United States Patent 9,328,346 (POLYCOMB-ASSOCIATED NON-CODING RNAS) - sequence listing, part 88

SEQ ID NO: 16364 - RNA, 155340 nt, Homo sapiens
uuuagaaccacacuaugauuucaaaaggcacaucaacauucaguugaauuucaugucuauugggggaucuuugauuucucucccccuaaauuuguguggggaugugaaaaagcuuacgcuuuagaaucugucgaucuuggugguucuugggcaaaugacucuccaucccugggaucuuguuugugucagaaggaugacauccuccaccuccaucagggcuaauguggggaucuaaugaggugccuuauguacaaccccugguacagaagagaggcacucaaucagagcugcuucuaaagcucuucuacuugaaaugaucuuuuuuuaauccucacucauacccugguuuuagguggaauaguuucuaaggaaacagaguccuuuucccauaggauggugcuggguuuuugugcuugagagagaccaucuuugucucucugagccccuuggacgccaagaugcauccacagggcaaggcacacgcaagcauuugguagguaaauauagaacccaguggguucggcagggaauuaaaguauccauuuaauaaaccucaagaacagcauagccuuuaauauaaagucccuucucccaaaggguugcaaaaacuuuugcaaugauuauugcuuuucauuuauagccuaauguuugaggacuggagccauaaacugaagagccagaaguagacgcuagcaacuaaaaauacugucaaugaaugucacagauauccaaaguagacaauucguuuuccuuccaguggcuuucuuggcaaaaaaaauaaaaauuaaaaaggaaaaaaaugacugaguuaagaaaacguuguaguguuugaugaugauaacuugcauuuuauaaugcuuuccagcuuacagaaugcuuucucauuauuauuucauugaauucuucugacucgcagagguagguaagacaauacuguguuaugguucaggacaugcugccucuaccacuucacuuccuagcagguggucaugugaguuagggaagugcucuaagcuuauuuuccaaauuuuuaaaauaggagucacaacaccuuccuuuuaggauugcuguucagauuguaugagauaagauaugaauaaucccauccacauaguaaaggcuucauaaauggcagcuguuacuauguuauuacauagaauaauccucacucggccaagguugggggauugcuugaguccaggaguuugagaccagccugagcaaccaagugagaugcugucuccacaaaaaauaaaaauguaaaaauuagcagggugugguggcauguaccuguagucccagccacucaggagguggaggcaggaggauugcuugaguccaggagguugaggcugcagugagccauguucgugccacugcacuccagccugugcgacagagugagacccugucuaagaaaucaucaucaucaucaucaucuuccuuacuuuacagacgaggaaacucaaaguggcacuuaauuugccaaagaucacaaagaucuaguaauggcagaacuggaaugcacaucuaauucuacuuccaacuucauuccuccuuccacuuuuccuuagccaagaauguaaaucaggaacauuuuggugcuucugccagcgacauuuaccauuaucaugagcucuuacaugguuucucgggugcacucagauuuucaacgucuacuuuuguauuugcagaacaucaucaagaaggugaucgggcagaaguuuguguacaaguuugucucuuucccggagauccugaagauggauccucacgcgguggagaucagccgggagagccuucugcugcaggacagcgacugcaaggcgucuccggagggccgcgaggcccacaaacacggccuggccgcccucagaagcacgagccgcaacgaauacauccacucaggccuguacucguccuucaccauuaauucccugcagaacccaccagacgccuucaaggccaucaagacggagaagcuggaggagccgcccgaagacagcccccccguggaagaagucaggacugugaucagguuugugaccaauaaaaccgacaagcacgucaccaggccgguggugucccugccuuccacgucagaggcugcggcggcguccgccuuccuggccucguccgucucggccaagaucuccucuuuaauguugccaaacgcugccaguauuucauccgccucacccuucucaucucgguccccgucccugucccccaacucaccccucccuucugaacacagaagccucuuccuggaggccgccugccaugacuccgauucccuggagcccuugaaccugucaucgggcuccaagaccaagucuccaucucuucccccaaaggccaaaaaacccaaaggcuuggaaaucucagcgcccccgcuggugcucuccggcaccgacaucggcuccaucgcccucaacagcccagcccuccccucgggaucccucaccccagccuucuucaccgcacagguaagagucauuccugucaucuaagccacagccagcuucaguggcuuagcaaaaaaggaagagcaacuaaagagacuuccuucugucccucaaaacguuguccuaugacucguaccgaggucacuguguaaaugugaagggaagcugcuuuuccauccucagaccaaggggugcacaugagacaggguuugguuugucgacucuagugggaugcuugauugguuucuugcuuuuagcggccuaaagugaccauagguggaacacgcacacuggccgacaaagcagaucucaccagcgauuuccaagggaaaguugagcgggccaguuuacauuucgggaggcgcuugggcuuuaugaaauuuuuauggcagaaucuucucugggggcgcuuaauaaggagccacuuguguucuguuaacaagaaaauagaugucaacugaugccgccaucgcaugucaguguggagcuguggucauagcguagguaauaagaaacaaaggggccaccccaaacagcugcuucgcugaaagcagcacuacucugagaaagccccaguccacagcacuggcgagaggacagcaaacuugcagagccaaaaaagccuucguuguuauuagucccaaagagaaagcagccuuuuccuuuaaaucagauauucagaugcucuuucuuguccagcugacaauugcagugcaaaggcguaguaggugcugggaaaccauauuucuccuuccccuugaaaauuggaugcaauuuuaguggcagagguuaaaagaguauucguuuuagguucacagaccugcauucaguuccuggcuacccugcuuccuaggagugggacugugggcgguugcucucugggccagguuccauguguggaaaaugggaccauggacaggcuuugugagcuggggacaccugguagcauuguuaaccguggagcugcacccguccccugccucuguaaucucaucguaguugucccuguugucauuagcagcagccgcggcagcauaugacgggcuccccacgugugccaggcacugcuccagaugcuuuacaugcauugccuguauccacacuuacagcagcccugucacguggauacagguugagcauccuguuuccaaaaugcuugugaccagaagcauuucagaguucagauguuuucagauuuuggaauauuugcaugauacuugccaguugaauaucccacaucugaaaaucugaaauccaaaauguugcaaugagcauuuccuuggagugucaugucaggacucagaaaguuucagauucuggaggauuugggauuugggaauuuuuggauuugggaugcugagccugugcuauuauuaucauccuguuucccagcugagauaaaugaggcacagagguaaaguaguucguccagggucccacagccaauaggugguagagguggcuuuggauccagugucugccuccagaauccaugcucucaaaugaaaugcauucccgcugcgagaaggcagugucccugaucacgauggccguccauggagcaccugaaagcagcucugggccacuguccucuccacgcuuucucuggacuggauucugcccaggauuucaugacagcucaagccugugagcugguggugacgcgcgccacugcggagggggagggccaggggaucaggauauaggucagagugagcacgugugcucuuaaaucaggcaucuuccaguuaagcaaggcuguccagugaccaagggcugcugagcaaauggcucagaaacagcagcuccugauguagcucaggggaguaucuugagaggcagggccaggguagaugaucugagcaucuccuccccuggccuccuguguguuuacaacugucagggugagaaagguccgaagccaggccagggcugacucugauuuaggugucuguguucccugggagccuggaucaccuucucagaacagagugaggcagaugccagcccugucucagaggaagucagcucagccagcccuguggauaauguggauggagugguggcucccaucgguggggcugagggcgugagagaaggaucaaggguggaugcccaacaaauggaugcagagggcacgaccaggagccagaagccaccagcauggccugaaacuaggugggaaggcguaggaaagccaggaucuuuacaagaggaccugugccuuaggcagugagggugccugguccucagccaagcugugaggguggggcugugaugauuuagugccaggaagcccagaaaugguccugaggggagggaggcaacaggcagcaucuggacccagggcaggagaguggaaguaaagggaccuggcucagagagggccuucgggucaaaggaggaggaggggcaccaggcaguccucuaaaccacgcaaaacuaagggggucaccagcuacacugggagaugguagagccucgggacucagaccccacuuugaacuucccucacauucccagagugugggcucugcuccuggcauggccauggguggccaacagggagggagagaaggggcaaugagggagacaccagaggggcccgggugguagucaggggugugguacuuauucagaguugaguucuugcagccgguuucacccaggcggauucccugagaucagauaggauaucuugaagccaggggugguuuaggauuaggguaugucagugucagauuuggacucucagauucccuccccugggagcugcuucagggggugccccagaaacucacccaccagcaccagcucaguaguuugucuuccaggugacagccagaaacagcguggcucucaacagccaggcauucuguggaauuccuuucggccucaggagugaaggacaacugugggguucaggguguuccacaggcagcagugaggcuucagugguuuuccucuuaccugagcacuuugucacagaaacucuccuuuucucuguguguggggggugugcugugugcagugugaugcugugugcacauaaacauuugauaaucugugggcugucagcuuugcuuaguggugggcuuuggaagaggugaaagcugugugugcuguaauaacccgauacccugaagguacaaauuccgaagguugguuauuuccagcuagaaucauggcaggaagaaggggagaaguaagggagccuuggcauggccugugucacgugguuaccuuaucacaccucauacaggcaucccucauuuuacuguacuuugcuuuauuacguuucacaauuaauuggugguuuuuacaaaucgaagguuuguggcaaccuggcgcugagcaagucuugucagcgccagucuguucuuccaacagcacacacucacuccguguuucaaugucacauuuugguaauucucaaacauuuccaacuuuuuccuuacuauuaugucuguuauagugcucugagaucagcgagcuuugauacuacuauugucauuguuuuggggcaccaugaaccacaccuguauaagacagcaaacuugaucaguguugugugugucccaacugcucuccugugucaaacuugaucaguguugugugugucccaacugcucuccugugucucccucuccuugggucucccuauucccugaaacacaacaauuuugaaauuaggccaauugauaacccuauaguggccuauaaaguguucaagagaaaggaagagcugcgcaucucucauuuuaaauccaaagcuagaaugaugacggugaaggcauguccaaaaccgagacaggccuaaagcuagggggcucuuauaccaguuaaguauguaaauguaaaggaagaguuccugaaggaaaugaaagugcuacgucagugaaaacaugaaugauaagaaagugggacauccugauuguugauauggagaaaguuuuaguggucuggauagaagaucaaaccagccacaacauuccuuucaggcuaacccagagcaaggcccuaacucuucaauucuuugaaugcugagagaggcgaagaagcugcagaagaaaagugugaagcuagcagagguugguucaugagguuuaaagaaaaaagccaucuccauaacauaaaagugcaaggugaagcagcgagugcuaauggagaagcugcaguaagcuguccagaagaucuagcuacgcucauugaugaagguggcuacgucaaacagcuucacuguaggugaaacggccuucuacuggaagaagaugccaucuaggacuuucauagcuggagaagagaaguccaugccuggcuucagagcuucaaaggacaggcugagucuuguuaguacagcuugugacuuuaaguugaagccagugcuacuaaauacacucugccugugcucuguaaauggaacaacaaagucuggacgacagcacaucuguuuucacaguuuauggaauaguuuaagcccaggugagaccuacuacucagaaaaaagauuccuuucaaaauauuacugcucauuacagugcaucugguuacccaagagcucucauggagauauacaagaagauuaauauuuuucaugccugcaaauacaacauccauucuacaacccagaagucaaggaguaauuuugacuuucaagucuuauuacuuaauaaauacauuucauaaagcuacagcugccauagauagugauuccucugauggaucugggcaaagucaauugaaaaccuucuggaaaggagucaccauccuagaugcuauuaagaauauucaugauucaugggaggaggucaaaauaucaacauuaacaggaguuuggaagaaacugauuccagcccucauggaucacuuugaaggguucaagacuucauuggaggagggaacugcagaugugguagaaauagcaagagaacuagcauuagaaguggagccuggagaugcaaccaaauugcugcaauuuauugaucaaacuugauugggugaguaguugcuucucacagaugagcagagaaagugguuucuugagauagaaucuacuccuguugaagacgcugugaauauuguugaaaugacaacaaaggacugagaauauuacauaacuuuacauuacauuacuuaguugauaaagcagcggcaggguuugagaggauugacuccaauuuugaaagaaguucuacucuggguaaaaugcuaucaaacagcaucacaugccauagagaaaucuuucaugaaaggaauaaucaauugggccaggugcgcuggcucacgccuguaaucgcagcacuuugggaggccaaggcggguggaucaccugaggucaggaguucaagaccagccuggccaacauggcaaaaccccgucucuacuaaaaguacaaaaauuagccagguuugguggcagaugccuguaaucccacuacuugggagccugaggcaggagaaucacuugaaccugggagguggagguugugaugagccgagaucacgccaccgcacuccagccuggacaacaagagcgaaacucgcaucucaccaaaaaaauaaauaaauaaauaaaagagucaaucaauguggcaaacuucauuauugucuuauuuuaagaaacugccacagccaccccagucuucaugacucugccuccuugucccugguucugcccugcuuccuccccugucccuuucuguagcuacccuaggcccccaugggagucuccauuuugucuccuuuuccguaggaucagugcuacagacuucugugggauuaacucaccuuuuaaagaccuuaaaaccaugguuucacuugaauucagacaacuuuaggagcuuccagagauucagucaccuuuuauuugaggacauuuuuuuaaccucaagguggcauugucauggauucuguuggcaucugugggagcuuaggauuacagauauuuguggguacaaccugcuagacaucuuguuucucucuccuuuacuuucuuagagacugagugacuuaccgguaucucagaucaccaaaucaagugaucagcaaauacuucugcaucuucuuuaaucaguccaguaacaaauguuuaucauguauucauucauuugggagauaaucacugaaaacuaagcauucgcuuagauaccuggagauacagagguuagcaagauagaaaccguuccuguucucaugaguuuacagguugcuguccagcauacggggcaauauauaacauaggguuauaauuuaggguggugugaaauuauggaggacccugagaacuggcuaaggaauuuugacuuguuuggauuggaaauuaacugcuagaggcugggcgcaguggcucacgccuguaaucccaauauuuagggaggccaagggggcggauagcuugaggucaggaguucaagaccaaccuggccaacauggccaaaccccaucucuacuaaagauaagaaaauuagcugggugugguggugcaugccuguaaucucagcuacucgggaggcugaggcaggagaaucgcuugaacccgggaggcagagguuacagugagccaagauugugccacugcaccccagccugggugacagagugagauucuaucucaaagauaaauaaguaaauaaacagcugcuagagguauaagugaaaaaaaucucauuagaaucaacaaauaauuauugagcaauaacagagccuagaaaggacaccaaaacuacaguugcuuguuuuuaugaccuuaggaccuagccaugacaacaaggcauuacaagugcacacacacacacaauagcccuuggcaagagucaaacaugcagcacagagaagcgcuuuaggagcugaggggcaagaucguuuaguucaggucaacacacaugaacugagugcccaucaugugaaagcugcuguguuuggagcuggggcuacaaacguggauaaaauagucucugauaguuaggagcucauaacuuaagucccuucaucuaguaucucaggugcaauacaaaaggaauacuaaguugcaaaaggaauccuaaggaggaagguauuaacuuugccugagauggaggaagaauguccagagggcuuccuggagggggugagaccacugguacaggguguugaaggaucagccuguggcaggguagacagggagaggaaggcaucgucggcagaggaacagcuugaggcaaggcauagauacgugaaauagcuuugugauuaggggagguauagcaauaggaagcauugaagggguaugagugacagucugaauuguuuuaggaaucacccugcuggcgagauugggaagggggaaggcuggauccaaguaggaugcuauuggaauauuccaggcgaaagaccaugaguaucuaaggcuguauggugggaggggucagagggauggaucugauguugggagugccgucagcaggaguuggugacugacugggugggaggaguggggagagccagaauugagugugaggaacaugggaggaagacuaagcucccugggaaaaggcuaaacguccagucggggccaugcugaguuugaggacccugcaggaaauucggguggaaaaguccagcugcaucuggagagcggagaguguuuuggagccggagaggaaguuaggcagucaucaacacgcaagggguggugaaaccaugggaacggaugaggucacuuguggagagggccuguagcccagggaacuaugggcugggcuggguggucagggaaguucugagggagcguugaaggacuguuggguuagaaugccuguuccuccgugcauaugaggaaagcucaggacacaucaaagcaaguaagaggguuuggggagggaagugucuacgaagagucaaacucuguaaaauauuugaagagauuuauucugagccaaauaugagugaccauggccugugacacaguccacaggagguccugagaacaugugccccagguggucgggguacaguuugguuuuauauauuuuagggaggcaugagacgucaugaaauugccaggcaacuucaagguauggcaaggaaauauauuuugggguuaaauauuuuuuccucguuccauaauguuacuccagagucagauugaaaaguaagucaccauauauagggucaaauaaaacccaucugaugagaauuuacgguuuguagggcaugacucccuagaccccuagguaggaauuugggcaagauaaaaaaugagagcuuaguccucagaaguuagcaagugugugaacccagauuauggggaaccucaaaucuggggcuaaggaggacaucacauccuuucugaaauggugacugaauguugagugaacucaguguuugagggugguugauuuggcgaugggguacagaauagauggggagaccggaggcagguggacuggccugggcagcuguuguggaaugccaucuguaaggugauaggggcuuggaugcagcaggaauggaaaugagggauaaacaggagacugaguugugggacuccuccagaggcuauguccggagcuugcaguuaucggaaggcauuuugcaugguggggccugggaugcgggugguaaauggggcugugcaugcaggguuuaugucuuguuuuauccucaucuguggcaccugaaacauaguuugcacucucggucaguauuuauugaggcagugccuacacggugguccuguugacagaaggggaagagucuuaagaaacacugauguggaaaggugcugagcuucaugaaguuggagcaugguggggcauccaaguggagaugcccaacaagcgauaagccaggggggacccagcuagagcugcagauggcuucaguucauugguauuuaggagaugaaaguacaggaggaauaaagaugagcagauaccuuaaaggcuacagaaagaauaagaaaaaugugccaaucaccauaauaggaggcagaacauguuaaauguuaagaaaaaaauggucacaaaguguuacaaagauucagaaauaagaaaucccaucugguugaggggagaucaggaaaguguccuuggaggagguggcauuuugaugggcagaggaaggcaagaggaggaggcagcgggccggggcaggggugcacaggugggcaugccuggaugccagcucacccuggcgagcucagaugugcaggcuuuuuaggagacucuaugaaguggaaguggaagaugaacugaguggggaaaaugaaaaggggaucuugggaugagggucuuacucuuugcaaaugcauugccuguggcaucuccuuucccagcagccgugggaucaggagcuccuuaucugccaugcuuguuaaaacgagacugucuuuggggaaggaaagaaaacagcacuuuuugcuguggcuucuuuagcccuuggcccucaggcucagcccacucugccugacuccaggagcguguggagagaggcugugaagucucacacugucccggagauaacccagagcagguguuauaggaacuuuccuuaaaaaagcaaccacaugguucuuuaaggccacaggauuuucagggagaacuucagggauagaagggagaggagggaaugaaaucauuuuacaguguuuauuugcauauauuauagaagacauuucagacauauuaaagaugagaaacaagaaggcuacaguagucugaguacauccuguauuccuaagaaacaaaugugcaaacaucucaaauccagacauggguauacguuuuagaccagagaaauagaaauucuagaccuuguacauugcuuagaggauuaaaaaggaaugggcauaugauggccauggaggagagaaggauagcuguguuuugugguuuagaagauugucucuuuaaagcuuugagagccuucauugauggauaaacuaggaggccuugaacacacugguuauuaaauguuaaugugacauauugagguuggaaccuugcuccagaguaacaugcaaauauuaguuuucagaacaccugagcuuguggccuugagccuaacacaacugacaguagccuccaaguccaggcugacucaguugaguuggucuguuucagaggauuaaguccuucucuguauacaguugagaauuucucccucacauagaugaaguacguuuaguaaguaugucauguauacuuucaauuaauuaccaauccauuuauucauucaaaaacauguaugaaguaccuagccagauaacugccucuggcacuuguugagcauuucuauaugccaggcacauaucuuauaagagcuugcaguagaucagcuuauuuaaucuucccaacaacccuguaacgugggcauuuuuauucuccccauuuuacagaugaggcaacugagacagagagagguuagguggcuugccugagguuaccuggcugggaaguagugguucugagauuggaacccuggcagagcucaugcugagccgugaaguuuuaacuguuaggccagauggccuggcaugcuugugaaauugccuuggacuagaacaaaugggaagcuuauucaaaacauguauuuauucuaguaaccucauaggucauucaguauguaggaaaugccauggaaccaacgacucaaauaauuugguauaaauguguuuacauuucagcagcuucacaguuugaggaacuuuggauguuugucuccauucugcugaacagagcagaccuuucaauuuagguuuaagccaaaugcuguugguaauuaaugaugcuacggaggccaauucuaggaaaaaauaacacuuuagcauccagcauggugcagucugaaaggcuggcgccuuugcugugguucuucuuacacaaagcaccuuauugacaucacaaaaccacugagggacuccuucuagucaccaaagguacaaaaccacccugggccggggaguuugucuccacugagaauaaaagccaugcagacuuagcagcugggcggguguuucuucugcccuccugcuggcuugcaggccaggacuccugcugugugugugcaagaaauucaguccuuggaacuccccugggaaacccaggguuuuggcuuuauacccaaucugacaagaaagggcccucccugcccccacccaaaccauugccagggcaaugaauucucaucaacuccacauccggaaggaaucuggaaaacccggcucagagcuucugaagaggcugcuacaggguauuuuaacagcaaaucccaaagccuuaacagcuguugauauggagaccauuuaaaaacguguguucguaacccaaguaauagauguccacuguagaaacacaggaaaauauagauaagaagaauuaaagccccuuuaugggauccuauuuuguuuguauacuaauccuuguuuaaucugggaaggggaacaaguuaacaaaccauucggacgaaaguugauacaaacuugaauuuuccaccagaauguuuagggaagguaaugugucaauaccuuuuuccuuuaugaaaaaaguguuaauaaaauuagcauugaagaaaacuagccagccagguaugguggcucacgccuguaaucccagcacuuugggaggcugaggugggcagaucacuugaggucaggaguucgagaccagccuggccaacguaaugaaaccccuucucuacuaaaaauacaaaaauuagucgguggugggugccuguaaucccagcugcuugggaggcugaggcaggagaaucgcuuaaacccaggaaguggagguuauagugaaccaagaucgcgccauugcacuccagccugggugacagagcgagacugucuccaaaagaaaagaaaauuaaaauuaaacuguucacagccccucagaauuaacguugccaguuuuccugagaugguaaggucguuuccuggcccaugccuagccuaccuaaccucucucugcugcucuguugaucauggcccaagucaggugaaccuauaugaagaagucuguuugcuuuacuucccagacaccaaauggauugcuucugacuccgaguccacugcucuccagcauacauuucuggagcagccuuaguccaguugcuccgcugaguccugccaggcugcaagggccaagcacgcuguuccaggugagcguuuggaaaugaacuuuugaacauuaagcuucugagggaugguuuuuucucuaaauccugcagagguaacggugaguuuugccauauguugaguugaaauauuaaauguccagaggggguucauguuagugggguugcacgcccuucagaggcagacauuuucauugaggcagaaauugcagacucaugccagacacccauacguggaacaauuaguucuuaaaguguuuugcauauuuucauuugucuaugaaaacaggaaauuuauuaaggaaaaggcaaaacuuuaagaauuauucuuuaggccagugugauggcucacaccuguaaucccagcacuuugggagguugagggugggaggauuguuugagcccaggaguuugagaccagccugggcaacacagcaagaccccaucuauauuuaaaauaaaaugaaaauaaauauuauuauuuauaaaaguccacaaaagacuuuaaaauauuaauccuccuaguuaauguagcaacuuguuugacauaaagugaaaauaaaaauagugaacaauuuccccauccugggauagaaaaauuacuugcaucauuuuaugaaucaucauuaaguucuccuuguucuguaaugaaaaaggagaauccagggcauuugguuaaaaaauaaugaagacuuagcugcuuuaucuuauagaacucuccauacuaggcgagcaccuucauuauucauucacacaccagaaucuugcaggaccgucacuugcuaucauggagaaaucaguauuuccuccuugagacccauagaucauuacucacugauuaagguguuacuguuugaauauguugagugcagguggaaagaauccuagggacaggacugaagaaaagguggacccagugcaaacucccucuuucccaaauucuagcuuuucucaucgucccugccuguauccugugccccacaguguggcuuaccccaaguuaguugcagcucuuuggauaccauuucaucuagcacguggcacuuuguauuaugauugccuguugaucuggcaaucuuucucacuaaacuaugggcccucgagaccagaauggaauccuguucacugugguguccccagcaucuggcacauggcuugguacacaagugaggcucaguaauaauugacugucuaaaugaauucacaaagagaagucugagaaaggccaguauuaauagcaagucuucaugaucaucugagcuggucauuuugcuugucaagguuaaugucugcugaguaccuccucugugccaggagcuguacaugcugggauucagggucucuuuguaaggguggagcuaaagagguuuugauugccaucuugcuucuuugguuuccuaguggaguuaggguagggugucaugaagugaccauauccuuggaguaauuggguuucuaucucuuucacagcccuuauucccaucacaacaacuugagcuauagucauguugauuuuuaacaauuucagcuuggguaggaaaagagaaacuagaaauagcaaaaagcaaugagcaaauguuguauuaggaaaguuuaaaauuaggaauacuaaucuuuugguggagagauaaaaacaccucauuuccugaaagucuuaagauuagagcagcagaauucuaaaauuaauagaauagaaagaaauuguuugguuacaguaaacuccauggcaguagggauuguuauacuacucuaauccuagaaucuaacacagagcuucuguagaguucaguagguauuugugaauaauaaguggccucucauuucucuccuuacugggaauucugccaccugauuggugcaggccuuggcaaccuccuaggaaagcaauggagcacuauuggcuggggguucuuugggauuccuugucuuagauaccuuuuccagcccaacacucccaacaggaaaugaugguucaugucuacagugauucgacacguuaucaggaucucugggaguugggauacgugcauccgcucguuucuucaguccucagucacuacuguagaccaaugguucucaaaguuagcaugcaaaauaaucuccuagagggugaguuaaaauaaagauugcagggccccacucccagaguuucugacucaguaggucugggauagggccugauaaaaacuuuuuuuuuuuuuuuuuuugagacagagucucacucuguugcccaggcuggagugcaguggugugaucucugcucacugcaauuuccaccuccuggguccaagugauucucuugcuucagcaucccaaauagcuaggacuacaggcguguaccaccacacacaguuaauuuuuguauuuuuaguagagauggaguuuugccauguuggccaggcuggucccaaacuccugaccucaagugaccugccugccuuggucucccaaauugcugcgauuacagguguaagccaccgugccuggcccaaaaacauuuuugucauguuccuagugauacuacccagucuaggaaccaauuugagaagcacugcagaccagagguuccuaguuuauauuuagaauucugcaucagaaauuacugcauuuaaaggcuaccugcuuagaguuuuaauuucaccaaguggaccuguucucuuuccugaagccauucagaauacaacccuugaaaaaaaagacaagcugguauuccggauggcugacagguuguauggccuugggcucucuuuuuguggcuggauccaggagacuaaggaaaaacaauuuuuugccuuuuaaaauauuauuagucuuccugugaaaagagcaacugaguauggcaaaaguugaaaauagcaauuuugagaacgguaaacaacaaaauaugguagaggaauaacuuucugauuuuuaaaacuagauguuacaauugauacauauucagaauucagauuacuaucagcagugccucuuauuuuuuuaagaacuuuuuuuuuuuuuuaaauuuagagacggggucucauuauguuguccaggcuggucuugaacuccuggguucaaguaguccuccacuucagccucuggaguagcugggacuacaggcauaccaccacgcuggccaacaucccuuuuaaacugaugaaaauaauuuucuuucaaaauaacaacaaaccucuuucauguacgcuauagauguaaugaaggaagaaaaaaauagauuuggcuuacacauuuuaaaugaugcuggcaaguuuccuauuaccaugauuggaaagguugaucagaauccuugggguaauaguugaacagcugaagcauuuuuguacagaagggccccuaauaugauuacuauagcagguuauagcagauaugaaagaauuccaaggaaggagagagaagacgccuuucuggaagagguaugcuuuaaaauugagaaauguuuagguaaggagagaggcaccgaagacauugugcuaaauguaaacaaagaaccuugauuuauauaaauaaagugaacucgguuuuucuuggacaguuuauuauuuucuucuugucuaaggaugucuguuccaugacuuuugaaacagauuuuguuccaauguggaauauaccuaguaggaauagguaugucuugaaacaagguagagcuaauuaaguuuucaauuaagaaugugugcuguaauuuuuaguucaacaaaucuaaccccagcaaauauuugcaaugcucugcgacaaggacuguagggacagagaauaugugaauaguggaugaguaaacaaacugcugcagaaaguaaggggcagacgcgcuuuuuccagcuggccacuggacaggcuccaaggaagcaguggcgccucagcugggaggaagggacaggauuucgaucgaguacauuuagaugaauagagccgaaugacggggacgugagagucuguucaggaagggaccaggugauaggagauaagguuggaaacgcagcugugggccuugaauauaggcuuaggaauuucucucuuuaucuguuaaauguuuacgcuuuuuaagcuggagguaggaggaugagaucucuguuuuagagaacaaucacugauauuaguguggaggaagaacugaagagaaaguggaaggaacaggaagauaagaggaaauuuuuauuuuuauuuuuugagaugagcucgcugugcugcccaggcuggagugcgguggcacaaucucggcucacugcaaccucugccuccugggcucaagcgauccucccaccucagccucucaaguagcugggacuacaacuacaggcauaugccaccaagccuggcuaaguuuugaaauuuuuuuguagaaacgaggucucacuauauugcucaggcugguuuugaacuccugggcucgagcaguccuccugcuuuagcuuccuaggaagggcuaggauuacaggugucaacgaccauaccuggcuagaggaaaugauacuacaaauauugaagggagaaucaucuuugagauuaaaacaguggacacaggauauaauuagaagacauuuuagaggugagcucaagagaggcagacuuugagcugggucugagggguaaaguagguauugaaaauuaaguagaagcaaagauuacuaagugauuaacauacuggaaaugcuacuaaauaacaauaguuaaggccgggcauggugguucaugccuguaaucccagcacuuugggagggugacauggguggaucacuugagcccaagaguucgagaccaucaggggcaacauagcaagacccugucucuccaaaaaaaauacaaaaauuggccacgugugcuggcgugugccuguggucccaacuacuagggaggcugagguggcagcacugcuugagcccuggagguugaggcuguagugagccaugagcaugccacugcacucaaaccugggcgacagagugauccugucugaaaaaauaaagauaaaacauaacaauaguuaacauuuauugaugauugaugacuuauugugugcaagacguuguucuuagcacuuuugguggcuucucauuuaauacucccaguaauucuauuuuagagauaagaaacuaaggcacagggauauuggcuaguuuauucaagauaacacacucguaagugguggagcccugacucaaguuuuaaguuuguggucccagccaccauucucacugacuuggaguaagcaauggaagaagggcgaguuuugugggaaagaggcauugguuggagaugucuaaaauggaaaugguugucaaguccaagcaugguacuggagaaaagguggcuggggacaaaaguuugggaaacguugcaguuuaaaauaggggagugucaugggagaagagccuaauaaagaugacuaaaaaaauguuagaaaagccaggcuaaucaagagaaacuauguccauugaguauacagaaauaauaagggcagaaaucaguaauuuauuuugcaaaacagaugaauaccaaaacugauucucuugaaaacaccaauaagguacaccaaagagagagaagaugcaaauaaacaaaaagaaugaaaaugcaggcugggcacaguggcugacaucugcaaucccagcacuuugggaggcugaggcaggccaguugcuugagcucaggaguuccagaccagccugggcaacauggugaaaccucguauuuaccaaacauacaaaaauuagcuaggcaugguggcauccaccuguagucccagcuacuuaggaggcugaagugggaggauggcugggagguggagguugcagugagccaauauugcaucacuaugcuccagccugggugacagagccagacccuaucucuaaauaaaauaaauaaauaaaugaaaauuuaaaaucuguucaucuucccauguucacucuaacucaaugggaagagugguuaguagcacggaccuuuuaaacaagaguauaaacuauaugugcauagauuugauaaugcaguugaagugaauacaauucuagaaaaaguuaaaauucuaaaguuccagaaaagaaacaaaaaccuugaauaugccaauaaucauuaaagaaauuaaaacaguaauuaaagauacccccuaacuccuaccaaaauaaaaaguuguaaaauguugguacagaaagauuuguuuaaaacuuggcuguguugcuuauuagcugugugaccuuuagccaacagaacuuauuugaaaucuguuuucucaucuguaaaauggggacaacaaaacuuacguuacagcuccuagguaucaaaugaaaugacaagccuugauaaacucuaagguacuagacacaaguuacugaaauuguuugaaaauugcaaaaacauauuuacuuaaauauaaguauuuguuguacuucuaacaugugucaggcucuguaauuugauauuuggcgcugaaguuuaacuuuccuggacuaaauaggaaauaagcuagaaaagacagcccaggagaucuuuuugacacaucauccucaacaacgaaaaucuaguugcaaguagucacauauuaaaaggccuuguucaguugggauugcaacuaacauauuuguuucagaccugaaacucauuaucagagcauauacugucauccuacuauauuuaucaucuuagugaacaacaauacagaaaucuuauucuuugucacuuaugagugaucugugugauauuuuaauuagaauacuuucuuagcuccaaaauaaucuauucuaaaucuuuaaauacauuucuuacuuuagaauaaaugcugcaagaaucaucuuuguaguacccugaaaaacugauggcaaauuucaaaauauaguauuagaaauuacugacucacauguaaagagucuaugguuuucaaaacacucuuuuaauauuuaauauuaaacauuauuuuaauauuuauagcauuaucagcauccugaguagcuuagaacuuuuaaaaaauaguguuagaagaugcuuuagcaacauauaaauuauauauuuuuuccuaguagccuaugcauauagaauaauuagggacauuuucugggccuuauccuuuguuugcucuauguaaaucuugaucucauugucaucuuccaauuauucuguaaaauacauuggcaacuaaucucuaucacaggggugaugagagaaauggacugcuauggacuguaugggaauguaaagaaccuaaguucuucccaauggauuugcaauaauuauuguaaaaaucuuuuguccccuacaguuccccacacugcuuaauggccacaugccagugccaauccccagucuggacagagcugcuucuccaguacugcuuucuucaaacucucagaaauccugaugacgucuggccacaauuaaggacucauuaacugaugaaacaaauuuguccccacgggcuaguuuaccugugucgugagaaggacauugugaaacucuuguuaauuugguuugcacuuuucauaacauggauagucuagauuuauguuagcauuuuaaaaacuguuuuugauauauucaaguauauaugaaaaucuguuuggcauuaagugaauuuuaauguuuuuguuuuuauauccuuuuagcucuuaaguguugaacacuguugacagugaagaacuuuucuuaaugguuuucaguauaacuaauaaggaugugaagcuuuuuucucuuuaguucugaguaugcuaaacugugugcuuauauagacuauaaccaguugugccuuccuucgcauuuaauguaaaugaaugauuuauauauuuuuuaguauuaagaggaaauguuugaaagaugaaaauuaguaucaaacagcucucuaguagaauuucauuauuuuucaccagugggcaauaugaaagcauauaucacguuuuguuuuacuuucaauuguauaagaauugccuuagaaccucuuuugaacugaaauucaguaaauguccaaguaauguuuuuauaauaaacuaagccauauuuagacaauaaacauugauaaaagaaaauguucuaaaguacauuuucaaaagaauggaccuugaaaggcuagccuccuuagcuguuuacaguaucuuaucuuuuagaugccucccagacaaaaaucugagauggaaaagcuacaucaaguucaugcuauuccaggcccaagaauaucuccuagguuagcauauucuuauuucaaaaaauuagcccugguuuucucaguuuuccauagggaaucccgaccaucugauauauuuacugugucaguauaaguaaguugggguuccccuggaacuauaauuaacauuuaaaaaaucuaaugcuuuagaagaagcucacagaguggugaugaacccaaacaacaaagaaaccauuuuuaacacuagguaucuucaucaguauagguagguguucacaauuuuugauggaucaaaaacuugcuguaauacaaauagagaguggagguacuaaaggccuugcuuguggaaacugagagaggauacacugcuuuauguauuacuaaaguuaggggagaaugaaggaaaucugacagaugaaaaauucuacaggaaccucaucaucguggaacugaacugaugauaacuuggaacacuccaguaaauucuguuguguaauguaauuuggagcagugauaauacagacauauuuucuguuccaucagaaaaucagcaggcaccaguccaaagguaccacaccuguacaugaagaaggaaaguucuaauacaagaaaacugaaaagcaccaagcuuuaaauucaagauuaauuacaauccuuaacuauaagugaugauaaaaacuaacuugaaaugugacuaaauaacugauccaaacugggcauuaaguggcaggauuaugagaaaggauaaaaaaagagauuugagaaaacacauuucuugaauuuucagaaaaaaaucuagacuauugcuuugacacuuagaaauucugagguuuuucaauuggaauugagcaucucuguauguggggaugugggcccuuaucaagggauaaaaauccaaacacucuaacaugccuccuugacuguaaaguaaugacacugguuccaaaauucacaaauaauagacacuacuguccccccacccccaccccauaggcuaagaauaauucuguaccagaauaaaaggagcugguccagggaacugauauuuacugaacauacaaaguuagugcuagaaggggccuuugagaaugcuucccgccaccuguuuccagcucaagacaggugcacagcagaagcugggaguugccuauggcugcacagcucacugaagguagaacaaugauuggugcucaguccaauucugucucccccaugccuagcuguuaaguaauuacugguucaaaacuacguguuauuaguaaaacaaacaaaacagauaaagacagcauuuaaaacuguguugucagauaagagaacacauccaaaaugcaugauucuuacaaacuaaaggaaguuaaugugcaaaaaucucaaccaaaacuacuauuuuuaguauacuuguuuacguaaaugcugauuggaaauauuuaaaugacuauagaucugauucuuucuuuuccuuuggaaacugggauuaauguaugcucuagauccauuuauuagaaaugcaaaaauacuacaauuuuuugauggaugaaaauacuccuguaacacaaacagagaacuggaggaacugaagaauaacucacucauauagcucugccucauucugugugugugugcauguguguguuagcagagguauuuuacucagaaaauagguuucaaagaacauuaaugacuuucuuuucccuuuuaugucugcuuaaucaguguuaaacugcuaugggaaaaguuuuauagaacuauauaaccugaauguuggucucuuuguacacaucuuuucuaugacugcaaaucuucacuuuauguaucauuuuuacugucauauuauuuuuguucaauaaaaacuuugugauaaaagguguuuagagguaacuggauuggcuuacuuccauuugcuuggggugacccaaaccacuuuuccauauggauacaaguuggaaaaugagucuugucaccuacccuuaaagacagcacauccaaaaaaaaagugcuuuacauacacauauuuuaagaaauaaauguaauuauugaggcugacuugugggagaauggaauggauugaaaagcagaccccugaucuuauuuaaguucuaucaacugcucuguauugaggaggaggaggaagugagaagguaggggaaaaucaaaucuaccauuuauucuuuuagccauuuuguugauucaggggaaugugaacugcuaggcuuggugauaaagguuauuauuucucuuggucucaauaccaggcugaccuggcucugguuuucaugggugauucaaagcagucuccacucaggguuugauauagggagacuggugugaggggaggggaggggaugcagggagaaagcagauuaaugcagucccuaaacaacacauucaguaucacuagcgugccaaaaggccacagauaacucacagcuacauauaguguaacacagguggcgguaggaaaucauuugcuuccugaagaaacauuuaaagaucaacuauguuccaggugccauuuuagaaacgggggauggaaacccgaucccuguucucauuaauaauuugcuugguucuguuuauacauaagaauucaacuggcugggugcgguggcucacgccuguaaucccagcacuuugggaggcccaggcgaguggaucaccugaggucaggaguucaagaccagccuggccaacauggugaaaccccgucucuacuaaauacgcaaaaauuaguugggcaugauggcaagcgccuguaaucccagcuacgcgggaggcugaggcaggagaaucaccuggaucugggagguggagguugcagugagccgagaucaugccacugcacuccagccuggaugacgagagcgaaacuacaucucaaaaaaaaaaaaaaagaauucaaaucaguuuuguaaaaugcccuuuuaugcuuaaauacccacagggaucugcgccgccccuucguguuaccugggauuauaugacccugccuaaaggauuggcacugaagaauacacuauguuuaguuacccucucucaggugagucagaucucuaaaacaugguuuuauuucauugcuggauggcauaauuucaguuaaugauagcaaccauuuguaagguugcugucaugccaggcacuguucuaagcauguuacauggauuacuuaaucuuccuaauaaaccuaugauagaaguacuauuauauaccauuuuacagauaaggaaauugaagccuagagugauuaaggaacuggcucaaggucacagaauuggccagauuucaaacagcauuuugauugagaggccauggucuuaaucuauaggacuuccaacgaauguaaauuagcaauuuacaucuucacauagaacaguaccuggugcacauaaaccuuucagacauguuugcuauaucaguguuuccugggagggcaggcaaauuuucugucaucaagaagcuggcccuaccuagauuucucuaguauugacuuuauuccuagacccacuccccaguggcgcguguguaccugcauaucugugugugugugugcguguguguguguguguguguugagaacagcuugaucauagguuaguucuuaagauuuuaaagacucacauguuuuagccagcuaggaagaaaguuucuaucaccaauuuuugacagcgacauuugucuuugguugacucagagaggggacgaauccaaguugauauuacauaacugacaaaagauuuuuuagaauuacucagaauuucaucaugcaugugugccuuaauuugaucagcaaauacuacuguuccccuaaaauguaucagguacuaggauaaagaagagcaaaaugcaauccucuccuucauggagcuuguggauuagugagaagaaaugacgugugauuaaguguuguugcagagugaaguauaaggaugcuauugggaaggaaggcaguuaagcagcagagcacauaacccagucugugguaggguagguggggcagagaaggcuuucuggaagaaaaaauuacauugagaaugaguaaggguaacaaagagaagaggcauagaugaacaagcagaggaaaggggauguuucacaaugaggugaggugugaggaacucaaaagaucaauauggcuggauuuacccucacagagaacaaagccuaucucaucaucauaugggauaguaauguagauaccaguagcaacagagucgaaauugaaaagggaggaaggaggaacgcuucuagaucccugaggaguaaaugacacagugauuagcuacgauucuguggaagagcaagauggcaggauggggcccucaaaaauaaacuuuuucaguguuucuggaauaacaguccaucaucaucauccagagaugagcuacacagccuguaacagcaccacgucacccauucaucacuugacaaccucagcugcauacauacaugaggaagaaaauaacaagauaaagaugauccuuaagacuauuuugacuguuagaauguggaacuauugucaauauagcuggagaaacggcuggagaguggcacuguuucaacuagcacuguucuaggaaagacucaaaagagucccaagggagucuugcguuaagucccaagucuauucacuaaaauuccauaggucaaucagagcccaguggagccauccuuugguaaacauacaagacuguuggcagacgcuaaguuucccuuacccucugaaaggugcugcauauuauccagagggucaccagcuacaucuucacaucuuuaugauccagcccagguaucucugcaucacuacugcagcagcguuaaggugggagagaguagcaagaacagccaucaggauuccuauuccagcuucagucuuucucucccugucccccucucacagaugcacaccugcacaucuagcccccacacccacucuacucaacagagguuuaguuuacagucuuugaaaugguaaucuuugaaaaauggguuuucaaauuaguggaauuuucccacuucucuuagggggaacccaccaaugaaaaauccuccccaucaucacagauugaaauuuuauauucuccucuaaucaaaguagcuuuauaaucaguggcuuggucaccuucuuucuguuugagucuaacagaaaauugguaacuucagugauuuucugggucagugauggaaacugauuauuguaauaacuucagccgggaaugaugacagcucagggaaacuccuaucugacuaagcccagaaucugaauuuaagauuagaaaauaguuucaggccaggcaugguggcucacgucuguaaucccagcacuuuggggggccgaggcagguggaucaccugaggucaggaguucaagaccagccuagccaacauagugaaaccucgucucuacuaaauauagaaaaaucagccagguaugguggcauguaccuauaaucccagcuacucaggaagcugaggcaggagaauugcuugaaccugagaggcggagguugcaaugagcugagauugcaccacuguacuccagccugggugacagagcauaacuccaucucaaaaaaaaauuuuuuuuaaauaguuucagcuuuacacugagcaagaggggaaaauguuguaccuuucucuugggucuaaaguaaugcauuaaaaacuuuggaaauuucaaguuuggaacauagaaaaguaugcaaauucuucagcagccuugcuugagggcuuguguuaacacuuaaaauucugauauggaugaauuugucaaucagaaagaaucaauguaagaaucuagaauauuuaaaaaauaaaaccacugacauuauaaauaauaaacucgaagggauuacauuuggggauaaauauuuuaaaaugauaggaacugaaaauaacuaaaaauauacaggcaaagaaagaagaaaauaaaaaugguacauuaccaaaaaaaaaaaaaucaaauacaaggcaguauguagaaacugaagaacaaaaagcacauaagacauacagaaaacagcuaaauggcagaaguccuuccuuaucaguaauuauuuuaaauguaaauguuguaaagucuccaauuaaugggcagagaugggcaggauggauuuaaaaaaugauccaucaauaugcuaucuacaagagacucacuuuaaaaacacagacacuguauuuuuacuuugaagaggcugaaaauaaaagaauggaaaaaauauuccauacaaauaguaaccaaaagagguaugggguggccauauuuuugucagauaaaauagacuaaaguaucaaaaaaaaguuacaggagacaaaggacauuauauauugcuaaaagguucaauccaccaagaagauagguaacaauuauaaacacauaugcagccaguaacagggcccccaaauauaugaagcaugcacucacagaacugaaaggagaaauaugacaauccugcaauaacaguuggagaugucaaugcucccacuucaauaauguacaaaagagucagaucaguaaagaaagagaggaacugaacacugugaaccaauuagaccuaacagacacauaccaaacacucuacccaacaauauuuuucauagaaugacacauacuuucucaagcauacaugaagcauucuccagaacagaccauauguuaggccacaaaacaacucuuaauacauuuuuaaaaacugaaaucauacaaacuaucuucucuaaccacaauggaaugaaacuagaaaucaauaacagaaauaaaaaggauuauaagagacuacuaugaaaaaguuuaugucagcaaacugguuauaagagauuaaauggacaaauuccuagaaacacacaaacuaccaaaacuaacaagaaauaaaaacucugaauaaaauuauauauaacaaagagacuguaucauuaaucaaaaccucugaacaaagaaaagccaggaccaggucaccucacugcugaauucuaccaaauauuuaaggaagaauuaacaccaauccucaaacuauuccaaaaaacugaagaggagagaacacuuccuaacucauucuauuaagccagcauuacccugauaccaaauccagacaaaaacacuauaagaaaaguaacuacaggccaaauaccuuaugaauauaggcaaaaauacuaaaaaaaauuuagcaaacuaaauucagcagccuauuagaauuacauaccauaaccaaguaggauuuauccaaggaaugcaagagugguuucacauaugaaaaucaauguaauacacaucaaaaaaauauagaaaacaauaugaucaucuuaauugauggagaaaaagcauuugaagaaaauccaauauucucaagauaaaaauacucaauaaacuagggauagaagggaacuucuuuaacacguuaaagaccauacauagaaagacacagcuaauagcauacucaauggugagagacugaaagcuuugucccuaagaucaaaacaagacaaggauauguuccuucaucacuucaacauaguacuggaaguccuagacagagcaauuaggcaagagaaagaaauaaacagcauccaaauuauaaaggaggaaguaaaacuaucauuccuugcagguaacaagaucauauguauagaaaacccuaaagacucuacagaaacccuguuagugcuaauaaucaaauuuagcaaagcugcaggauacaaaaggaacacacaaaaauuacuuguauuucuauacacuagcaaugaaaaaauccaaaaagaaauuaagaaaacaacuccaucuacaauaacaucaauaagaauaagaugcuuaggaauaaauuuaagaaggcaaaagacuuguaugcugaaaacuacaaaauguugcugaaauuauagaugaccuaacuaaauggaaagaaaucuuguguucauggacuggaagauuuaauauuauuaaaauuguaauacuacccaaagugaucuauagauucuaauuuaaugcaaacccuaucauaauuccaaugguguuuuguuguuguugcagaaauagaaaaucccaucuuaaaauucauauugaauuucaagagacucugaauagcuacaacaaucuugagaaagagaacaaaguuggaagacucacauuuucugauuuaaaacguucuaaagacaguaaucaaaacauugugcuacaaacccuuauggacagacauauagacuaauggaacagaccugacagcccagaaauaaaccucacaucuauggucaacugauuucugagaagggcaccaagaccacuuaauggggaaaggacagucuuuucaacaaauggugcuggaaaaaaaaauugauauucauaugcaaaauaaagucggacccuuacuuuguaucacacauaaaaauuuaaauggaucaaagcucuaaaucugacagcuaaaaauauaauaaacucuuaaaggaaaauauaagagcaaauauuuaugaccuuugaaacgugacaauacuuucuuaaaucaccaaaagcacaggcaacaaacgagauaaaauagaugucguuaaauuaaaaacuuuuggcugugcgugguggcucacaccuguaaucccagcacuuugggaggcugaaaugggcggaucacaaggucaggaguucgagaccagccuggccaacauggugaaaccccaucucuacuaaaaacguaaaaauuagcugggcaugguggcacaugccuauaaucccagcuacuugggaggcugagucaggagaaucgcuugaacccaggaggcagagguagcagugagccgagauugcaccacugcacuccaguguggacaacagagcaaggcuccgucucagaaaauaauaacaauaaaaauaaaauaaaauaaaacuuuugugcaacaaaaggacaccaaagaaagugaaagagaacccaaagaacaggagaaaauaauuacaaaucaaauaccucauaaagguguaacagccaaaauacauaaagaauuuuuaaacucgaugacaaaaagacaagcaacccuauuuuuaaaauggacaaaguacuugaauaaaccuuuggauaaagguuuauccaaagcaaauaaacaaauagccaaaaaaguaugaaaagauguuccacaucacuaagcauuagguaaaugcaaauaaaaacuacaaugaaauaccacuucaacuuauuagaauaaauguaauaaaaaggaggaaaaaaagaauuagcaaggaugaggagaaacuggaacucucaugcauuacuacugcaaauaucaaauaguacagccacuguggaaaacauuuuggcaguuccucaaacagucaaacacagaauuauaugacccagcaauuccacuccuagguguauguauuccccaaauaauuaaaaacaaggacucaaacagaugcuuauaccccaauguucacacagcauuauucacaaaagccaaaagaugggauauccuaguguccaucaacagauaaaucgauaaacaaaauguguauaaucauaauagaauauuauucagucaugauaagaaaugaaguucugauacaugcuaaacauggaugaacugugaacauuaugcugaaugaaauaagccagacccaaaacgacaaauaugguaugacuccacuuauuugaaauaccuagaaugggcaaauucacagagacagaaaguagauuagcgguuaccaggggcugcggggaaggguaaaaugguucagaguuucuguuuggaguaaugaaacauuuuagaaguagacagugguaacuguuauacaacuuuguggcuauaauuaugccacugaacuguacacauacaaauaauuacaaugccaaauuuuaugauauauauauauauauauauauauauauauauauauauauauauaugucucaacacaauuuuuaaaagauaaaaagaaccuacauaaauugucccgaguccaaaagacagauuauaacauguuaacaaauagccuuucaaaugaaaguugauaaagccucagacagaaugcagccacucuauacaccuagaaugacacauccaauguguguucacaguaccacuuggaaagaaaauauaaaaggcaucuucucuuaccuuuaagaaucuuaccaguuuaagaggaaucacagguauucaaaguuccaaguuucggaguuucaauucccuucacugcaguguuuucaggaucugaauggugcucgaguaucaaaaauaaaacaaaaaaacaaacacuuguuugcuugucaaauuccuuaauaaaaugaagaaauaccccuaggaauuccuaggaagaaacacuuuauguaacaaauggauauauauuuucaucuuuuauacgcaagaauuaagccuaugaaaagcuauaaugucaaauuugcaacaaaucaaauauacauucuaugaagugacaaauuugauacuuuauaauugagagugcuauaaaaaaaacccagcagaaauuacuaagcaaaugauuggcacaaacagaaaacaauaacaccucuagcacagugagacuucauuaucuuaagaacgacccauaaaagaaaaggaccccacucggcacagccuucauccccaagaaagaacugugacucaauaaaaccacauuuuaacaacauggagauuuuguuauuauaaauuucaaaacaaaaugaaggaauuuccacauauuuauaaccuucaaaguacaauauuaauacaugucugucaguuagaaagaacagcaguuuguuaggcuacaagguuuaacauaaaaccaauuuacaaaugugaaaagcaguagugguccaauauucaccauuacacaugaaucuguuucuuccagaauuuuuuaaaauuaaaauuuuaguaucgugaaauauuaaaauaacaccccaaacaugccacaaucacuauucacaaauaaaguuaaaaugaaauauacaaaaauccacuuaauacuguuaaauaacaacaauaaacuacaagauuuccugaacagaaaugguaggaccccugaauguuuuacagugaauuucaggaaaagaaauuaaguuaugacuauuuucaugauauauaaggcaaaaauuuacacgaccauuucaaaauauaccaauuaagauuuauaguuuguaagaugcacuaaacaaauaguccuuaaaagugaacaaaaaugcuuaaaauacuguuaccaacaccaaaguguguuuaugauguucaaagagaugcauaauuaaaacuaauauuuaguaucucugguaaacagauaauacccacaauaauuucaagcaauccuguaaguucucauuucucuuguuuguaauuuaucauggcucauuucaaagacauauuacagcuuucagcugauuccaagugaauguuauugaaacacauagcccccaaaugaaagaaacuauuccccaaugaaauaucauccuuucuaauaaaauaaauguauuuaaaacaaacaaagcaagaccuuucgcguuugaacagacuucuacgguuaaguuuuaacuaaauuuaaaacacaauguaaaauagguaaguguauuaguauacaaauauccaguaauaugcaguagacguuucuaaagugaggaacacauaaaaaauaaauaauuuuggagcuuuaauuuguuggugucuaaugugagauccucaaaaugucagggauucacuugcuugaaucaacuucugcaucacaugcuuaucuaaacguaaugugcuugucaaucucuuagcuacucuauuugccaauguucauuaagaaauuauauaguauaaacuuaaaguguucaagauggcucacuuauuuuacuauuaagcaaagcuaaauuuacauuccaggaaacacugcaguuuaauuuuaaaaacaaaaaaugcagcaguaaaacaauucgugaggagaaacagaugcauucacauauaauaaagccacugcaacuucuucaggcauucaauuguuguguuaaauaaacagacaguaguuauuuagcagcaaugauuccgcaauaaauaaugcacuguguuucucaguccugcacaaaaauugcagcuauaguuacaucaauagcuguaaccuacuggcucuaauggcagagaagaccuuaaaaccgacuguacaaaaaauugucacacugugacaacaaauauaaaaacaaucuguaggucugaaauaaaaagacuccacugugaagaggacaguguagacaaacggagauuccaaguccaccaaaagaaauaauugccuucaguucugaguccuugauugguaagaaaggcugggggcugggcuugaaaccauguuaucagacuuaaaagagcaugcucugucuucuguucuucccauguccuaaaauauaaagucauuuuaugaggcaguucaagguucaguuuuaucccacauacaguuauuuggugacuaggaagcuaauguucccaccagcaaaagcuaauauuccaugguaagagugaucagcacugucuuaaaugacccuucuguugacggggucagucuacagcuucuaugcuucgaagugaugaaccugaugacuagggaagcacaagaugugucuucugccucagguaccagggauggcgugugcagugaucaagccaggucacuuguaaaaggucuuugugccaucugcagcuuucaggaucccugacuugacugagucagauuuuucucugaagauuuacugagcugcccacaucauacagaaaagugaguacgugcaaugcuaaacauaaacaguuguggaaugcacuguacauugguuuuuacaucaauaauuuuacugaucaauuuauaaaccaaaagcuugguuccacgcaaaaauucaugaucgacacgugaaaugguuuaugacaaacacaccugucucuggauaagaagaauuucgaaaacccggguccuuuugcaacugaaucucuuucaaacugaauauugauacaccuaaaaugcauagacaaaaauuauuaggugaaggucuaacauuaaaacaaacacaacccuacuaucaacaaauguuuauaaagcauauacugauucaauaugaaaccauuuuacaaggugauagcccugcugaaauuuuuccuuuuugucccaguguguugaggagaaaacuaaaugaaugaagcaauccaccuuuagaaccuuucuucuuccaacucugugucagagcaggcugugggcaaguguuucucugaggagaauauacacugucuguuccaggacuuucugggguugggagacccagucaaaauauauuauuauacuagguguuaauucucucuguccuuucucugucuccuuacaaugacaugaagguaccaggcccucaagcuaucuuuggaauuuuagcgaaaaacaaggaaaagguuuguauaaccauaacugccuaccucaaaguaaaacuugguauuaauaaugaaacacaaauaccuuuuucuuuuugagacggagucucacucucucacccaggcuagagugcaguggcaugaucuuggcucacugcaaccuccgccucccagguucaagcaguucuccugccucagucuccugaguagcugggauuacagguacgcgccaccacgcccagcuaauuuuuguauuuuuaguagagacgggguuuccccauguuggucagccuggucucgaacuccugaccucgugauccgcccgccuuggccucccaaagugcugggauuacaggcaugagccaucgcgcccagugaaauacaaauaucuuuaaaagaaaacuuguaauuuaucuuuuucauuuccaaucucugucagagagguauucuuucauuuaaauauauccaguaaaguugaagugaaaaguauuaaggauuuuuuauuccaauuagcuuugucacugacugcuacacaagcuuugaugaaucaauauugucuaauaaaugagaauaggaaauuaaugaaagcuuuuggcagcuuaguucccaaacauucuucuaauuccccacucaccuuacucuauuuuaaaguaaaauacugugguaaucuaaaaauagaauguuaagaguaaaaucaauguuauucaggcaugggaaaucugcuauuacagugacuuugacaauaugcucacugcugucauggggauaguaaagucagugugaccacaauaaaggaaaaucaucuuuguaucuuaagaaaaaauguauuuucacaagaaaacaauuuauguuucgguuaugcuucauuaguuuuuguuugaaauucacuuuuaacaacgcuaaaucgaagcuagauugggccuagggacaaugccugucaucagauggcauguuucaacuaaaguccaauaagauuaaugauccuugccuaaguacuauugguuuccuacagaggagugacaaugugcucaguguuacaagaaauaacugaaucauagggaaauaagacacacaccucccuucaagaaauucuaaucuaacuauagagaagacuagaaucuuaggcuuaaaaaucaauagccaucuccccaaucaccccagacccuaaccuuggacaaauaaaaauaaagcagggaaaacacuuuaggauuucucuuacuuucugguaaagcauguauucuuggucccagacuucgaaaguacacauguuucauggccucuucagcugaaacccuuuucuuagauucauacugugaaaaagcaaagaacugcuucauuagcuuuuucucuaauuacugcaaaaaguaggagaugggcaaauuagcauuuagagcuacuuaaaaaaaaucuugauuauuuaauaugaugacuauuuuucaaucaacaauuuggaauacuccaguuauacucuaauuugagucgcugcugagauuguguaauaacaucucaguuccacauuucuaagauaaggcuggaucuuaaacaagaauuuacauugcuuguauuuucugaagcaaagaaaaauuaaaauauuugaccuguguaguuacuucucuucaugaacaccaaaggacugguggacauauacccaguauuuuuauggcagucauucuuaacgaccuauccaauacucauuucccuuuuuuuuuugaugauacaaccuagguuuguucaagguguccaucaacucugauagaugaaucaugaaucauaacuguuuuaaauuuuggcuaauuaugacaauucugcuccccaauucccagucuuuccuacaauuaauguucuggccaauaagacuuggaaagaaaccuuguagggguuucuguaaagcuuuugcuuccaaguuucaagaggacuaauguggcugguacuacccuuaucguccccccuuauuccugcuuuggagggaaauaugaauggcauuuggaggcagagcauccuccaaaggcuguacguauaaggaaaagagaacauaagagagcauagagagcaucaauugcagagaauguggccuugacacagcugaucaaugccaguaaccaacuaccucagacuguuguaggugacaagagacccagacacauuaggagaaaccauguuuuuuuuuuuuuuuuuaacuuaaacaugugccuuaagcauagauaauuuuauuugucauuaacaauaccgaggaaguacuacugagcccauucuacacaugaagaagcugaggcuuaacaaccuauuuaacaauuacuguaagaacugacuuaccugaagaaauuuuguuaucaacucaauuccuucagagucuaaccuagaaacaacaaagaacaaguaaaaauuuaugcucucuuagcugauaaaacuuuucagauaaaacuauuuucuaaguguuuuaaucugcuaaauuuaaaugcccuaaaauagucacucuuguugucuucaaauagacacaaaucuguuuuagucuuaaaagacuggccuugcuauuuguuuaaggauaagccauaaauaacuuggcuucaauuugaauuuucaauauccaagaacaaauuaaagaauuuuaaaaaucaccaugcugucucaaaacaaagaaacuucaauauuaagaaagcuuacauauuguaucacuuuucgcagucuuucacuaaacgcaaguauauaagagcaucauuuuccuauuauauaggugaaaacagagacaagugaccccaaaauguaucacuguuguucaagacaaacacagaaaugagcuauucagcaaauuuuuagaguugucugcuuagcaccggguacuagaagguauugaguucaauuuaaauaugcuacaauaacuucauaaaacuucaucaaugguggccaggugcaguggcucacgccuguaaucccagcacuuugggaggccgaggcggguggaucacgaggucaggagaucgagaccauccuggcuaacauagugaaaccccgucucuacuaaaaauuagccaggcgcaggggcaggcgccuguagucccagcuacucgggaggcugaggcaggagaauggcgugaacccgggagguggggcuugcagugaccugagauagcaccacugcagucuggccugggcggaagagcgagacucugucucccaaaaaaaaaaaaaaaaaaaaaauucaucaauaagggauauaaaacuaaugacauaauaaagaugaaauuaguauaacuagggguaguaggguuagggauuaucuuuuuuuuuuuuuugagaugguguuucgcucuuguugccuaggcuggagugcaaaggugcgaucccggcucacugcaaccucucuaccuccuggguucacgugauucuccugccucagccucccgaguagcuaggauuacaggcaugcaccaccacguccggcuaauuuuuuguauuuuuaguagacaggguuucuccauguuggucaggcuggucucaaacucccaaccucaggugauccgccugccuuggccccccuaaagugcugggauuacaggcgugaaucaccgugcccggccugggauuaucuuaauggaauaaucucuugaucagaaauaacagguucuaucuuacacugccuuucacugguagaaguacaauuaugaauaagguaacguuuuuuuccaagugcucucaaguggguccuguggaugcugcagucuagacauucuauguaguuugccauucuagcacauauccagaguucccugggcacaaacuaggcacuaagucauggagacucugcuucaaagaaaagcuucaaccuucuacacugaacauuaccaaaaaauaauuaaaggacaaaaauagaauuuaugcuacuugggagagacaugcaaaaaaagcccagcaaguauuauuauucuuccuaagaaaaucuaguuagaaugguauuaguugcuauaguaacaauaagaguaccaacucacauaaauacuuuaaaaauauuuuuggugucauaacuguuuugcucuuccuuccuuagcuugaaaauaaaaggaagcauaacaaguguguuauguugugagcaaugugaauggcuuuggguuaaaauaaaugauguccuuauuugguaucuuggugacuuucaaaauuuggggggguugggggcagggagauggaaaaugcagucaaagggguuauucuauguuaucuccugaaaauguaauacauucuacaaguaaaaauguucugacucaaauuuuauugggagccuuggauugaucuugggguaggucuaagaagaaacuuaaaugaauggcugacauuuagauguuacauuuugcuaaggaauuggacagaguuuauauucuucaaauaugaauuacaucauuaacacuggucaaaauacugauagguuaccuuguguuauagagucaagauuuuacuuacauaacccuuucuuagguuuuuguuaaguaaauacagaauaauucuguagaaagcaaaacaggaauuucaucauaaucucugugguacggaauaaggcauuaaucaaugucuucuuucugggaaaaguaacuacauaaacucuagaauucuaaaacauauacaguucaaaauuaaauaagauccuaaaauacguaaggguuauguguauuauguauuuuuuccugaauccuuacuguggcuaauccuucaaaagauugaaaagaaucauguguuuuccccccuuucacauaagaaaaaaaaauaccugggugcgugguuaauuagaggcugugguuuauauuuuggaaaguuguaguucuugaacuccucauuugaagaaauaccuggccaaguuuccugagauggaguuccugaauuaaaaaaaaaaauuaaauauauuuauaaauauauauaaaauuuauauauaaaaauuauauacacauauauauaacaaagugucuuagagaauaauuuacauuuaccagaugacuuaacuauuucaacugcaauugaaaugacagaaauaaacguacauggacuuuuuguuuggacuuugcaaugauacuguaaaaaggaugccugguccuuuuucuauccaguugauaccaaaaaaguuagcaauauuccuuaauaauauggugacauccaauuuuccauacuaauuauguucuguuuuuccauaaaaucuuuauugcaaagauaaaacuuagcagaugaaguuaccuagaaggaucuaucuucauaguguccauucuaauuauucuaacuaacagcuguuuauguuagucucaguaucuaauuuuaaaauauguauuuuagagauacagucuuauccagcuagucaauuaugggugcaaaaucacugggaaaagauuucuucuguuaccuagcagucggaaaauuaagugcaguucaucuuccacgguugauccuggaaauaaaggucuuccagaagccauuucaaagaaaaugcaaccaacaccccuuuaaaauagaucaugaaaauaauuuagcaauucauuuacauauuaugaagcacaagaaucuuuuccuuaagguugccucucugcagaauuuugcacuagccugucggaaaaccucuugaagggauauuuuagaucuaacuaauuuguucgcauuuacccuauuugucucaauuucuauauugcuauauccauuuuucccacuuaaaauguccaacucuccuuugcauaauccuugaagaauaacacuaacaacagcuaacagugacugaagauuuacuauguguuagaaauguuuuuuaagugcaccaauuaucucacugaauccuuguauuagcaauaguguagaccauggauugaacagcaaagacaggaguggggaaaaacaacugaagagauauuaugguaaucuaggagaugacagugagugaagcuaggcaggagaaauggagagaaacaaaugauucaagacguuuugaugcaggaagcagagguagaacauguugguacaaggcgguguguguaagugaaggaaaagaaaaggauggugguucagagaauagaauggugguucuuagaacagucaucuaggaacuguauguacacacacaguuuaagacauaauccuuccauuaaagggcucguaaucuagcaacuauauauaaaaguuaauuuuacauauuaaguguuauauagaaaguaaaaugauauaguugcuauggaaaauaguauggugguuccucaaaaaauuaaaaguagaauuacuauaugauccagcaauucuacuccuagguauauaucuaaaagaacugaaaucaggccaaugcaggaggacugcuugagcccaggagucuaagaccagccuggacaacauggugagacaaugucucuuaaaaagaaaaagagaaggagagagagauaauugaaagcaggguccugaaaagguauuuguauacccaugugcacaacagcauuauuuacaauagucaaaagguggaagcaaaccaaauguccaucaauggauaaauggguaacagaauguggaauauauauuuaauggaguauuuuuagccuuaaaaaggaaggaaauucuggcauacacuacaacgugaaugaaccuuaaagacauuaugccaaaugaaguaagccagucaugaaaagacacacacugcaugauucuacucauaagugguacuuagaacagucaaauuuauggagacagaaaguauuauagaacagugguuaccagaaacugauggugggggaggggaauaggaagaaauuguuaaguggguacagaguuuugguuuugcaagaugaaaaagauucuggagguagauagauaguggugaugguugcauaacaauauaaauguacuuaaugucucacaacuguacacuuaaauugguuaaaaugauaaauuuuaugaguauuuuacaauauuaaaaauuaauuuuaaaaaguuauacgagacauuuuacauaaacuguucaagacagcaacagaaaucgguauaugacuuauuaccacaugaagaacauagaaaauaaaugcaaccacaguucagaggaaggaacugccaacagaggcuagaguauauucaggaaaggauuuaugaaaagcuguauuuugaacguuacuaggaaugagcccaaguuagagcaccggagugggcauuccagauggguggacugguaugaacaccaagagcaaagguaggaaaguccacauuauuccugagauauagugaguaugccauuuugcuaaaagggaacauuuguguugagaaacagucugaaauaaguuggaaaagguaguuuagagacaucuuauggaaauccuuaaguaucagauugaggaauuaauuguaccuuauucuauagguaaugaaggggguggcaauaacggugucugaguagaagagugucaggaucgaagcggugugugagaaagaugacuacaauauuuugauuauuacuuuuaguucaaguuaaagcagaaagauuuuggugaauauuaaaugaugauaaaaugauaauuuuguuuuaaauuacuauguaucagauacucuugagugucucauaaagcacucuucugaguguucauuuaaucuuaacaucaccuacaacacuucaaaguaguuauuguuacuauucccauuuccuuaaaugaggaaacugaggcaaaggccaguaauuugaauaaaguuaacacauaguucuaaauggcagaauugguauuuaaaccuagguaaucuaauucccaugccagaacucauuaaucacuguuacauuauggcucuuuaaaauaauaucuccuuaaaaguauauacuuaucaauacaucuugcauuaacaguuacauucuuucaaaauuauaaaugucagugacaucuguauauauuuaccacaugucaaucuguguugaguacuccgaggaaccaagaagcacaucagguggccgguaccauagugugacaacuucauuugaguaggucuuugugggaacugacuuggcucgggcuaguccuucauagggaaaauaaaacaaaggguuaagaaaaagcuuuaauggaucucucagacccuauucucaccaugacuccauucaaagggaugccugaaaugguuaauucguagcuucuugaggcuucaccacuauuaacuuuaugaauucguugagugcauguggcccuaaguaagcaaauccuuacauaguugaacuaaacaagaauuccacaaccagagacugugcuuacuuuuauguuugaauacaccuggugaaguauucugggugaaucuaaacuuaagauguuuuccuucuguccaugaaucaugaugacaaaauuauuucucagcugcaauuaaauuaauccauaauaggccaaugacauugagauacacaauuuuacuucuaacggcuaugagcuuuugucaccuuuuaaccugauuccaacuuucauuugcuauaccauuuuuuaucaaaaacuguaaaguuauugguccauaaucucauugagauuuacugacaaaucgacuuagagacaauuuccuuggaauaaaauuacagugcuguucuguacucccuuuuuagguuguaaguuacauggaucauucuggaguaagacagacuucauuguccuuggauauuauuaauugcuguuuacgucagggguguccaaucuuuuagcuucccugggcuacaauggaagaacugucuuaagccacacauaaaauacacuaacacuaacaacagccaugaccuuuaaaaaaaaaaaucgcaaaaaaaucucauaauguuuuaagaaaguuuacgaauuuguguugggcugcauucaaagccauccugggccauauauggcccaugggccauggguuggacaagcuugcuguaagugauauaaaacauuugccauuccuuugcuaauuuaauauggaaucuauugauaauccagaaauaaaggcuagaguuuacaacuuuaucucuugagucacuagugugagagagucgcuauuaccucgaagccucuaaauuaugaucugaagaagcaacuuuaaaaaauaucuggaaaauuacaaauuuauuuugccaaaacaaggaagaauuuauuuuuuaggcugagauugcuguuauauauaacuugguauaucugauuaaaauauuaaagaaaaaugucacaaaagaaaaaaucaauuuuacugaauaagguuacagaaacaaugucagaaauuuaauuaggcaggacucauauacuauuucaguucaguauaauggugaaagguuauaacuggaacaauguugacauuccuucauuuaauuacaaguuuuacucuagcaucucaacuuggugaaguaaguccaacaaauuauuuucauaccaauuuugguaauuaauuaacaagauggagguagcuuucugaccucucuucuugauauuaaaaguggguuauaggaaggcaaaggacagggcugcaaacgugcuuauccuguaacauaccauaucaaggcaaauuaccaguuauaguuuccucaguauccuacucucccacuccugagaggauuccgaacuaugguguuuguguacauggccuucuaguucacaauuagaauuucaauacugguuggaaugaaaugaaacaaucucuccuaaacaaaauuaauuaaaugugauaugguauuauuauauaagccauuuucuaucauuagugaaaauaucugucuauaucacuaguuccuagacuucugauuuucacugaucgugggaaaaggguagaauuuucagagggacagagaacaacuuauaguauaaauacucaaaguuauaugacccuccuucacaagaagucauauuuacuaugcaaccaaaaaaaaaaaaaaaaaggaagaaauagagacagaauugaauauacuaucucauggaauaaucagaauuucuuguugccuuguggguaaaauuugccuggcuugcauuguagagguuggaagcaaaauuuaaagcacucagaguauucccugauaaaaguaguuguuguuuuuuucuuccucuuuuugagacagggucuuguucugucaaccaggcuagaaugaaauggcuugaucaugacucgcugaagccucaaccucccgggcacaacugauccuaccaucucagccucccaacuggcugggacuagaggugcacaccgccacaccuggcuaauuuugaaauuuuuuauagaggcagguuuuugccauauugcccagacuggucuugaacuccugagcucaagcaaucugccugcugggccuuccaaagugcugggauuacaggugucagcaaccgcacccagccaaagguaaauuuuuuauaguccuugacauuccuuuugcuuuuuuuuuuuuuuuuuuuugagaugaagucucgcucugucaugcaguggcaugaucuuggcucacugcaaccuccgccucccggguucaagcaauucuccugccuaaacuucccaaauagcugggauuacagguguccgccacaaugcccagcuaacuuuucuauuuugaguagagacaggguuucaccauguuggucaggcugguuuugaacuccugaccucaucugauccacccgccuuagcauccugaaguauuucucuucacugccauucauuuugggauugggaauaaagagcauuacaugcagguuagcaaacaaagagaaggagaaggaaaaagagugaaaaggaaauaguggcugggggaaggaaagagaaagaaaaaagagagagagaguaacaauuauuauaagggaaauaacaacauaaacuaugcccaagaagagacuuuaugaaagcauauguaaauagcauauaauuuguuauucaaacacagguaacccacacauuuccuuuuuaaggaaggaaaugcaaaaaguaauuuacucuucaaauggcaaaguauuaaacgagcaaaaguauaggaauuuccagaauaaacucaccauuuaaugacagugaagaguaauacuugaaacacucauauuuauuaaauuuaaugaaauacuccaaacauaaaacuaccauaaucaaagccaggugugauggcucacaccuguaaucccagcauuuugggaggccaaggcaggcagauugcuugaggccaggaguucgagaccagccugaacaacauggugaaaccccaucucuacuaaaaauacaaaaauuagcugggcguggugggcaccccuguaauugcagcuauuugggaggcugaggcaccagaaucgcuugaacccagaaggcgaagguuguagugagcugagauugcaccacuagacuucagccagggugacagagcaagacccugucucaaaacaaacaaccaaaaaacuaccauaaucauuuaugaaaaaaaauuaugaauuuaguuauggaaaacugcauggguuuuuaaaaacuaaguucucuaagaguauucaaacucucagaaugcggaauacaaaaaauucaaagcugcucuacaaaguuccuucaauaugaaaaaguuuacuuucuagaagcaaaaagagcauuuaauuuuacuuucaauucccuuaaaaccagauuagcuaaaaaaaaaauagauaaauagcuacaauuaaauuacugagcauauaauaaauacagaguaaugguggcagguauauuaagggaacgccuuucaguaguugcuucuaaacucauuguucucaagacccauuuuauacucuugaaaauuaucaaagaccuaaagagcuuuuauuuuuguggauauauuuacugauauuugccacauuagaaauuaaaacuuagcaaauuuuaaaauauuauuuucucuuuaaaaacaccacccuuuauaugcagcauguaugacauuuuuaugaaaaacauuuuuuuuauaaaaacaaaacaguaagaagaauggccuucuuucacauuuuuguaaaucucuuuuaagucuuguuuuuguagagauggggucuugcuauguugcccaggcuggucuuaaacucccggcuucaagugauccucucaccucagccucauaagugcugggauuacaccccugagccacugugucuggccuaaagucuauuucaauagaagacaacuggauuccacaucuguuuuugcauucugugugucgugauauguugcuuugauacauaucacaauauguaucaaaauagaucaaauauacauaucacaacauacauauaugaaggaaaucaaaucucacacagauaugagguugaaagaggaggggcauuuuaauagccuuuucugauaaaugugaauagucuuauuugacacuacaucagaacuagaaaguaaguggucucuuaaaagcuauguguuaacaaaaccuauaacgaugaacuucucaugcuuuuguugcacuaaaauucauugaccuuguacuuuaaaugggucuuuuauccaugcaugauucuguaauaucaugcauuagccauuuggaaaacaguggaucccuggguuauacauuccaaauguuuauacacuuuuucagcauauugaaaaaucguguuuguuaacaucaacaucgaucucaucagaaaagucucuaaguauugaaaagccaucaaacucaaagcagauccaaauuuccaaacucuaauuuuugcuugaaaacuugaauuuuauuauuggcaagaaauacugacaguucuuuuccuugaaaugauaggcuuccuucauucacuuucaggaaaaugucugccaaacaccuaagucugaauaaccacaguuugucugucagucauuuaaguaaaaaugguguccccucaaauaacagggcuaguucaaugugcacucaaauaaucacaugagcacuuuucccugagaaguaaccacauuauuucugugugcagcaaaugaguuuuauguacacuucccauuuuaucacauaaaauauuaaaaagaaauguagucaaggauggaaauuaaauauaauuaauaaauuuuauugcuucaucauguaaguguaacugacaguuuucccuuuacguaaguguagugguaaagaauacaaugacggccugggcaugguggcucaugccuguaaucucagcacuuugggaggccgaggcgaguggaccaccugaggucaggaguucgagaucagccugaccaacaugguggucacgcuaaaaauacaaaauuagccaggcaugguggcgcaugccuguaaucccagcuacuugggaggcugaggcaggagagucacuugaaccugggaggcagagguugcagugagucaagaucacaccacugcacuccagccugggcuuuaacagcaaaaugcugucuucaaaaaaaaaaaaaaaaaaaaaaaaaaagauauauuuuggugccacuacuuugauguauaguuuuaugcauuauuauuuugggaccaucauugcaaauauuaacacagugaaauaggcaaauaacagaugguacaauuuugguaauauauuuacauuuagaggccuccuacaagggucucaggagcccuaggggucuuuguccacacccaagaacagccugugcauuuuagaauuugcugcuaauaaccaacauaaaucaccaaccaaaguucugucaaauaucuuauucugugggcuaccgagaaaauuuccaaacccacauaaaagcaauggcacauuaugacagugguugaucuuuuaaccauuacacuuuagaaccuggaaguacuaauaaauaucucauacauuccauaccaaaaucugcuagcuuuaauucuccuuucucauuaaugaggagguucugugguuucaagucucgaugcaauaccuuucuucuauggcaauaugccaaaccacguagaauuugguacagaaacagcuacagaaacaaauaaauaaaaauuagucuuaaagaugagacaugcuuuaguauaagcauaaaugaugguaagcagaaaagcagcuggccuagaacauuguaacaggaaaaagaaaguaauugcauacuuaaguacaaugucuuuuuccuuuuauauauaguggcuuucugaauuuaauaguuuauuauucuauuugaagcaucuaccuauuucuuuuagucuaacaguaucuauggaaauauuuuuuaaaaaguaacuuccuccuagcaguaacaguugauuuacuguggaaaaugacuuaaaaaaaaaaacauauccucauaaacuuacaggccuacuaagguuuacauaguuuaauuauaaaauucuggcaaaacaaccaaccaaccccccucccacccaucucuccuugaaaaaaaacaaaaacaaaaacucugaucuggggcagugucuuuaaaauaaggcacuggaauuggcgauuuuaugaaaagucugagguaucaaagagaaagcugcugcauagcucuggcaaauuacuuacuauaaaacuaaccuaaaccagcuucuaucacccaucucuuggguacuuuacuuucagcaccuccuacuuagccuucaaaaucuacugugauucacaaaggggcauuagcaccguaguguucugaaugacucugaaaaaaguaauuccuauaaggcuaaugguagaguuuuugcuguacauuuugguagaaagaggguuacggaacacauaagaccuuugauucucugggguuaacaaaaagaaccucaaguacagaggauucaagaguuuccccucaguucaucuguaggugaaaaacagggcauccgaacacugaggcagccaaggcagcaggucaacgguaugccugaaugaauucucugugccagagucucuccagucuacauaauuauguuuuuaaaacucuaaaauuacuauuuaaaugaauucuuguuacacuuuguauuuugaaaguauaaaggccauuuaaacaaauaaauaauaaaacgcuuuccaacuuaagcuaaucauguaaaccuggcauuaaagaaauaaacgucucaacauuugugaaauuaucaucaaggaccuuguuuuauuuucaaauuauugccaauaaaaaaagcaggaaaaacaaaauuaaaaccaaaaaaauacaaaaugacaguuauaacacuuugcaaacaaaagauguaaaauaagaugaaaacaacccugacagaauauauauggaaguacauuuaaagcccuuuuuaaaaauccuuagcaauguguuauccauauguucugagcugucuuuuaguaacagaaacuggcucuccuuuauaaccaccaaacuuaauauuuuuuuaaaauguaaguuuaaaauuacuaccuacagaauuagaaaugucugaagcacacagcugcgacagccuauuuucagaauagguucuuacauauuguugacuaaguuuggauaaauaaaucuuugcuaaauuuggauacacuacucaggucaaagaaaccuacuguaagaauacaaacuaugcuggaugcuguuacucaguuaauaacuuuuggguaucaucuggcacugauuuuauggcaaacauuuuuagcauuaaauuuuuaaauauguuguuguaagaaaacacaccaauuaucuuacucuucuuccugacaguacagauugguauuuccagcauaguguucauaaaaccugcauguucuggccuuauucauuaguucugaaaaguuguuguuuuacaauuaaauaccauuuauuuggggaguucacuauuuaaagaaggccuuucacagaaugcacccaucauucguguuuauuuugaauuuuuuuuuuaaagcagaauacaccuguacauauauucuauauuaggacaaucaguuguaaugugaaaugucaaaagaaugaagugguucuacaaaaaggucugauccuaagaaagcuauaguguaguaaacagaaguucuggguaaauauugcacguucagaggacaauaaccuauuuaaaaggccaaacagaaaacccugaagaagaguuaugaggcugguacauuucauuauauaaugguucaccuaugcuuuaaacaaaauuuaaaaauuacacacgcaagaaaacauaccuuuacguugugcauacucaugauguuuccacagucauccauguacuguuucaggucuuuauccuggaaaaacacagcacucugcuaugugauacaccauuuucagaauguugugacugguucacuuaauaguguuuuucaaaauuaguuguuuuucaagaaaagauacuggaugcaccauacacauaauuuaaugaaaaacugauaacuaaauaauaaagucucuugggcuguuaaaaaguccaauuuagcuaagcacagcugcaguuuaaagaaaaauaaaaaacaaacuaaaaguccaauuuacuauguuuuucuaaaguaaaguuaaauacugaauuuuuaugagaugcuuaccagauacucaaacaccaaagucaaggauuuaucugugugaacaaugucauguaagguuacuauauuugcauguuuuaaauccuuuaauagugaaacugcaaaacagaaaaagaaaauuguuuagucuguggcagucuuuauaaaaaccugaaguaaguugaacauacgaacugauuaaaagauucucuuaaguuuaggucuugggcgguggcucaccccuauaaucccagcacuuuugagagaccgaggcaggcggaucacuugagcccaggaguucaagaccagccugggcaacaaugcuauuuaaaaaaaaaaaaaaaagauucucuuaaguuuaaagcaauaauuuaccaaggggauugguuguaaaaauguucauggaggcugggcacgguggcucaugccuguaaucccagcacuuuggaaggccaaggcgggcggaucgugaggucaggagaucgccuggcuaacauggugaaaccccgucucuacuaaaaaauacaaaaaaaaguuagccgggcgugauggcggacgccuguaguuccagcuacucgggaggcuaaggcaggagaauggcgugaacccaggaggcggagcuugcagugagccaagaucucgccacugcacuccagccugggcaacagagccagacucccucucaaaaaaaaaaaaaaguucauggaaaucaauuuuuucuuuuauacuacuggguuugauauuauaauacuuaaaauuguccccaauauuauaacauucuccauaucaucuucuguauuuuuccuaaauguuaacuuuugaaacuucuggcauuaauuuagauauaaauuacaaggaaccauuuuuccccuccacauuacuaaucaguugccucaagccauuuucugaauaaucuucuuuauaaaaugguacuaugauauaaauauguuuacacacuguuuuuuaauuuauuuaguuuaucugguuaauuuauaguuaccauguuccucauguaccaauguauaacauuucccuaugacaaauaguugucuaugauagugauuuuuaaugaauucagauuucauuauaaguuauacacuaauauaauuaaucccuuugaguauuuguuuuagaaauuugcuuuuuaaagguuuaauuacaucuuccagucauuuauuacuuguauaucugagcucuuuuuacuuauaaaaaauagacacuuauuccaccacuuugauuuuaaaauguucuguauaauuauuauaccuucucuuauagcugugcagggugcaccuucuucauguuccaaucggaucucuuuuaaugccaccaaauucucugucaauuuacuucuuccuuuauauacuguugcauauguacccuauaaaauauauuuuuaaaggacgcaucaaaaguaucauaagagucuauuuaauaccaucuuauaauaaagagcucuaccugaauuucuaguuucuaagcauuguuaaguuccaucuugcaaagaaaaacacacaaugaucagccauggcuuuucuuacaguaaacaggacuuucaguucauaugcacagcuuccauacuucuguaacacuacagagugccucaagaguauaaaaacauagacagaauauuuacuuuuuguaccuuauuuuagauuaacaauuagaucaauagcuuuaaaaucaaaggugcuuuaccugcaaugguauauggagacugauggacacuaauugaacauauuaauugaaaaaugaaaacauaauguacauauuguuaaaugauaaauuuuuuuuuuuuuuuuuuuugagauggaguuucauucuuucgcccaggcuagagugcaguggcacaaucuuggcuugcuguaaccuccaccuuccgguuccaagcgauucuccugacucagccucccgaguagcugggauuacaggcgcccgccaccacgcccagcuaauuuuuguguuuucaguacagacgggguuucaccauguuggccaggcuggucucgaacuccugaccucgugauucacccgccuuggccucccaaaaugcugggauuacaggcgugagccaccgcgcccggcaaucauaaaaauuuuacccauguuucuagacuuuucagaaucuuuguacauuaacucuccuuuaaaaaacaaggaucucuucuauuauugccaggacagcccucaagcuccuuuaagccuucccuauuaacuauuguuuucuuugcccuuuccuacuauaggagguaggccauuucuaaaucaguaguacuaguaguaaguucaagaaaaccaagaucuuaagaauuuccguaaccuucaaaaaauguguuuuuaucuuuauucugauuuuucacaggucugaacucaugcaauuucccaugguggcacagacaguagacuggcaguagacuaagugacaaaugccuacuuuguuauuaagaaaacauaauacuuucugcuucaauaaaaauuucaaagcuauaaaaaaaauucauuuccucucaaacugaugggauaauuucaagaauugaagacucuaacuccuagaaacucuguuaccuuuccagaacaaguauauaaucuuguagacaucaguacuuacguuuuuuccagguuaacaaaaaccguggaguaacagaguuugaaugacgaauaagaaaaaaaugugucuuacauuuuugagauauuuacuuaccucuccaagcuuuuccaauuugauguagguuuccauuuuuccaaagccaauuucugacugaaaaguaaacaaugaaaaauguaguauuuacuuuuuuuuuuuuuuuuugagacagcaucgucucacucuguugcccaggcuggagugcagcggcacaaucuuggcuuacugcaaccuccaccucgcggguucaagugauucuccugccucagccuccggagcagcugggauuacaggcacgcagcaccaagcccggcaaauuuuugcauuuuuagcagagacaggguuucaacacauuggccaggcuguucucgaacuccugaccucaagugaucugccugccuuggccuuccaaagugcugggauuacaggcguaagccaccgcgcccagccuuguauauauucuuaaaguuucaauucaucucuuccucaacuucugaaacuuucccacucuaaagaaugacuaagaauagaaaaaucugauuauaaucaaaugguugaauaucuaucaaguuuuaaaauaaacccaauguuggaacauucaaagguucaaaaauaucaaaguucacaaucaaaauugucaacccaaccuuuauauauacacaguuaacauucugucaugaaaaauauuugguuuuauucuaagauaccacaggcauuuuaagauacuaaagaaucuuaucaaggauaacuacuugggauuuucuuuuuaacaaaauugcaaaauaaauaauuuuccuauguauuuucucccucaccaaucugaauucccaaggaaguccugcaaacaacaaaauacuauuuguuucaggcuuuccaaucaaaauacaaugaaaaagacaacugaaaaucaugcucuucuauggaucaggaaguggcaaacauagaagcagcaauguaagucuaauucuggcuacacccccccucaacacucggccaaaaaaaaaaaaaaaaaacaaacaaacccacaacaacaagagaaaaugcuuuaaaagugaguucuuaaaagccuugcuuuuaaaacuugagcucgccugacuauuguguauggagaugauaaacaggguacaugaaauauaccuaaauauguaauacaaacacaauauuuaaaaugaaaaagaaaaaaccuuaacacaaaauuuaggaaaauuuguuuuuagauagauugaaaacuagggacugagagagcagaaauauuuuaaaaaguaaaacagaaugggaaaagaauuuucuuaaaguugcuuucuaguaccccuuuauagauaauggaaaagguaaugauaaucuaaagaaagauccacuugcuuagaauggugcuaaugcccuuaaauaaaaagccaguuaaaggaaauaauguuuuuuaauacauaaucucaguucucaaagguguauaaauuaugccagaugauuaaacguugugauuuagucaaacucuagaggucuaaauacgcaauuuuccuuggaacuguggaauaaaauuaaaauaauccuugguaauuagacuugcaucacuuaccauuucagacaauaggauaaauuauccaaagcugaauggccaaaaguagcagaggccccucaaaauaacuguuuuuaucuuuuuguuacaaugauauguaucauauuaaaagccauguggaaaacugcacguccaauaguacuuaauucaauuuuaguaaacuaauuaaaacuuuggucacagguauuauugaaugaaugaaaaauuauuuuugcauucuaugacauuuuccuaugacguuuuucauaaaacauuaaauuuuaaaaaugaaguuuuacgaccaucauacacuauucauccauguauugucuugaacaugacucaguauuaaguccuucgcuuucuaguaucaauaacuaugcaaaauaaagaaguaaaacuacaauagauaacauuuuuaaaauacaagugaaguuuuuaaaaucaguaugaaaaacauggcaaauagcccacuaucugguacaugacagucugauuacgaauaaucuuuuaauuuauauauguuuuauauagccuauuuauauaugaucuuaaauacuuuacuccauaaaaaaggcuacuugccaagaucacagaaacuaauaaaauaucuuuauucugauacuuaucucuggaauuuaggugcuuaaauucaugaauauggaacuaccgcauuuuugccaugaauuuuaaguuuugugucaucuuuuaugggggaaaaaacacuauauugagaauaaaugcaaacuaguaugaacaaaagaaugaauguuccugaaaaaaauauuuaaaaugucauuauaacaaugagaagcacacgggaaauaagacuguaagcuaggcauuuuuucuucucaggaguagagaaauuuucuuauuaauccuuuuaucuuaaaugaaugaauacuacuauguucuuaaaacaucaaauacacuaggguccaaugguuacuaugacaaaaugucgagguuugcuuuaaagacuauguaaauggacuacaaauuagacuguaaagacaaauauguaagagguuaaguuuaaauuugaauaaucagucuauaaaauaaacaacacuacugaauuccacccaugcaggcaggcaggcaggcagagaauucagacaaaggcacaauuacacuagugaauugucugucagauccuaauucaaaaaguaaaagcuuagcccccaauuuaguaauuuccaacuuaggauuuaaugauuacaucaaaacaguacuuacugaaucuuuaaauaaaauuuuuagaaaauuuugcuugcauuuuuauuugcugaacacaacaagauuaacaauagauauaaugacuagcuuguugacgugcucuccuacagaaauuauucagaggacagaggacaaagcucauuuauucaacauuuacccagcacaauguuaggugcuagagaagacagacaugauucccacuuucaugaguucacaaucuagccugaguuccauccuagauuauuuuagaauauuuuaaaaguuucacagaaacagaaauaauagcuaaagaaauagcacaauaagcuuuauaauguguauguuguuguuccagucucugcagaaacucaaaaauugccaaugccaacuauaaucacaaguugucaugguggggguauuugggaaaaauuuucaauuagcaauaacugugccuuggauaaaccucggguaugauacuaucacugcucaaagcuuauauuuucauguaauauaagagcccccuuaaugcugcuuuccagacaaaugaagauaauuuuuucugauauuucacuguuccaagaaaauacuucacuuuuugacagccccaagcaaauuccuauucagauggcucuuagaguauaaacacaugaaaauucuaaauauauauauaaauuaaauuauaauuuauaauagucuuccuagaauucacuguaacuuguaagcaauaccaagccuuaugggaaacuuuuuguuuacuuuggaucuagcaacauaauuacucuaucacaggcuggagaugcuguucuagcugagcuucaaaacaaaugaagcaccagaggucccccuuauccacaggggauacuucuaagaacaccaguggaugccugaaacagcagacagcacugaaaccuguauguacuagguuuuucccuauacauauuaaauacacuccuaagauaaaguuuaauuuauaaauuuugcagaguaagagaucaacuaauaaaacaaauaaccauaauaauacacuguaauaaaaguuacgugaaugcagucucuaucucuugcucucaaaauaaucauacuggcauuguauucaccuauccucagacuauguuugaccucacauaacugaaauuguggaaaaugaaaccacagauaaagggggaagcuucuguauguacagaggauccauagaugacauuuuaagagugaguauauauuaauacauaagaaacggggccgggcacgguggcucaugccuguaaucccagcacuuucggaggccgagaagggcggaucaugaggucaggagaucaagaccauccuggccaacauagugaaacccugucucuacuaaaaauacaaaaauuagcugggugugguggugcauaccuauaaucccagcuacucgggaggcugaggcagaagaaucgcuugaacccaggaggcggagauugcagugagccaagaucgugccacugcacuccagccuggcgacagagcaagacucugucucaaaaaacaacaaaaaagaaacagcaggggaagagggaggcuuuuucaaacauucauuucccucucugugggaauuaccgaguuacuguuaacgaaagaaauguguuuuaucccuuagacuuggugggcagggggaaagacugagaaucucuauucuacucagucacuuugucuuacaaaaauugcuauuaucaucaccacaauaccaccuuaauccuguacuccuguacauaauaugcuaaagguaaauucugugggacuuugaaccucacucccacauuccaucuuauauuucuaauugcugagagauguaaggacuugauuguauuuucucaccugcucugagaauuaagaaaggucuauauagucuauugguaaaaccaggaaugaagaauccaaacauucauuguuuaggaaggcauaugcucuuaaaauguauaaaccuauaauuugaauacaauaagacaaauuuuuauauauggaugaccuccauuauaauugaagcugcacucagucucacaaaacuuccacuggguauaccauuaucguaagggcaaggaagcucugaugaauccugacuaucuacauauaggcuuugccacuauucuaauauuuaacuaaauauguugacaauguuuuauuucuuaucaaucauaaaggacuacuaaauagcacgucaccauccaauagccaauauuuuuaacaugacauaugaucacuaaauguaaugugguauccuggagggaguaucgggacagaaaaacaacacugacaaaaaauuagugaaaucugaauaaaguauggaguuuuguuacuaguaauguaccaauguugguuccuuaguugugacaaauguauuaaaguaauauaaaauguuaauaauaugguaacuggguaugugguauagaagaacuauauaauuuuuguaauuuuuucuguaaaucuaaaacuaaaauuauguuuauguaaauaaaaagucacuggaaaggauuaagguaagaaaugggagacugaacacacaucaguuuauagggauaacagauagucuuaagcauccugaaaagaugggauaguaagggggacaacuucucaagauuaaaaacaaaaaagaacagaauggguauaugcauagguagauuugcaaguuuguuauacagaaaaggagggaguuuucgguuaauggccacccccuuuuuuuuugagacagggucucuugcucugucgacaaggcuggagugcaguggugcaaucauggcucaccacaaccucauccucuugggcucaagugaucuucucaccuccuaccuacugaguagcugggacuacaaaggugugccaccacgccuggcuaguuuuguuaauuuuuuguaaagauggaggucucacuauguugcccaggcuggucuuggacuccugggcucaagcaaaccuccugccucagccucucaaaguggugggauuacaggcaugagccacaacaucuggcccucucucuuuuuuaugauauaggaagagagaucaucugcuuacaguaagagaggaagaguuaaucagagaaagacagugggauagccagacaacacuggggaucuaugcgagauugaugaccauaaauuuauauuagacccauucagcccuacuguauaacuuucuccaggaaaaaugaauuguuucuuaauuccuacucaagcaaagguuuuauguuauuuuuacuacucauuauauauugccauuagaaaauaugaaaauaggccaggagagguagcuuacaccuguaaugucagugauuuuggaggccaaagcgggaggacugcuugaggccaggaguucaagacaagccuggauaauauaguaugacccugucucuacaaauaauuuguacaaaaaaaaaaauuauauauauauaugagaacaacacauugaaaguuuaaaacuuuuagaagacaaggcuaaauuuuacauuuuaccuuaaaaaauauuuuauuuuuuagauuaaggguauauuauccauggaaaaaugaagucuaguacaugugaagaauauuuuucuuuuccuaccuccuuucuauccaucccuaaucuuuacccaucuccuuuacacauaaaccaaggguccagacuucuaugcugaagaacugaucucuuugaaaaaacuuuuacuuuuuagguauauaaagaauauauuauccacagauacacaaauucuaauacauauaaaaaaaugaguuucuuuuucccacuccuuuuccauccaucccuaacuuucacaugcccucccuucacugacuauguucaaauauaaaccuaggguagagauuuucauuuugaagaauaauuuuuaauguauuuccaaaaaguaugcuuuacuaagguagaugaauaaugaaauggaugcaucaguaaaauccaaaacauagcuggcaugauuuaucugaaaucuauaagccauuucagaauuuucugaaaagggaaguaggcaggccaggcgcaggggcucacgccuguaaucccagcacuuugggaggcuguggcaggaggaucaccugagauggggaguucaagaccagccugaccaacauggagaaaccccaucucuacuaaaaauacaaaauuagccgggugugguggcgcaugccuguaaucccagcuacucgggaggcugaagcaggagaaucgcuugaacccgggaggcgaagguugcggugacccgagaucaugccauugcacuccagccugggcaacaaaagugaaacucugucucaaaaaaaaagcgggggagguagguaggaacacuuaaccauaaauaaaaacuuuaaucacuuagcauucauuagagggcacuguuuuucuuaauaucauguagacuguaaaagauagcuccuaaaugauagcuuaaaaaaauuacauggugauuaaaucacauuuuuacucccaauuggaacaaauacaaccucaaaauuuauccuaaguaccaaucuuugauaaaaacugauagccgaagaaaacuuuugacuugacaaucaaauggcaaaaucaucccaauaaaaaugucuuggccaggcacaguggcuuaugccuguaaucccaacacugugggaggcugaggcagguggaucacuugaggucaggaauucaagaccagcuuggccaacacggcaaaaccccaucucuacuaaaaaugcaaaaauuagccaggcaugguggcacaugccuguaaucucagcuacuaaggaggcugaggcaugagaaucacuugaaccagaggcagagguugcaacgagccgagaucgcgccauuguacuccugccuggacgacaaagugacacucugucucacacacacagacacacacacacacaaaaaaugucuuaagcagugaugcuaaauuaugauaaucauaugcuuauaccaaaaucaaguuuguguuauacuuuuuaccauauuuauauacuggugaaugucaaauaacaaugugcucaugguauauacagcauaaagugauuuuauuuuuuagaguaugucaccaaaauauuuuguagacuaucuaacuagaauaucuaaucuggcccacaggggccagaugcuaugggcggcucacaccuauaauccuagcacuucgggaaaccaaugcagaaggaccgcuugagcccaggcauuugaaaccagcaugggcaacacagugagaugccaucucuaaaaaaaaaaaaaaaaaaaaaaaguuuuuuaauuagcugggugugaugguguacaccugcagucuuagcuacucaggagccugacaugugaggauugcuugggcccaggaguucaagauuacagugagcuaugaucgugcuacugcauuccagccuaggugacagagugagaccuugucucuaaagaaaauaguuccauuauauaauaauauguaaaggcuggaugcaguggcucaccccuguaaucccagcacguugggaggccgaggcggguggaucaccugaggucaggcauucaagaccagccuggccaacauggugaaaucacaucucuacuaaaaauacaaaaauuagcaggacaugguggcgcauaccuauaaucccagcuacucgggaggcugaggccagagaaucgcuugaacccggggaggcagacugcagugagccaaaauugcaccacuacacuccagcuugggugacagagcaggacuccgucuccaaaaauaauaauaauaauaauaauaauaauaauaauaauguaaaaaaggagauacaacaacugcuagcaauccaagagucaucaucaauuucucuuccuucaggugcaaaguccaaguggguauuaggugguauuuuaucccuuccuggucccuaggauuuauguucugcuuucuauuuccaucugauugccacaucauccuuaauuuugaauacauuccuaauucucccugccucuagucuuucucucuaauucauuguuuguacuuuuccuaaagcuauugcuaugaaacaaaaaugugaccaugucagccuuuguuuaaauaaauaccuuugaugucuucucauuacaugggaagaaguccagacuucuuggccugaccucuaaggcuuuucauucuggaucuguccuguccguucaagccauagcuuuuauauuauuccauauuacccuucauaucaguucugauuucccaaacaugacaucuacacccaaaccucuggguuuuaguuuuaguacaugaaguuuccucuucuuacaacacccuucauucauaggccguuuuugacugacaaauuucugcccauccuucuaggaccagcucaagugcuaucucuguaagcuugugauuugccaaggcauuuuacuugcugccucuuuuguugucccaaagcacuuuauauguaucucuacuacaggacuauagucauccaaaagagauucucacauaaacaaucaccugaauuuacauuaaagugauacugcaauaagaaaaguuauccuuugaauaaauggugcuggguuaauuacuaaauauuaagaaaauauauuuguaagacauguaacugacaaagguccuguauauaaaguauacuuaaaaauucguauaaaccaauaaaaaagacagaaaacccaauagaaaaaagaagaaaaacagacuuggguaguuaauucacaaaagagaguaucuaaauauaaacauacaauaaacauacgaugaauaauaaacacacagaaagguguucaacuuagucaucagagaaaugcaaaauaaaaccaagagaccacuaucaacuugcuagaaaacuuaaaauaauaauuuuuaaaagacauuaucaaaaguuggcaaggagaacaaccagaacuauuauaugcuagugauauacguauaaguugguacaaccacucuggaaagcuguugacaguaucuagggaagcagaauauaaugcaacaauuccacuccuagguaagcacucaacagaaaugcuuacauguuaaccaaaaaacaugcacaggaauggugauagaagcauuauuugguaauagccaaaaaccgaaaacaaccagaaugcccaucgauaggagaauggaugaaguacaguacacucauaaauggaauaccaugcaacaaugaaaacgaauuaucuauaauuacaugcaaaaauagggcugaaacucacaaacauaacacugaacaaaagaagcuaacaacaaaaauaauacauacuguauaacuuccauacauacugggauacauauugugcaauauauauauacaaacuuuguauaaguauauaauucuguauaucuacauaaaauauauuuuaauauaauuacauauucauaauuacacaaagcucagacguuuuaauaaggauaaucagaaagagaauauuacacauuuaaaaaacaaauaagaauauaugugaaugggauuuuagaagauccagauaccaaaacauacuauaaaaacaguaugaucagaacaaugucacacauauggguaaaacuaaucuuuagcaucagaaggcagagaguauggcuacaguugaggaagugaggaauacuaaguaaagagaaagggaacagaaggggguuucugggauuucugaaauuuucuuuuacugauccagguacugguuacacagguauauuaacauuucaaagguucguugagcuguacaauuaugguuuguguacuucucuguauaucuaguauauauuaauacauguuuauuuauccagcacauaucuaguguaucuauauaucuaguauguauuuaucuaccuagcauguauuaauaacauuuaccaaaaauaaaauauaccuuaaauccuauuccaauaugcauccuauugaaugcaucuuaaggacuccaauaaaccuuuaagaauggaaaauaauaaaaaucgagaaggcaauauaauaaaauuuagcuauucuaaagucaaguauaaaaauuaauuuaaaauguuuacacccagaagcagcaaacaagcagaucugauugaugguggagguauaggagaccaaaaacuuacuaaggaagcucuacgagaccuucgacucauugguuggucaaaugguggacuguuuaucugcaacuuuucaagauauccaucagguauucugaugucugcaggcagugauaaccgcuuauuuaaauccuuaaaaaaaaaaaaagguaauccaaaauaguaaaggcaaggcauuuggcuuuuguauucacaggcucuaacauauuauuucuuagugauaaguaauuguaaaguuuuauugcaguugcaaaguuaccuacauugauuauauguaauauacucauggcaaaaacauuuacuguaagcaaaaguauacagcgaaguguuacagaaaugaaauuuugcaaccucaguaauuuuugaguccuuucacugguaaauucaacuugaaauuuacuuuaaauuuauuauaccauauaguaacauuaggcaaacacuaccacaaacucugugaucaguuuaaauaacuaaccaaguagacauuauaugaucuuguaugcaacauggggaaagagaauuguauuuauuacugccauguuaauggcauuucuacuuuauuuaauuauacaaugugagcugggauaaacuugaaaagaaucuugccuauaucauuguaucaagaaauuuaagcccuauaaaaagaaauuccucccauucauaacagcagccaaaccaugaaacggaauggagagguauaggaacugcauaaauauuuacugagaaauauaagacuuaaguauaaaaacauacaaugccaccaaaugguaagaauaaguaaggagaagauacugguccucccuauauuaauuuuauaaguuauauaaccacuaagaaaucacaauaagcuuauucuuagaacaaaauaaaaugccuaaaauguaucaauagaauaaacagaaaaaauccaaaaacauucuaaaauaagaaagaguauauguguauaugggggagggauacagaaagaagucuuuccagauauuaaaauauacuacaggucaggcgcaguggcucaagccuguaauccuagcacuuugggaagccaauauggugaaacccugucucuacaaaaaauacaaaaaaauuagccgggcaugguggugugugccuguagucccagcuacuuggggcuaaggcaggaggaucacuugagcccaggagguugaggcuguggugagcugagaucccaccacuguacuccagucugggugacagagugaggcccugucucauaaaccagaaaaaaauauauacuauaaaaagaauauaaucuagagcaugccuccuuggugguggggaaacaaauuauagcucaacgaagaaugagaaacuccagauacagacccuaauacuaaauaaaacaaaugauuuuaaaaaaucaucuauaaggugaagaaaaauaagaaauauuuucauuaguauugugucacauaaauauaucguugauuucaacaagugaaaauguuaauuuaucauuuagaaaacugauaagauuuccuuaacugauuaagaagaauccuuuuauaaugaaaauauaaucaaccaauaggagagauaccuuaaucaucaucucaacagcaccaaaaaagcaacaauacuuucauuucaaaacauguucaauuuuuuuuugcagaaaccuauuuuaguuuacaguacguacugaaauaacagucacgaucaacuuauguccucaagguuauaccacaacacuuacaaagaaaagaaaaugaauucuucauccuuuuacacggagaaauaaaugugcuucagagaucaguagguacagugaaccacaaaggaaaggacacccacuuuuauaauauaaugcaagaaaaaaaagcuguuuauuuauaccucuuaaaauuugaaacagagaaaauaaaaugcuaauuauccagaugaaucucaaaaauaucauuaaaaucguauuuucuaaaaagaagacauugcuaauguaucauucuguauuuccagaauuuuugaaaauucacuucuccuuaauggauaaccuaaaauaacguuucgcaaaaaauuaaaauaaaauguuucacagaaugcgaacaacuauauuacauaucuacauugggauaaaaauuaaaaaagaggaaauauucacagacugcaauuuaugaaugcaaagaaguaacuuucuuacaagugucacgugucuucaugaaaauuuuuaaaugggcauuuacuccacuugauauguauguguauuaacauauaccaacacacauauucacaaguauauuuguauuuuuuaaaugauuaccuccauugagauccgucuauguauacgauuucugagacaaacaccuguaggugacuggacuucaucagaugaugucccagaagcuuggucacucucaccaucugaucccauuuuuagauuuucaugaacaauaucuauaucaaaaaaugagacauuaaaagagauacauuauauucuaauauauaauuuauuaucacuauggguaaaauauagaaggccaacgaguaaaaaucacagcauaaaaagucauuuacauucugggugccacagguaugcaguuaauagaugaaaacaugacucaaaugucuuaaaauaguaugaaaucuuuuuacacuuucaaauuaugaaaaaaauuaacauucaaguuauuaucaaggguugaguaauaaaauuauaaacuggaaauaauaucucugagaaugagccaguucuuucauuuucuagaucugggaacugagacuugaaagguuaaaugacuuucaaaaguucacaaagcuuagaugcagagcuggaauagacaccuggucaucugccucuuauuuaguauucuuucaauuaaauaaugugucacugggucuaugguuaaauggagcuaauucuuggaauauucuuuaaaacaccucuuaaaagcuucuaaugcaguuucuccucccugcacccccaauguuaaaaauaaaacaauaaaaaauuauucacugaauaucuauuuuguaccagaacuacaaaaacaaguuuaugaucuucaaauacucaaaaaucuguucagagcaaaaacauacuacaaaaaagguggguuauggcaugcuuaauagagauaaaaguuaaauggaaguagggggaggaagauaaauuccauuugaaaauauuaaaaacagacauauacuguuuuguuuuugagacaaggucuugcucuguuggccaagcuggagugcagugacacaaccauggcucacugcagccucuacuucccaggcucaagcaauccuccugccucccaaguagcugggaguacaggcacccaucacaucugguguuuuguuuuguuuuauuuuauuuuauuuuuuuuguagagacaagguuuugccuuguuguucaggcucaucuugaacuuguagccauuuaugccuaguguuccauuauuggaagcuaagcaugugggagcuacuuauauccuacugcucaaggucaucaccaaggucugauugcaaaaauucaaaaaacugcaacuucaggaauccacccaccuuggccucucaaagugaugggauuacaggcaugagccaccacaucuggccaaguuguauacucauauaccugcauuugucagucauuaucuaauaacccagcaagaagaguguacuaggaaacaaaugcuggaucucuagaacuccucucuugccacuauuacuuucuauacacguauucauuuuccagaaagaagcauguuguuucaugcugcagugcuuuaacacacuuuuuuucucguuuuuaaaagaugccuuuuccuauuuuaucaacuuugugagaucaggcuuagucuucaaacuaugcucaugugucaucacucagugaagucuuuucuaaucucagacacaguugacuacugugcccccacccacugcacugaagaacauuuuuuggugcaugugauuuuauaagauccuuggggaugggauuuagcuuguucacuuuucuauuuccagaacuuaaccaacugucuggcacucagaaggugcuuaacaaguauucaagggaacugcauauuaacuaacaaucaaggaauggccuagauaacuagaucucuuuuucaaauaaaguuauauaaaauaucaaugugugagacaauuguauuuuauaaguauaaauguuaacuuuuaauaauauuuacauauaaaaucaugaggacugcuuagauuaaggagaaauuugaacucaagggucuuauaucaacucuaucuuaaaacucacuuuaugucuguauuuuugucuugguuaacucaauauuaagaaaacuccaauuaauauucauaagcaguugcaaaugguaauggauuuuuaauagcucaauauguaaucuaagaauacacuucaguuauguugagauuuccauagaaauuuuauggugauaugugaacaaaaaauuaauuuggcagcaaaaguaauguauuggugauugauuccuaaccucuuaaaauuugguauauaacacaucuaagguccuguauucauuucugucacaccuucaaaauguuaaaaauaauuuaaucauggcuuccauuucuagugagauaugaaaaucucccuuuccucaagaaaauguugacuaaaauacaauauuuuaaaaugcacagcuaaaugugcaagaauguauugguaauaccuaggaagcaaaaacaaagagaggacugaaaacccaaagcuguuauacauaaauugacucuaucagugucuuaggagaggcugcugauguugaugagaaggucccuggguuuaccuuccacauugggauaaaaaaugaagcccuggguuucugaguuacaagugagaccuucccacagaaaggcucaacucccaaagugcuacacuuuugagacuuacaggguacauuuaaaaaaaaaaucagagggaggagccaagauggccgaauaggaacagcuccggucuacagcucccagcgugagcgacgcagaagacgggugauuucugcauuuccaucugagguaccggguucaucucauuagggagugccagacagugggcgcaggccagugugugugcgcaccgugcacuagccgaagcagggcgaggcauugccucaccugggaagcgcaaggggucagggaguucucuuuccgagucaaagaaaggggugacggacgcaccuggaaaaucgggucacucccacccgaauauugcgcuugucagaccggcuuaaaaaacggcgcaccacgagacuauauaccacaccuggcucggaggguccuacgcccacggagucuugcugauugcuagcacagcagucugagaucaaaccgcaaggcggcagcgaggcugggggaggggcgcccgccauugcccaggcuugcuuagguaaacaaagcagccacgaagcucgaacuggguggagcccaccacagcucaaggaggccugccugccuuuguaggcuccaccucugggggcagggcacagacaaacaaaaagacagcaggaaccucugcagacuuaaaugucccugucugacagcuuugaagagagcagugguucucccagcacgcagcuggagaucugagaacgggcagacugccuccucaagugggucccugacccccugacccccgagcagccuaacugugaggcaccccccagcaggggcacacugacaccucacacggcaggguauuccaacagaccugcagcugaggguccugucuguuagaaggaaaacuaacaaacagaaaggacauccacaccgaaaacccaucuguacaucaccaucaucaaagaccaaaaguagauaaaaccacaaagauggggaaaaaacagaacagaaaaacuggaaacucuaaaacgcagagugccucuccuccuccaaaggaacacaguuccucaccagcaacggaacaaagcuggauggagaaugacuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacaugaagaaugcagaagccucaggagccgaugcgaucaacuggaagaaaggguaucagcgaucgaagaugaaaugaagugagaagggaaguuuagagaaaaaagaauaaaaagaaaugagcaaagccuccaagaaauaugggacuaugugaaaagaccaaaucuacgucugauugguguaccugaaagugaugcggagaauggaaccaaguuggaaaacacucugcaggauauuauccaggagaacuuccccaaucuagcaaggcaggccaacguucagauucaggaaauacagagaaugccacaaagauacuccucgagaagagcaacuccaagacacauaauugucagauucaccaaaguugaaaugaaggaaaaaauguuaagggcagccagagagaaaggucggguuacccucaaagggaagcccaucagacuaacaguggaucucucggcagaaacccuacaagccagaagagagugggggccaauauucaacauucuuaaagaaaagaauuuucaacccagaauuucacauccagccaaacuaagcuucauaagugaaggagaaauaaaauacuuuacagacaagcaaaugcugagagauuuugucaccaccaggccugcccuaaaagagcuccugaaggaagugcuaaacauggaaaggaacaacugguaccagccgcugcaaaaucaugccaaaauguaaagaccaucgagacuaggaagaaacugcaucaacuaaugagcaaaaucaccaccuaacaucauaaugacaggaucaaauucacacauaacaauauuaacuuuaaauguaaauggacuaaauucuccaauuaaaagacacagacuggcaaguuggauaaagagucaagacucaucagugugcuguauucaggaaacccaucucacaugcagacacacacauaggcucaaaauaaaaggauggaggaagaucuaccaagcaaauggaaaacaaaaaaaagcagggguugcaauccuagucucugauaaaacagacuuuaaaccaacaaagaucaaaagagacaaagaaggccauuacauaaugguaaagggaucaauucaacaggaggagcuaacuauccuaaauauauaugcacccaauacaggagcacccagauucaucaagcaaguccugagugaccuacaaagagacuuagacucccacacauuaauaaugggagacuuuaacaccccacugucaacauuagacagaucaacgagacagaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccacauaguuggaaguaaagcucuccucagcaaauguaaaagaacagaaauuuuaacaaacuaucucucagaccacagugcaaucaaacuagaacucaggauuaagaaucucacucaaaaccgcucaacuacauggaaacugaacaaccugcuccugaaugacuacuggguacauaacgaaaugaaggcagaaauaaagauguucuuugagaccaacgagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaucaaugaauccaggagcugguuuuuugaaaggaucaacaaaauugauagaccgcuagcaagacuaauaaagaaaaaaagagagaagaaucaaauagacacaauaaaaaaugauaaaggggauaucaccacugaucccacagaaauacaaacuaccaucagagaauacuacaaacaccuguacgcaaauaaacuagaaaaucuagaagaaauggauacauuccucaacacauacacucucccaagacuaaaccaggaagaaguugaaucucugaauagaccaauaacaggagcugaaauuguggcaauaaucaauaguuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauucugauaccaaagcugggcagagacacaaccaaaaaagagaauuuuagaccaauauccuugaugaacauugaugcaaaaauccucaauaaaauacuggcaaacggaauccagcagcacaucaaaaagcuuauccaccaugaucaagugggcuucaucccugggaugcaaggcugguucaauauacgcaaaucaacaaauguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugccuucucucaccgcuccuauucaacauaguguuggaaguucuggccagggcaaucaggcaggagaaggaaauaaaggguauucaauuaggaaaagaggaagucaaauugucccuguuugcagacgacaugauuaucuagaaaaccccaucgucucagcccaaaaucuccuuaagcugauaagcaacuucagcaaagucucaggauacaaaaucaauguacaaaaaucuuauacauuguacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucaaugccauccccaucaagcuaccaaugacuuucuucacagaauugggaaaaacuacuuuaaaguucauauggaaccaaaaaagagcccgcaucgccaagucaauccuaagccaaaagaacaaagcuggaggcaucacgcuaccugacuucaaacuauacuacaaggcuacaguaaccaaaacagcaugguacugguaccaaaacagagauauagaucaauggaacagaacagagccuucagaaauaacaccgcauaccuacaacuaucugaucuuugacaaaccugagaaaaacaagcaauggggaaaggauucccuauuuaauaaauggugcugggaaaacuggcuagccauauggagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcaugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaaaaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaugacuauaaaucaugcugcuauaaagacacaugcacacguauguuuauugcggcauuauucacaauagcaaagacuuggaaccaacccaaauguccaacaaugauagacuggauuaagaaaauguggcacauauacaccauggaauacuaugcagccauaaaaauugaugaguucauguccuuuguagggacauggaugaaauuggaaaucaucauucucaguaaacuaucgcaagaacaaaaaaccaaacaccgcauauucucacucauaggugggaauugaacaaugagaucacauggacacaugaaggggaauaucacacucuggggacuguggugggguggggggaggggggagggauagcauugggagauauaccuaaggcuagaugacgaguuagugggugcagcgcaccagcauggcacauguauacauauguaacuaaccugcacaaugugcacauguacccuaaaacuuaaaguauaauaaaaaaaaaaaauucacacuuaaaaaaaaaucuguccuguugcacaaggaauuggacgacaaagaaagcuuacuaaucucagacuaugaauaaauacuugaguaccaucugacccaaacaagaaauuacucacgucauuaacaaacaaguguaguucugacaugacuaccagucgguauuuucauuuccaucaagacaaacgugaaacaaugauggcuugucagaacuuuacucaucugucaaggggggaagagggauaucucucugcugaucagguaauguaacagcggcagauacaacauacuuuucuccuccagcacaauacccuuuaaauuuaaucugcguuacuaacauuuucaauacacugucuuaguucuagaacaagggucuagaacaaguguggcuucuuuuuauauggcccaugagcuaaaaauguuuuuuguauuuuuaaaggauuauuaaacagagaagaauaugcaauggagacuguaugcccauaaaaccuaaaauauuuauuacuaacugcccccuuacaaaaaaaaaaaaaacaaacccuggucuagacaaacaagaaaacaauaagccagggccugaucuguaguguuuucugacuucucucuccauggacaacuucaggcuaccaacaugacaacacugaacauaugguugggaagaaaugugcaguagcauaccauuauauaguguuuuugacuauaacuagaacagaaaaaaauaacgccgguggcauagauaauaguuaaaagugguaaaaaauuaggaagcaaugacuuuugcauauucauuaccuuuguuuuuaauuuaguuuaccuauuuguaaacuuauauaauuuaaaauuuaauagcuauguuuaacaaccaguuugcaaaguuccugaaacuuuaacaaucaucucuuaugaacuagugugagccaacuccagcauaccauucuguagagacacaccuacagagauaaaggcuauaugcaguucucacagaaaaaaucucacuguagauaagcucauacucccaaaauuaaagaaacacauuuggaaauaauauacuauuccaagaguaagcacauaaaacgagcaguagaauaaaaccccaaggagcuucaguaaauauaauuaucuaagaagacuauaaaauaguuguacuugaagugauuuuaaaaaucaaaacauaauaggccaggugugguggcucaugccuguaaucccagcccucugggaggcugaggcaaguggaucacuugaguccaggaguucaagaccagccugggcaacacagugagaccccgucuucuaaaaaaaaaaaaaaaacaaaaacaaacaaacaaacaaauuagccaggcguagcggcaugcacagguaguuccagcuacucaggaggcugaggugggaggaucauuugagccugggaggucagggcugcagugagcuucaauagcaccacugcauuccccuccagccugggugacagagugagacacugucucaaaaaaaauaaaaauaaaaauaaaaacauaaggcaucaucaaaaaaggccagaggaauaaacagaaacuugcaauucuuuuuucuuggauauuuaaagacauaaugacagaagaagaaacaauucaggugauaaccacauauacuauucauuauaauaggcuuuauauggugaugaucugaaaaguuacugaggcauuacccuaaaauaaacaccaucccaaacugccauucaucuugaaauacugcauccauuuauuauggguuucauuucccuccugauggacagguuuuucaaauauuacuucccuguauugucagcacuacuaccucucuagaacuuuccauccuucugcuauuccucuugaucucaacuugauuuuuaucugacagaagaaacgagauaauaaaaguugcuuaauuaaaacuuaacuaugugcaugacguauaaucagaaagguaaacacaacagacaaguaaucaaauuaccuaaucugcuuccauuucugggcauugccaugaaggagccaaggcucccuccaauaacacuguguggucuccgcaaugggggcuucuugaaagauccuguguacugguggaggaaggaaugcauacugugagacguuggaggccugccauucuucacaauaggcucugugguucauagaauucgaaaaucauuccaucaucaguccaagauccaggaucacaugagaaggauucagaaagcaaaacaaaaaguuguaacagagauuaguacauuuagccucauugcuuugcuuaacuauacacaguauuaaaauuaaaauaguuucucugaaaaaauacuuaagaaaauacuugaauauuuuaaguuggucuaauaaccaucuauuucuuauauaaucaaaaguggcuaagaaccacaaaacuacuaauauacccaaccaaauuuucauccauuuguuuauuuuaguguaucucaagauuguuuccauaccacuccuccauuuauugacuaccugugugccuuauuuuaagcaugcuuggcugggugcauggcucacaccuguaaucccagcacuuugggaggccgaggcaggcggaucaccugaggucaggaguuugagaccagucugaucaauauggugaaacuccaucucuacuaaaaacacaaaaacuagcugggcaugguggcaugcgccuguagucccagcuacucaagaggcugagacaggagaacugcuugaacccggguugcagagguugcagugagccaagaucacgccacugcacuccauccuaagcgacagagcaagacuccgucucaaaaagaaaaaaaaaaagaaauuaagcaugcuuuagaauauaaaagacauggucccggccuaaaggaauuuacaucccuguuugcuggacauucaaaaugguaugucaauuagugaauaaaaccgaaguaccuaaauacauaucaauacagaggcuccaaguuuauuccccugaauuugggauuaauauaaagaguuuuuaaacaaucacagacccauaaccaagcagaaacauuaaaaaaauauaauacuuaaaagcuauuuaauuaugcaugggggagaaacuguuuuguaauguuuaucaggaaucucuugacuccuuuccaccuccaaagaagagcucugauacagguuaaagauacaagucuugugauacacaauuagucuucuauauuagaauuuuguuuuuacugauagcagccaaggaguuuuaaaaagaacugggcugcucugaauaccuucuuuuuaaaaugaagccaacuauucuucuguagcuaacaaucaggcauaaggauaccuccugaucaggggauuccuuuuuaaaaugaagccaacuauucuucugcaguuaacaaucaggcauaaggauaccuccugaucaggggauuccucuaccuguuucucaacuaagguuucucaacuaaggacagguugacaggaguuggcuacaagccuuaaagugaaaggcuucucucacaagaaaaucuuaggauccgcagaacaggaccaggguaugggcuccagagaaaugggccaagaaggccauguggccugagccucuacgaauacugguugccuaaaaggguauaagaaggauggggcauaagggcccaaaggcucacccaagguccaagcuaucuaaucugggucaaagacagacuggagguaggggcaaaugccuaccuaguaauacagaacaugugucuaaaguuuccugugaucuguacauucccuggcaguaccuaacugauaaagaauuuggggaucuuaagugaagcaaaauaaucaaugauuuaauaaugaaugaagaggggcuaucugauauaaaugcauaaauaauuacaaacaaugugggauaauacaggcuacagcauacaauaagauuuuucucagccaagcaugauggcaugcaccuguagucccagcuacucaggaggcuagagugggaggaucacuugugcccaggaguuugcggcugcagugagcuaagauaaugccacugcauuccagccuggguggcaaaguaauacccugucucaagaaagagaaaagaaaaaugaagauuuuuuucucuuucuagguuauuucacaugugaaauaucacaacauucaaauauuaaaaacaaauuaugcaaaucuuuugccuacagacaacauuuuaguugcucuguaaagcuguccuggagaauacagcuugauuguucuggagaauauagaaaaaaaauggggaucauaaggacauacuauuugauaaacacuauucuaggcacugggcaucaacuggugaacaaaacaaaguacugaucucagagugcauaaaaccuaacagggaaaagacacacacacgaagucagguaaugacaggcgauaugcaaaagacuaaaauagagggauguggaaaugaguagcuaguuauuuuacacuguauauugaggaaaguucucucugcugagauauuuuuaacagaaauuuaaaugcaagaaagagccagucagggaagaugguuaaguuguggauaacaggauauuccagauagagaaaaaagcuaaugaaaagccgacauauggcagaguucgacuuguuagaacagugguccucaaacuuuaacaugcuucagaaucaucaaggaucuguaaaacaugagauugcucggucucacccacagacuuccugguucaguaggucugguguggaaucuaaaaauauguguuucuaacaaauucccagguccugcugacauugcugguccagggaucacacuuugagaaccacuguguuagaggacuagaaagaaggcaaguguagcuauaguaccuaaccgugcgggcaacagugguaccaggugagaccacagagguaaggagggaacaagucauucaacacuuuauacuucaccauaaaaguuugaauuuuauucucagauuggaagcaguuacgguagcuuugaagcaggagagugauaugaucugauucauguuucaaaaauaucacugugaaggguuaaagauaguaggagguaaggggguagggaagacuacaaaagguaacacgagagaucuauugucaugaugaaacaguucuuaaucuugauugcagugguuauacgaaucaacacaggugaggacaugacacagaacuauauuuagacuuuauuccaguaucuguuuccuggguucuauaguuacauaagauggaaccaaugguggggggauugggagaaggguacaaguauggguccuuucuauauaaucuuuguaacuuccuuuauauuuguaauuacugaaaacaauuuuuuaagauaucaucuugguugcuguuugaaaaacaggcaauagggaaucaacagcaaaaggaggagauuacuacaguacccuaaguaacaaauguugguggcuuagacuaggguggcuguacugaagauggagggaagcaggcagauuuaggacauauuacaaaggcagaagcaacaggccagcagacacgacugcuaaauuaguuucacacacacuccuaccacccagcuuuuagucagcauuuauaguaaaaacaucuauucaaauauuuuuuuuuucuuuuuuuccaggcagggucuugcucuguugcacaggcugaagugcaguggugcagucacagcucacugcagccucaaccaccugggcucaugugguccucccacuucauccuccccaccauagcugggacuacaggcacacaccaucacaccuggcuaauuugugucuuuuugguagagaugggguuuugcuauguuucccagcuagucucaaacuccugggcucaagugauccuccucaccucagccucccaaagcacugggauuacaaugagccaccaugccuagccccaaaauauuuuuaaaucuuuaccagaucaacuguuaaacauauaugaaauaugauguguuaauggacuauaacuggaauuguguaucagucacauugaucagggguccccaacuccugggucacagaccaguacugguccauggccuguuaggaaccaggccaagaggugagcaguuggcaagugagcaaagcuucaucuguauuuacagccacuccccauugcucacauuacugcuugagcuccaccuccugucagaucagugguggcacugauucucauaggaguacuaacgcuguugugaacugugcaugcgagggaucuagguugcaugcuccuuaugauaaucuaacgccugauaaucugucacugucucccaucaccuucagaugggaccaucuaguuguaggaagacaagggcagggcucuuacugauuguacauuauggugaguuauguaauuauuucauuauauauuacaauauaauaauaauagaaauaaaaggcaaaauaaauauacuaugcuugaaucauccugaaaccauucccccaaccucagucugugaaaaaacugucuuccacaaaacuggucccugaugccagaaagguuggggaccacugauacagaugacuaucauaaucaugaguuucuaaguuauuuaugugguaaaaaauaggaagcuacaaugguggggguugggggcagggaggagacaacaguaaaguaaaggagagaaaagaauuggggacaaugccuagauuuuuaguuuuaguaacugguuaagugagcaaaguuugaguagaggcagauuuuggagaaaggaaaucaagaauucugauuuggucaugugaagucuaagauucccauuacacauccauguggagaagacaagaaggcauuuaaauaugaaucuagagauccagaugaagauccuaacuggagauucagacuuaggaguagucaacauauauaugguaguugaaauuguaggguuggaggaggucacccaaggagaggguauagacagagaagagauugcggcccaugagagagccacaauaaaauacaauaaaauauucuaacacuuccagaacuugaaacuaauuagcuggccaauucaauaagauaauaacacucuguauuuuaaaaaguaauggaaaccuuggcgacaauaugcuaagggaaauaagucagacacaaaaggacaaauauuauaugguuccacucauaugagguaccuagaauaggcaaauucauagacaguagaauggugguuaccaggggcuggggagaggagggaauguggagguauuguuuaauggguacagaguuucaguuugggaugaugaaaaaguuauagacauggguagcagugaugguuacgcaauguaaauagacacguauuuaaugcugcugaacuguauacuauaaaauguuaaacuuuguauuauauauauuuuaccauaacuuuuaaaaaguaauagaaaucuauaugaaaaauugcagaucuuuuauacucuauaauuaguuccaaguaaggauuuccaaugauuuuuaccaccacaacaugauaaucauuaugauuccacuaagaaacguuauuuggcaucuuauuuaucuagaucuuuucauuacgugaacuaugaucaggaacaugcaauuucauagcccaacuuguagccuaagccauucccuccucccaaaccugcucuuucaaacauuauuacuagccugaucccauucuagauccuacauauauccaauggaguuuaugccuucagcgucaaccuuucaaggaacuugugcuauuuguuggaguuaguccuccuuaaacucccuauguuauccacuguuguaaaaaacaauuacuguuaugauguaaccacaaacugucgaagacaaacugucacagcuaacauguaagagaucagcaagauaaagagaccuaggugaaagacagaggcucacaauauccauaaaacuggaauuuguugacuccaaacuugacaaauugcuccaguguacaaacggagcuguuaagaaugagaauuuggaauaucaggaaaaccaggucauuuuaaucuuugcuuuuugguguuacuucuaaugcuaaauaaucaugauaagugacauucuguuagguuuaucugacuacacuucuugggaacauguacauuagcugaagaauuucaguuggucaagaagucucaaguaguauaugugcaauaaaacauaauuuuaccuuucuacaacugugauuuauucucuuccucacauuuaaauugucaccuauucucaucaaauucaauaaucucaauauaucgucccauuacaagaaaaaauaaguucaaggcuauguaaacacaagauucugaaauauaacuuucugugauaagucuuaaaauagaauuaagacuuaucaaacaucuguucugcugcagugacagcaaaaaaaaaaaagacaucaaauacauugaguguuuaugagggaaagcugaagcucagaugaacugaauuuuuuauugagaugaaauucuuauaacauuaaccauuuuaaaguauacaauucaguggcauuucauauacuuacaaugugguacaaccaucaccucccuguguuccaaaacauuuucauauugcuaaaggagaucccauacacaauaaccagucacuccucagucuuuucucccuaucagccucugggaaccacucaucuacuuuuugucucuauggauuuaccuauucuggauacuucauauaaauggaaucauagaguauuuugggucuggcuccuuucaguuuucaaaguucaucuaugcuacagcacauagcucuucauucauuuauguauugaauaauauuccauucuauggacagaccacauucuguuuauccauucaucuguugaugggcaucuggguuguuuacaccuuagcuguugugaauagugcugcuacaaauauaaauauuuguguacaagacuuugauuaccuguuucaauuauuugggguauauuccuaggaacagaauuguugggucauauaguaagucuauguuuaacuuuuugaagaacugagguaaauuaauuuuugacagguguguuuguuuguuuguuuuugagaugcagucuagcucuguuacccaggcuggaaugcaggggugccaucucggcucacugcaaccuccgccuccuggguucaagcaauucuccugccuccugagcaggugggggacuacaggcgugcgccaccacauuccauuaauuuuuguauuuuuaguagagacgggguuucaccguguuggccaggcuagucuagaacuccuuaccuccagugaucugcccaccucggccuccccaaagugcugggauuacaggcauaagccugguaccaugcuuggccuugacagguuuuuaaaaacugaacauuaaacacuucucaguuaguaaaaagaaaacugaugggcucaaaauucuuuuucuuccaggcacuacagaaaaaaauauuuuguacauuucaguuuggaaauuuuucugcaaaaauuuuauuucauauuuagggaaagguguauugaguuaaggccagaauccuuaaaugaaccaaauuugcaaacuuucaacuuuuuuuuuuuuagcauacugaauacaaauucaggauucaucauuccuuggguucaacccaccugucaaugugcaaacauacuaguuucuauaaauagacaaaguaauuugauuuauagauuuauaacugaguuaaaaaccuucauauaugacucaguuaucaaaauaagagagauaauaucucauuugggauauucuauuguauuuggauagagguagagcaugcaugagugagauuauggguauaaguauaaccaaacgcaucauacccauaauuucuccaacauguuuauaguauuacccccaauuaauguguucuggaucuagaguaugcaugagagccaugugccuagauaugcaagaguaauaggacugugaucaugccugugacuaaucaagagacaagugaucaaaaauugguccaaaggcaguuuauucagggaaauuauaaacuacuguuaugugccaugugacguuucagacaaugacagacaucauauacaacaguggucucauaagauuauaauggaccugaaaaacuccuauagccuagugaugccagugaugccacacccgcuguaacauaguagcacaaugcauuuccuuuucuauguuuagauacacuuagauacacaaacaacauuguguuacaacuaccuacaguauucaguaccauaauacacuguacagguuuguagccuauaaguaacagguuguaccauguaggcuagguguguaguaagcuauacuaccuaguuuugauauacucugauguuugcacaaugaugaaauggccuaauaacguaucucucagaaugcauccccacuguuaagcaaugcaugacuguauauuccuccuacuccuucagcuagcauuaugcuacuauuuggcauuaaagcucacuuuugcuucauaaacugcuuacauuguaugugagaagauaacuuuaaaaguauauacgugucauucauuaugcuauauucucuguauucuggcauggacugugucuguguaugugaccugucuaacagcuuuuauacucuaaaauauguuccacaagaaaagaauguguuggaaucagcuaucaggcacugacaggugaccaaaaagguguagaaucucugugaaagcuguuggugaaauccaugugcuauuacagagagaaaauaagcauaguagauuaugguagccuaugcuacuagcaaucuuuguaacccaagaggaaucaaugucucuuaugacgucuugaaguauuacuucaaggucaaggagaaacucaauagaucgccuauuugcccuuauuuacuaccuauuaaaaguuacuacuguaauaaaauaaguuuuaaaaaacauauacaacuugagaaaacaaauauuuuuaaucuuucaccauuuguuaaaaacaaagcauguuuuaugauaguuaauaccaaaauauucuagaaaauaugcaauuggucuaaaauauuagcuaaaacauacguucauuuucuuugacucauaucuuuucuuuaggaaaagaggauugucuuguagucaaauacuaaaaauaugucccagaaaccaaccacuaagauauauacuguguuuauuuuauuccugaucaucauuggcaaacacauuggcaagacccuucuauccuaagaguaggcacacugcgcuucccaccaaaaauucaaugggggggggucccaccaaaaauucaaugagggggucuaaaagagaauuaaggauuuugcucuguguaucuagaauagguccucuggcaagaggaacaacaguaaaaucaugauguuugagauuugacccaaauguacaauuuuccccuccuacauauaauucuauccaaauuauuauauuaaauuuccuacugagcccaucccucucuccuccccaccaugacaaaaacaaaacaaggccaggcgugguggcucacaccuguaaucccagcacuuugggaggucgaggcaggcagaucacuugaggucaggaguucaagacuagccuggucaacauggugaaaccccaaccccaucccuacuaaaaauaauaaaaaacuuagcugggcaugguggcccaugccuguaaucccagcugcucaggaggcugaggcaggagaaucacuugaacccaggagguggagguugcagugagccaacauugugccacugcacuccagccugggcagcagagcgagacugucucaaaaaaaaaaaaaaaagguagauguuaucaaggaaaaccuuaacaaaugaaugaaaggguccuugcagaacaguagcauuguuauagacucugaagugaagaaaccuggguucuaaaguacugguucuggagcuggguaaccuugagcaaauaaugacccuucugaguaaaggaaauaagaaaacugaagccuggguagaauaaacggcuuagccagucaucaacuaggaaguguuuaaguguauccaaaauccaaaccuaugacuuuaaaaaguccagagcccacuccacuauaccuuuuccucucucaaaacauaaguaugugcauucuaguggaagggguaaggguguccaugcuuuccagccacugccacaaaucucuaacagcagaauuucaggcacagguaaggaagaucugccagauacucugcacaucaugacacacugaaagccagucacguaaguuccuucccaguuacuacuaugacaucccuagggcuauuucagauuugaauauguagccuuccucuagaaauuucaccaggauuuuguauuuaacacacuuaacaagcucuuuuuauuuuaacaucuggauacuacuacuuuauguuguaaaaagcacugucaaaugcaugaaacauuaugaaacugaugaagccacaaacagaaauuucacagacuuccuaugcacuuuuaagcuguauuaacuuggguuauaagaauaaaaaaaauuaauaguuauuuaacaaucaagauaauauuauaaaaugcauucuucuuuaagaacuagugaaaaauggaaggauauguggaauagaacaauucaucaggguuugagaccagguaucguaauguuggagugagagggaaauauuccaguuaguaaccaaacaaaaguuauauagucuucaauuuccuaagaaaccauggaaugagacagaaauaaacaaagggaagcuauuaugaacuuaucuaaaaaguaaauuuacauucuauucauaaaguaauuaaaaggaggaagcaucucccccuaugccaaauauuuaccauuauccuugcugcuguuuucuucaauagucauuuguucagccaauucagacaaugauucaucaauagucugacuuccucggagugugagggauagccuucucuuaaauuuuuucauccuaucaauugaauguggcuugaaaaauccugaaagaaaagaauaaacacaaaacuaaagcuauaaauauuuuaccacugaagaaaaauaccgccuggguuuacuggaaaucuuuaaaauaggaauauaaugaggaauucucacuucugccaaacaucaccaaauccaaccccuuuuuuaaaaagauucaccuacuccgaauaaugcuguauuuauuuggcaucaucagaagagcaggaauuccauguaacuaaagagugggacuuuaagcaucacaaauaaguuuagaaggauuggaaauuuucuuaaaauguguauuuuaaaaaccauuauaguaaaauaucaauauuauuuugaugcuuagguuccauaacauaaauaucaaucauuauauuggaaccagccagugauaucuucagauauaacagggaggcgggugagguaauggaggaagacaaagaacaauguuugacaauuaaacagcuccaacaagaaauuuuccuuuuuacgcucuuacacagccaguacauuagaguuugguuuuguuuuuacuuguuaggcuuucaagugucucuuucauccuaagagaaccaagcuuuagaaggaagaaacgaaagccaaauuagcggguacugaaugccugccacacagcagacacuuucauaucucuaauugugucuuccuaauucugaaagguaaaguauacuaucccauuuucacacaugaggaaacgugcucaaagaaguucccugacucaugucaaacaaauaaaugacagaacugagauuuaaaaccagaauuaccauuuacuuuuuccuucacacuuuaacaucuuugaaaucagaauguaucucacaauuaaugugaugucaaaauguaacugacaguauuuuuucuuacagguacauaaauuaaugguauaauucauaguagagucuuggauaugaugaaacaagguacuuaugccaaacccaaauucuugacccacaauuuccuuucuaacuugguauuucuaugaugagcuggcuuaccagauugccaugcacacuauaaccauuaucccaaccaaccaagaguaagggccguacaacuccucuauauuaaaguacagggguuuuaccauccagcuccagauaucuauuuuauagcuguaaauguuuugcuuauuuucucauucuaaggauuuauucuaaguaacugaguuuacugaacagguaaucuaugcauauuaguuacagaauaauuuauuuuugcuuaaaagcuggggggggagguaucacaaauaaacauaaguaauaauuuuauauuuuacuacuuucauauuauauuuuaaaauagaaaccagcugggcauaguagcucaugcuuguaauccuggcauauugggaggccaaggcaggaggaucucuuggggucaggagguuaagaccagccuggaaaacagcgagaauuugucucuacugaaaaaaacaaagaaaauuagccaggcaugguggcaucugccuguaugcccagcuacucaggagacuggggugggaggaucacuuugagcccaugaauuugaggcugcagugagcuacaaaugugccacugcacuccagccugagugacagaauaagaugcucucuuaaauaauguuuuuuaauaauuuuuuaaaaauccacuaaaauaaaaauaccaaaaaauacuaaauacacauuaaaauagcaagaguugcgacugcacuuuaauaaggacucuuuucacccacaugcucuaaaauaagagacauacuuuggugagauauugaaaaguuucuauuccuuagcucaguuuaaagucgaguuuaugccuaauguuuucuacuaacguauccuccaguucacaaauccucuuuucagcugugucuaaucugcaguuaaacccaucuguugugcucuuaguuuuaguuacuauauuuuucagcucuagaauuuccauuugacuccuuccugcagaugccaguucucuagugaaauucuccaccucagcaucuauuuucaugaaccgaauacaguauuuuaaagccccugcuuuuaacuccaaagucugaacaaucuaucaaucuguuucucuugucaauuuucuucucuugaucuuuuuguaugcuuaguaauuuuuuauuguauguaagacauugugaguuaucauaugcauauguauacggaaaaaacguagagccuccagaugauguuaccuuccuccagaaaggauuuaauuuuuauuuuuuuuaacagucucuguaggagcagacugaugcaauccaauugggacugagcugacuugagacugaguuucagacacuacaaagauagguaggccucugauuuguccucacucuaugguguggcucuucacuagggccagaacaccaccacaacaaacuauugaaagcuccauucaacuuccucagucguuuuuugcucaucucuuaugccuugcucagcuuuuaucuucuuacccccaauagcuuaagagcuggaaaauggaucaagaggaaaaccagcacagagugugucugucucccuucucuccugaaucuugacucuucaaguguugauucacugagaagcuuuacaaugccuucaaaaugauuuuuuccccuagcauuucuaguuuucagcaguuuuagucuguuacaaguuacuccaucauaggcagaaauggagguuuugauguggauuagaugagauaauauaugcacuucccaagcaaaggagaaaguaaaccaugaaguucauuccaauuaagaaaccuguuaauuguaggguuacucuaaaugcuauucuuuacuucugauagucaaccuuuauagcucuaccuugacagucaguaacucaugccauuuguuuaaacacacuagauauuuaaguuguacugagcuauugccacucucaucuacccuuuguuucuguaagacuuuacacuacuuuacacuagagacaucuuccuuuguuaggcucccaaaucauccugugcagucaagaaauaacuagggaggcuugggguacucuaacucugcacauucugaaaaaagcacuagucugugagaggcuccugggagauaaccuccgagcccuuggaauauccugccugauaagagugucucuacauaacugacaccuuggaucauaucagguaaucuauauaaacaauaugaauuaugguuaaugcuuguuuuuguaugccuggggcucuggcccacacuauaucaguuugauuucuuaggugaggaaggaccugcaggagaggcuggagacugaguaacuaaagucagucauaugagcacuccaugccuaucuaauagauccacaguaauuuucuugcacaacaagacucaggugaacuucccugguugaagcucuuugcauguugucauagcccaugcaacuccacuggaagaaggcaaaugaaagcucacaucuggauccucuuggacuucaagcuacauaccuuuucccuuuguugauuuucaucugcaucuuuuagccauaacaaaucauaaccaugaguuuaacagcuuuucucuuaaguucuaugaguccuucgagcaaaucaucaagcaugauggguuggucuuggggauucccaacgcacacuccaagaaaucuacgugccccagcaaaaaguccuaagagaugguagcucauaacuaccaacauuucggacuccaacuuuuucaaacacaggcaucuagucacuaauuuuuguauuuuuaguagagauggaguuuugccauguugaccaggcugaucuugaacucccggccucaagugauccgcucaccucggccucucaaagugcugggauuacaggcaugagacacugcgcuuggcccucaacauguuauuaauauaauaguuauuaacuuuuuuuuuggugagcgauaauaaauguuauugucugaagccacuaagguuuuuuuuuuuuuaauuuuuaaaaaaguuguaaaauacacauaacaaaauucacuaucuuuaccauuuuuaagugcaguuucagugguauuuauuucauauuguucugcaucuaccaccauuuuccaucuccagaauucauuucaucuugcaagauguaaacucuguacccauuaaagaauaaauucccauuccuguccuucccccagccccuggcaaccaaaguccacuguguauuuuacaguugcauuauccgacuauacagacaucaccacuucagaaucuugccacaccauuuuugaaugacccuuuugcuauuuugcugaccacgggaccugccuauuguucuggaugacaaauaaggacaaaaauaacaaaguauuauagaaauguuauuacagaauuaauucauauaacaguaacauucuguaacacagaguaacuauaaauggauucaguaucuauuacagcacagaacugagcuauccaaaacuguagccaacagcaggcuaauaagcacuugaaaaguacguaguccaaacugaguugugcugcagcuguaaaauacacaguggacuuugguugccaggggcugggggaaggacaggaaugggaaguuauucuuuaauggguacagaguuuacaucuugcaagaugaaaugaauucuggagauggaaaauggugauagaugcagaacaauaugaaauaaauaccacugaacugcacuuaaaaaugguaaagauagugaauuuugcuauguguauuuuacaacuuuuuuaaaaauuaaaaaaaaaaaccuuaguggcuucagacaauaacauuuauuaucccucaccaaaaaaaaguuaauaacuauuauauuaauaacauguugagggccaagcgcagugucucaugccuguaaucccagcacuuugagaggccgaggugagcggaucacuugaggccgggaguucaagaucagccuggucaacauggcaaaacucugucucuacuaaaaauauaaaaauuagccaggcaugguggugcacgccuguaauccuagcuacuugggcugaggcauaagaaucacuugaucccagggggcagagguugcagugagcuaggaucgugucacugcacuccagccugggugacagagacucugucucaaucaaucaaucaauaaaauaaaauaaaauaauguugaaaaauauuuuagauguuuaaguaaaaaaaucaccaaaauuaacucugccuuuuaaaaaguuuucaaaaaauaugccuacaaaaaucuuaaaaauuacauauggggugcacauuacauuucuacuggacaaugcugacauagagcauuuuauaugcucuaugucagcaugguuuuaagagagucuaagagaaaaaaauagaaucacauaaaccuuaaccuuuucuucauauagugcauuugaacaauguaucaggggacauucuaugcgcuucuaacucagaauaauacgcauggcacuuauuucaucaucaaagagugaagaaaauccuggucuauaaaguaauuuuaacuauacuuauuuuauauucugucaggaguaagaaagauauuucuaauucauaaaagcaagagaaaaauacuuauaaagcuaaaccuuacuauaaaauuuucaaauaaaaucacaucuucaaauuguuccuauuuuuaaucugugguauaauuguaaaauuuuaauuaaguuacaaugauuuguaaacacagauaauaaagaauuucauuaccacagccuagaucauuauuaaagaaaaaauauucccaaaugaaauagguucccugacauuucuaauuaucuuuaaguagaacugugcauaucaacuuuuuucguuagcugagaacaaaggcacauaugcuaaacuaaaaacaccuuuugugacauaaaaacuacuacuuacacuggcuuuaagguuaaucuuuaauauuuacuauaauagggcagugcuaaauuacugauuaucuaaaauuggaacacucaagaguuugguuaaaauauuuuaucaguuuaauaaaaauuuuugagauuaugaagaucuuuacacuaucauuucuuuuuuuaacuuuuaugcucaggaguacaugaacauguuuguuauagagguaaacugcauauauggggguuugcugugcagauuauucugucaccaaaguaguacguauaguacccaauagguaguuuuuuuauccucucccuccuccaaucuucacccucaaguaggccccggugucuguugauccccucuuuguguccaugcguucucauugcuuagcucccacuuaugagugagaacauguaguauuugguuuucuguuccuacauuaguuugcuuagaauaaauggaugaaucuggaggccaucauccuacgcuauuguuucuaugaauauuaagauagauuaaacagugugacuuaaugguaaaugacuaaauauucacauuucaguguaaaugucauucuucagagggcccuuuucugacucuauuccucuauccuuaguuuuuacucauagcacuuaucauauacauacacacacacacacacacacacacacgucucauauauguacguguguguacugcaaaacuaauguuuuucuagaugucaaaaacacuucuagcuuuuuguaauacuuagaucaaauuuaaaacgguaaaagggcaguaaaggguuacagaaugacagcauauaacucuccauuuaaagacaguugaaaauguucaaaaaucaguuaucaacaauaaguacauaaaaggaacaugcaaauauaaugaauuaucuuacuucgccuugggcuaaacuuguucuuggauuaucugcuauacaauuaaggaaagguaagaauucuauuuacuuaaggaauauagauaaugauucuagaaugccaacucaguuugggccuuaggaauagaaaaauaugcauaccauacacuguuuuaaaagaagauaacagcuaaaaauacucccaaacuagauguucuaguaugagucuuuacuuguaaaaaugguguuauagugugguuuucucagcacuugcaguaagaaacucuuugcauacaauuucaccuuauagucaagcuacucuaauauaaaaggacuuauuagaguggcaauccacuguuuauguuuuugaaauauucuuaaaacaauuuuuuguuaauaauugcaaaauauuaaagaaaaggcuaaauauuguuuuuaaaugacuaaaugacuuuccuuuagguaaauaagcaaaacauacacguagaacaaaucaaguauugugaagaauaaaaucuaggauuuauugggaaacuaagauuauuccacguaauguugcuuuugucagucuuucugaaauaucaaacagagauaaagacagauuuauuucuucauaacauuuucagcaacgaugacuauaaauaaaaacuacuguaaaaaaagugaacucauuaaguggcauguaagcaaauauucuguuauuuuccccacaauaauuaagccaugacaaauacccaacacacucuaggacauguaagcuaaucauacagaaugaggaauaaccaguguuuaaaacuuaaacuuuuuucauuagagacaauguuguuauuugcauaaaacacaaaguaaaauacaaaaauuagccaggcgugguggugugcaccuguaaucccagcuacuugggaggcugaggcagaagaaucgcuugaaccugggagguggagguugcaaugagcuaagaucaugccacugcacuccagcccaggugacagagcaagaugccaugucaaacaaacaaacaaacaaacaaaaccaugaagugauuguacaaaacacugacagagcacugaauuaaaauuucaaucaugcuauagguuuuuuauacaaacacuuaaaauuuuuaauccuuggccaagugugguggcucacgacuguaaucucagcaauuugggaggccaaggcaggcggaucaccugagguugggaguucaagaccgccugaucaacauggagaaaccccgucucuacuaaaaauauaaaauuagcugggugugguggugcaugcuguaaucccagcuacucgggaggcugccgcaggagaaucgcuugaacccaggaggcagagacugcagugagccaagauugugccauugcacuccagccugggccaacaagagagaaacucugucuuaaaaaaaaaaauuaauccuugauguguucaaaucugaggcugauucuuuucuuuugauaguaugaauagugaaacacacaaacuagaaaaaaagaaauguaccaaagauuuuccuccauucaaaaauaccauaagaaagacaauauuaguuuauuaugacacuugagguguaaaaugucagagaagaaugcucuagagcuugguucuuguaccaaaaacaaccaguaaacuggaaaaacaacaagaaucaacuaucuuccaaguauggaaccuaauuagacacuaaaaacaaccaggaaagugcuucaugcagaggcugcugaucuugacucacaugggcaaaccaguagcuaccauuccccauuucucagcuuugccacaacaguaaggaauagcagcccccaucucuggagcgacuuauuagugccauagcaggcagugggagaauuuuguccuccaaaaauucaaguuugaauauuuuggucaguuuggcagaucacugagagacaggcacagaggcagaugcuugccuuuauuuaggcccucuggggcuaccgggcaggggaggcgcaccugcaucuacuggaagaucuaauaagacagcaccuucuucuuuaaaccagauauuguuauaucauugucaggucacugacuuacuacagagauaauguaauagaaacuucagugacuauacacacaagaaauacacaguuugcaaaaaugguuuuggaaagucacaaagggaugacaacagccuucaacuagccaagaaaggccugaugagugggagaaucugauaaccacaguuaccacauuguacuacaguggcuaggucucaacaaauaaccacaaagcacacaaacaggaaagcauggcccauuaagaaaaaaagcauuugacagaaaccugaagcagcacagaauuuggaauugcuagucaaaaauguuaaaucaacuguccuaaauauacucaaagagcugaaggaaaucaggaaaacaauguaugagcaaaacaagaauaucaguaaagagacugaaauuauaaaauggaaucaaacaaaaauuccaaagcuaaaaauuacaauaacuacaauuuaaaaauucacuagagugguucaacagauuugaacaggcagaaaaaaugauuagcaaauuugaagacaaggcaauuaaaauuauccagucuuagggauacaaagaaaaaagaaugaagaaaaaugaauagagccugaugaaccuaccggacagggacacuaucaaguguacccaccuacacagcauaggagcccccaaagauaaaagaaagggggaaauauuugaagaaauaacggugaaaagcuucucaaagcugaugaaagacaugaauacauacauccaaaaauuucaaauaaauccaagaauaaauucaaaggagauacaauauucagacacauuauauccaaaguguagaaacccaaagacaaauaaaguaucuugaaagcagcaagagaaaagcaacuagacauauacaugggcucuucaguaagauuaacagcugaugugucaucauaaacugugaugaccaggcagcaauaggaacggcauauuuuaaauccagagagaaaacaaaaagucaaccaagaauuuuauauucagcaaaacuauccuuuaagaaugaaggagaaauuuccagauaaaagccaaggaaguauguuaccaguagaccuacucuacaagaaagauaaagggaaaccuucaggcuauaaugaaaggacguaagacauaacacugguaaagguaauuacacagguaauuauaaaagagaguauuaacgcacuuuugguuuuuaacuuuuugcuuuucuuguuuuuuuaauuauuuuauuguuguuguuuuugaaguucugggguauaugugcaagaugagcaggcuuguuacauagguaaacaugugccaugguggugugcugcacuuaacccaucaccuagguauuaaggccaacaugcauuagcucuuuucccuaaugcucucccuaccccugcccuccuccgacaggccucaguuaaguguuguuucccucccuguuuccauauguucucacuguucaccucccacuuauaagucagaacaugagguguuugguuuucuguuucuguguuaguuugcugagcauaaugguuuccagccuuaaccaugucccugcaaaggacaugaucucauuccuuuuuguggcugaauaguauuccaugguguccauguaccacaucuucuuuauccagucuaucaaugaugggcauuuggguugauuccaugucuuugcuguugugaauagugcugcaaugaacauacacaugcauguaucuuuguaacagaaugauuuauauuccuuuggguauauacccaguaaugggauugcuggucaaaugguauuucugguucuaaaucuuugaggaaucgccacacugucuuccacaaugguugaacuaauuuacauucccaccaacaguguaaaagcaucccuauuucuccgcaaccuugccaguaucuguuguuucuugacauuuuaguaaucgccauucgacuggugugagauguuaucucauugugauuuugauuugcauuuaucuuaaaagguaaaaaaaauuauaaaucugcugcugggcacauaaaauauaaaaagguaaucugugacaauaacaauauaaaagggaagagacagagauauacaggagcagacuauuuauauacuacuaaguugguauuauucaaaugagguuacuaucauuuuaagauguuaacuauaauccucaagguaaccacuaaaaaacuaacuauaaaauauuacagaaaagaaaaaaaacaaaggaauuagaaugguaugcuauuuuaaaaauuagcaaagugcaauaaaagggcaaaaauaaaaaaauuaaggaguuagaaacaaauaagacauacagaaaacaauagcuaacuagaaaaauuaguucuuccuuaucaguauuuuaaauguaaaugaauuaaacucuucaauuaaaaggcagagauugucagacuggauuuuuuaaaaacccaauccaccuaaaugcugucuauaagagaccgggugcaguggcucauaccuguaaucccaggacuuugggaaguggguggaucgugugaggucaggaguucaagaccagccuggccaacauggugaaaucccauuucuacuaaaaacacaaaaauuggccaggugcaguggcucacgccuguaaucccagcacuuuggaaggcggaggcgggcagaucacaaggucaggagaucaagaccagccuggccaacauggugaaaccccaucucuacuaaaaauacuaaaaaacagccgggcaugguggcacacgccuguagucccagcuacucgggaggccgaggcaggagaaucacuugaaccugggagguggagguugcaguaagcugagaucaugccacugcacuccagccugggugacagagugagacucuaucucaaaaaauaaauaaauaaauaaauaaaauuagccaggcguaguggcgugcaccuauaaucccagcuauucaggaggcugaggcaggaaaacugcuugaauccgagaagcgcagcuugcagugagccaagauuccaccacugcacuccagccugggcaacaagagcaaaacuccacuaaaaaaaaggccgggcaugguggcucacgccuguaauccuagcacuuuuggagggcaacacaaguggaucaugagaucaagagaucaagaccauccuggccaacauggugaaacuccaucucuacuaaauauacaaaaauuagcugggcaugguggcaggugccuguagucccagcuacucaggaggcugaagcagaagaaucacuugaacccaagaggcagagguugcagugagccgagaucacaccaccgcacuccagccuggugagggagggagacucugucucaaaaaaaaaaaagagagagaagcacuuuggauacaaagacacuaagaaacugaaagugaaaggauaggaaaaaauauuccaugcaaauaguaaccaaaaaagagcaaguguagcuauguuuuugucagacaaaacagaguaugauaacaagacacgaaggccaucauauauuauaagggguucgauacauuaagcuauaucaauuauaaacguuuacacaccuaaaaacagagacuaaaaauauauuaagcaaaaacagaauugaaaggagaaacagacaacucuacaauaauagauggagacuucaauauccuauuuuaaguacuggacagaagaaccagacagauuuauaaagaaauacaggacguggcugggugugguggcucaugccuguaaucccaacacuuuaggaggcagaggcgggcagaucaccugaggucaggaguuucaaaccagccuggccaacauggugagaacucgucuuuacuaaaaauacaaaagaagcuagccaggugugguggugcaugccgguaaucccagcuacucaggaagcugagacaggagaauugcuugaaguugggaggcagaguugaagugagccaggaucacacuccagccuggacgacagagugagacucugucucacagaaaggggaagggaagggaggggaggggaggggaagggaggggaagggaggggaagggaggggaagggaggggaggggaggggaggggaaggggaggaaagaaauauaggacuugaacagcacuauauaccuauuguauuagaccuaucagauauacauaguacacuccaccuaacaagcagaauacacacucuucaagcgcauauggaacauucuccaggacaggccauaaggcaggccauaaaacaagucuuaauaaacuuuaaaaaacuaaaaucauaaaaagcucuuuuccaaucaaaauggaaugaaacuaaaaaucagaaacagaaggaaaaccggaaaauuugugcauauguggaaauuaagcaacauauucucaaacaagcaacugaucaaagaagaaaccacaagagauauaaaaaagacccucaugcaaaugaaaacaaaaacacaacauacauaagcauaugagauguagcuaaagaaguguaaagaggauguuuauagcuauaaaagcuuacauuaaaagagcucaauaaccuaacgguacacuuuauagaauuagaaaaagaacaucaaacaaaacucaaagcuagcagaaagaagaaaauaauaaaguccaaauuggagauaaacaaaauagagaauagaaaaagaauagagaaaaaacaaaacagaaaguugguucuuuaaaagaucaacaaaauaggcugggcacagggaggcugacguggguggaccaccugaggucaggaguuugagaccagccuagccaacauggugaaaccccaucucuacuaaaauacaaaaauuagcuggacgucaaggcaaguaccuguaaucucagcuacuugggaggcugaggcaggagaacugcuucaaccugggagguggagguugcagcgagccgaggucgugccacugcacugcagccugggcaacacagcgagacucugucucaaaaaaaaaaaaaaaaaaacaaaaaagaaaaaaaaaaucaacaaaauaaauuuuuagcuagacugacuaacaagaagagauuacacucaaaugacuaaaaucagaaaguggaaacaucacuaccaauuauacagaaauaaaacggauuauaaaagaaugcuaugaacaauuauaugcuaacaaauuggauagcuuaaugaaauagacaaacucuuacaaacacacaaaccagcaaaacucacaagaagaaagagacaaccaaaauauaccuaagaagugagcugacaaucaguauaaaacacuuccaaccaaaaaagcccaggaccagaugacuuuacugguaaagucuaccaaacauuuaaagaugaauuaacaaccuauuccuaaacaacugaagaggggguaacacuucuugacuucuauaaggccaacauuacccugacaccaaagccaaacaaagacaucguaagaaaagaaaauuuuacaagucaguauccuuuauaaauauagaugcaaaaauccuuaagaaaauacuaacaaauugaauucggcagcuuauuaaaaagauuauaccaaauggguauauaaugaaccaggauuugucucaagaaugcgacggugguucaacauaagaaaaucaauuaauguagccaggcgcaguggcucacgcccauaaucucagaacuuugggaggcuaaggcagguagaucaccugaggucaggcguuggagaccagccuggacaacauggugaaaccccgucucuacuaaaaauacaaaauuagccgggcaugguggcgcaugccuguaaucccagcuacuuaggagguugaggcgggagaaucgcuuaaacccaggagggggagguugcaaugagccgagauugggccauugcacuccagucugggcaacaagagcaaaacccugucucaaaaaaaaagaaaaucaacuaauguaauacaucacauuagcaaaaugaagauaaaccacaugaacuucucaauugauuuagcaaaaaaaaaaaaaaaaaggauuuuacaaaauucaacacccuuucaugauaaaaucacucaauaaacaaaagagaaaggaauuuccucaacaugaaaaggccauauauaaaaacucacagcuaauaucguauucaauggugaaagacugaaagcuuuucucuuaagauaaaaaacaagacaaagaugccugcuuucaccacuucuauucaauaccgugcuggaaguucuagucagaacaauuaggcaagaaaaagaaauauaaggcagccaaauaggaaaugaaaaaauaaaacuaucccuauuuagagaugacaugaucuuauaugaagaaaaccuuaaagaauccacaaauaaaaccccauuagagcuaauaaacuaauuuccuuaagauguagaaagaaaacugccaugaugaaaucaguuguauuucuauagguuagcaaugaacuauaugaaagggaaauuuuaaaaagaauccauuuagaauagcaucaaaaacaguaaaauacuuaggaauaaauuuaaccaaugcagugauagacuuauaugcugaaaauuacaaaauauuguugaauaaaauuaaagaaaccuaaauaaaugaaaguauaucccauagucauggauuggaagacuuaauaugaugucaacauuauccaaaugaucuacagguuuaaugcaaucucuaucaaaauuucaauggugcucuuuugcagaaaaagaacauggucuaaaauuuguuccgguuuacagugagcuaugauuaugccacugcacuccagccugggugauagugggauccugucucaaauuuaaaaaaaaaaaaaaagcaagacaacgacgauaucuuaaaauuuauauggaauuccaaggaaccuugaauaguuuugaacuagaagaacaaagguggaggucuuauguguccccauuucaagaccuaauaaaaagauaaaaagcuacaauaaucaaaacauuaugguauugacauaagaauagauauauauagaccaacagaauagaauugagaacccaaacacagacucucacaccugauuuuugacaaagguaccaggaccauucaauagggagggagcaguuuauuuagcaaauggugcugggaaaacuggauguuuucaugcaaaagagugaaacuggaccauuaccuuacaccauauacaagaguuaacugaaaaugaaucaaaggccuaaauauaagaguuaaaacuguaaaacucuuagaagaaauauuccugauauuggauuucacaaugauuucuuaaauaugacaccaaaggcacaggcaacaacaaaaaagacccccaaaaacagacauauuggacuuuaaauuuaaaaugauaguaaagagagugaaacaacccacagaauggguuaaaauacuugcaaaucauauaucugacaagaguuuaauauccagaaagaacugcuacaacucaacagcaaaaaacaaacacccaauuuaaaaauggguaaaggucuugaauguacaucgcaccaaagauauaccaauggccuauaagcacauaaaaagaugcucaacauuauuacucauuggagaaaugcaaaccaaaaccacuaugagauaccaccucauacccacuaggauggcuacuaucaaacagaaagcagugucagugaggauguggacaaacuggaacacugaugcaacuguaaaaugguguagccauugugaaaaacugguaguuccucaaaaaacuaaacacagaauaaucauaugacccagcaacucuacuccuagggauauaccaaaaaaaaaaaaacugaaaacagggacucaaacagauacuuguacaccaauguuaauggcagcauuauucacaacagccaaaaggugaaaacaaacugccaaucaacggauaaacaaaauguggcauauacauacgaugccauaaaaacaaaugaaguucugacauaugcuacaacacagaugagccuugagaacauuaugcuaagggaacuaagucagacacaaaaggacaaauauuauaugauucuacuuacaugaaaaagcucuagaaauaguugugaugguuacacaaaauuucaaucuuaauugucguugaacuuuaugcuuaaaaauaacuaaaauggcaaauuuuguuuuguauauuuuaucacaauaaaaacauuuuaacugucguguuagcaggcauuuauaucaguuuuccaucaagccuaaauauggucaauauuucauuugaguggagcuuuacugaaauaauuggcuaaauaauuucaauaugaccuauaccaauuaugcugaacacaacagaauauaucaggauuagcgcuuuaugguuaugauauagacgcucacaaaagacuguuguugcucccagcuuaacaguaagaaugagccagacaaacuauaaaaucauaguuuuuuaaacucagaaagcugaggaugcaaagaaaauaaaucaacuaaauucuagaggaacaagcccuuucuggaaaagaaaacagggcugggaucauggugaaaggagaagugaaccugcaauaggagggggaaaccagccaacuuuuaacagacuuuucaaggggaacacgggggcaagauagauuaaaaucucagaaaucucauucacaaagcaaaucugcacuuucccaauaggaucccuuccaaguauugaagcugaauaagggaaggugaggcgaugggaccacagaaugcugaggacaaggcagaagagcugagagaaaccccuguucaaguggcacacuaaguguaagguggccaaaggaagguggcaggguauuaguucagugcucucuccagagguaaggaccgaagccagaaguggggcuagagagagagaaaaaaaaaaaacaugucccagcugcuccaaaugccaacagcugugcugugaaacagagagggaucucccacaguacaacaaacugggcuauaaaggcuggggugggcuauaaaggauggcgagauugccugaaucucacagguacucagauggcaaacucuaauaaagggaguguccucauccugccuucacaacaucugauaccagugguaaacuaaagacaacuaaaacugcaacaaggucccaucccaaacugaacugacucagccccuaacacuagugaccugacagaauacuucagucuguacuguccuuuuucacaaugucugacagcaaauaaaaaaucagagaccaagaaacagaaaaaugugacccauaaucaagagcaaagauguaauaugaagucuuucagugacaacauuucaaauuauggcuauuuugcuacucaaauagaugacaauuuuuuaaaguauuagaguuuaugaaauaguuuaauuggaucagacacagguuuuugguaauaaauacuguuuguuuuuccauauaaagguauuaaaagugguguacagaauucauacaacauagaaaccaccugucccacuacuauuaauaguuuggucaaaucuggaaagcuaaaucaaauaaaguagaaaaacuauaaaauuuugcagagacuucauauacuaauaaguauuacugacacuccaaauauauuuggccauguaauaucaaugacacuuuuaacacuuuacaaaaccuaauguuccaaaaaacauauauaaauacauucacaugaauuccaucaggccauacaugcuguuucauaggcuguuuucccaugaaguauuacauuucagcuacuuccccucaacuauuucauggagauccauuuauauaaauaaauguagcuauacgucaucuuucuaaauggauguuuacuauuccauuguauggcuauacuauguagcagaaaugucuuaugcuuuggguuucaucacacagacauuaagacagacauggugagauuuaauaaaauuaauacauuuuacuucuucaucaagaacauucuuaagugaaacuguuucuguuucuuucccuguaugugugaaguaaagaaugccacugccauuauuuugaaauaaggagccagaaguuuuacacacacugcauauguaccaccagagcaaaugucaacagaguuuaaaagguggcgggggggggcgcggguacaaauauuuuaguauuaugaaaaauuaaguuuugaccuugugggcuuucugaaagggucucaggaucacaaaucacacugugagauuugcuagguuaguuucccaagcugaauuucaauuaaccuaucuuagcaaacagaacauuaauaauucaauaagaaagguaauaacuaguaauaauaguaaccauaaucaaaauuacuaauugcugagcacaggaaguaaguuugggggaaaaaaguaaauuaaggauugaaccuauuggaacaaauuuaaucuagaacucagaaaaaaagucaauguuuaaagugugagucugagagcugcacuuauauaaaaccaacugaagccagaaaggguauguguaauaagagggaaggucagaaacuugacgaauacuuaaaguuaacaaguagacaagggcaaaguguaaucaacccaguuccaaacagaauggauagagacaucaauucugacaagugaagaaacauuagagacaaccugggccaagcaauuuauuuuaugauuaaagaaacagagccugaagaggcucaaaaaagugaagugaucuggccaagucucugaaagugagagagucaggucuuaaaauuucaccuuagggaucccaacucaauuuucuuuccacaguagcaaauuuccagaguuaggaagcaacucucuuaccugcuaacuacugaagaauuaaaaucuagcaugagacagauuucagcaagaaaauagcacguguaucucuacuccuucaaacucugcuccucuugcagucuucaccauggcaguaaauggaugguaacuauagucuaacauuugcucugucuuuccuuuucucacauuccacaaucaaugcaucaccaaagccuucaaaauguaucaagucugaucacaugaacugcucaaauccugauccaagcccagccucaucaucucuuugcuuagaauuuaauguuuagagcauccaacugggcaugguggcucacaucuguaaucccagugacucgagaggcugaggcgggagagcuguuugaggccaagaguuccaagaccagccuuggcaacauagugagaccccuccucuuaggaaaaaaaauuaaaaauuagccaggcaggguggcacaugucugaaguuccagcuacucaggaggcugagacaggaggauuacuugagcccagaaguuugagacugcaaugagcugugaucucaucacugcacuccagccugggaaucagagugagaccccaacucuuaagaaaaaaauuucgagcauccuaacucgucuuacugcucccaccgcaacaccucugcccucccugccccacugcccauaguguauuucuauacagcagccagagcaaacauauuaaaucauaaauaacauaaucacucuucuucaaaacccuacaaugacuggcacuuacuaaacuguuaaacucaaaguucuuaaaugguuuaugagguccugauaagccucauaaauggccugcccaucuccuuuuuaaccucguuuucugccauucugcuccuacccauuccacuauagcagcugucucuuuuuuugcacuugcccuuccucugcuuggaaugcauuuucuccagauguuaauggcucauuuccuuauuuccuuuuagguucuacucaaauaucacuucccuggucaccuuguacaaaacagugagaacucuacacgcagcuaacacucuauuccccuuaacugcuuuaauuuucuccacagucuugcugucuaacauucuacauuggguuuuuuuuuuuuuuuuuuuuuuuggagauggagucucacucuguugugcagucuggaguguaauggcacgaucucagcucacugcagccccugccucccggguucaagcgauucuccugccucagccuccagaguagcugggacuacaggcacgcgcuaccauguccaccuaauuuuuucuguauuuuuaguagagacaggguuucaccauguuggcgaggauggucuccgccucuugaccuugugauccgcccaccucagccucccaaagugcugggauuacaggcgugagccaacgugcccggcauauauuggucuauugucgauucccuccacuagaauguggucuccuuaagaacagggaauuaauauauuuugcucauuauuguauccucagcauuuagaacaaauccugacacucaacaggugcucauaaauaccuacagaaugaaggaaugauagcaaauacuaacauaguacuagagauuagucauuuuuuugacuuaggcucugucucccugauugaagucaaucuauuaacuggcaaaguuucugaucacugucucacacaaacugcugugcuuagguuuucuccuauauauuaaaaaguauuauucauucauuucaacaaacauucacacacaggcccuaucauguccccagcaauauaggaggcauuaagggcaaaaagauaaaauauuaacucuguuaauauuacuuagucuugggagguguuauaucauuuucagaaugaaguuauucugcaaaugagugaaacuccaggauaauaacgaugaauguuuucauaauuauuucaaaggccaaaaauucaaauaauagcccacauacucaaagugaacuuuacaugaaaacuguuugagccaugugacaacauauauaaaauuuauuuauuuugagacaggaucucacuuugucacccaggcuggagugcaguaacgggaucauggcucacugaagccucuguugcccaggcucaagcaauccuuuugccucagccccccaagucgcugggacuuacagguaugcaccaucacaccuagcuaauauuuguuuuuguagagauggaguuuugaacuccugaacucaagcaauccucccaccugggccuccuaaagugcuaagauuacaggcaugagccacugugcuaagucuuaaaauuuaauuggcugccuuuauuaagcuuguagagaucaagacauuauaguucacuauauuggaaccccuacaugaaaugauaccagccauuaccuccugaguucaguaagaacuuagacaaaaauaaccaguagcugagaagcuucaaacagguuuauuaagguuguuucucaacaccaucauuuguauaaauaaucccccagaucccucugacuuucacaagauaauauuuuucaacugaaacuuauuuucauuauuuucuuuaaacauauuuuuguauacauugucugcugggcaauaaauuaaaauucaaaauauaaaaucugauuuaaaugucacucggaauguagauacuuccaucaugaauaauaaauugauuugcagaugauaaauccccacagaaagggcauuuguuuuaaacagcuguucaguuucagagaauucagauagugaucuauuagaaaugucaucugaugcuuuugauaauaauggucuuacucagaauagaaccaagagagcaacuguaaccacuugagauagugccucauuuugauauacaaaugguuauauacaaaaggggaaaaagcccauuaaaaggaagcucaggccaggcacuguggcucauggcuauaauuccagcacuuugggaggcugaggcaggagcaucucgaggccaggaguuugagacuagccuaggcaacacagugagacccucaauucuacaaaaaaaauuuaaaaauagccagauguggugucaugugccuguaguccuagcuacuuaggaagcugaggcaggagaaucgcuugagcccaggaguuuaaggcugcagugagcugugacugcacuccaaccugggagacaaagugagacccugucucaaaaaacaaacaaacgaaaacaggagagacgagaaggcaauuauuuuacaucucaguuaugugaugaacacucucggucgugagugugcauauaaguaaugcgucucucaaaguacaacuacagaaagguuauaguagacuacugauaauucugagauucaaauuacccuaccuagccauuugaaaaccaaccuuuuuaacugauaaagcaagcacugagagguuacaccucuggguuguacaugcccuaccuucucugugagagcaauccagcuuauuuuaucuggugaaauguuaacuaguaauaauauuaggccaguaaauucaaauucuuccugagaaagguauccugagauuuuaauccuggguacauauccaagagaaacuguaacacauuuacccaaaaauaugaacagaaauagucacagcaacauguccguaauagcauaauacuagaaacaaccuaaaugucuauuacagaccagauaauagguaacaaauuacgguaauucauagaauagaauguuauuauacagcaguaaaaaugaaugaacuacaaccacaugcaacaaggacaaauauuaguaaugugaucuuuaacaaaaagaagucccagaagacuacauuuaguauuuuuuauaaaaauaaaaacacacaauauauuuacuguuuagguaaacuauauauaaugcuuuuuaaaaauacaaaggauuaaaauaaaguuuaugaugacaguuacaaauuagggagaggcaaggagaaaagcacauaaaaaguuaaguuacugacaauaagaaguuggguuaacagauauuaauuauuuuauugcuguauaacuacauacacacacagauaugcagauuaugcagggaccagugaggaucuugucauaagcccagaacucugugcaaacuuguaaaaaaaaaaaaaaaaaaaaaaaaaaguuuagggaaaaaagaauaaaaacaauagcauaauuaaaaaguaaaaguagauuuuaagacaguaaaauguauacauauauuuauuuaccuguuucuuaguaagugugcaaggucaaauauuuuaauaauaaaaaggauacaggggccgggcacauggcucacaucuguaaucucagcacuuuggaaggcugaggcagguggaucaccugaggucaggaguucgagaccagccuggccaacauggugaaaccccaucucuaguaaaaauacaaaaaaagguagccagguguuguggcacacaccuguaaucccagcuacucaggaggcugaggcaggagaauugcuugagcccaggaggcgaaggcugcagugagcugagaucaagccacugcacuccugccugggugacaagaguugagacucggccuccgugcccgcccccaccccaccccaccccaccccaccccaaaaaagggauauauggcuagagucaaaagagugaauuucuuuuucccagaccugccacuagguaaccguauauucucaacagaugacuuuccaaaacugacuggucagauggcuuuuuuuuuuuuuuccugaaacaaauggccuauauuugacaucauuagguauaaaauuugaugucaucggguaugaaauuuggucucuuuuguaagauguaucacuccauucuuggcuucccuucauuucuuggcccaccaacguaucuaauaccugcuacuauuuggcccacaaauaaagcaccuuacuaaucauuccagcagauucucuucauaauuuauacagauuauuauaaccacuaaggacaaacaugaagauacauacaccaugggagaacaacuguuuuuaucugagauguguuuauuugauaaauguuccuuuaaagaagacauuaauuaauaccaacuguagcagucagauuugacuagguuauaauaacaaagauuuuauucucuuucauguuauacauccacugagcacugacuggaggcucugcuccaagucuucaaggaucuaggcugaaggagcugcuacuauggcaagaggauaaacaguggcaaaguacugucuauacaaacucacucaaaguguccaucugggguauuacacauuacuuuugcucagauuucauuggcuaaaucaggucacauggccaugccuaauuucaaguagguagcaauuccuaucauauucccaagaaaaagaauauagcuaaacaauuuucacaauuucauaacauuuuggcauuuggagacaaacacuauauuaauuagcauacuaugauguauuaaaauucaagaguaaacaaaaauaaacacaauuucuuaaaaagauuuauacuauaaaacucaaagagcagauaaaguuuaaaccaaauccccaucaaaauucugaaagacagaaaacaaauuaucuauaucccuugauaaguacauagaaauuucaaagaaauauuuacuuuuuccucuaaaaaucccuauaaaguaaaccgagacauucaagcuaucuauagucaacaaaucuccacuauaaaggaaauaaagcaggaacagacauaguaauuauagauuuguuuaauuauacuuaggggaagguaaccuacacuaaaagguauuaagacagaaaugacacaagagccuauaacaugcacuaugaugggggaagggaucuggaagugggauuuauacaggccaaggugaccccacuaaauaauggagaggaaagcauacugcaaucaaaauaucuagaagucuuggaaacucucagcaugacccuguauccagcauacguuuagguacuaacgaagaaaguacauugaaggaaacaggguucacucuacaagcguaauggagguggaaggguugacgggaagaggccugaucauuugaaagguaucuugauagauggauuuacauucuucccuggaacaguuuuacaagagcugguaagauaugccagugagaaugaggcauauucaaucucauuaacaacugaacuagaaaaaccuaaucaagccucagguaggugacuucuggaggguaucacauaaucuuugauaccagguuaagauuugguuuaaacaucucauuuucugaagaauuuuagaugccaaaaauuaucaaaauaagaucccucccuucaucagguaauuuuaucaugacucaccuaguuuauaugaauccuguguuaggaacuaaggacagagagacaaaagacaucagcacuggccucaagaugagaaacacuacagaaaagcagacaacaaugcagugugauaaugacguauacccaggcagcucugggaccacagaagacauccaacaggauaccaagaacagggaaaggcucugcacauugcagaggcucaguagcuauuaaugugaucuccuggacuuuggcuggcaaaggccuaguauucugaccaguguauuaggcaggguucagucaagagacagaaacuacaccuguaauuuuaacagacaauuuaauaaaaguugcuaaccaggaaaauuggagaacugaaaaggcaaaaaggaggacagacauguaucacagacauaguaaaugcaaaaagcaacugucaauaccagagcugagaggaacaaagggaagucguaggaacuaugaaaacucagaggcuugaaggagaaacccuaugaaacugggauccagaccuccgaaaagaaaacuacgugucaagagcuuggagcggggaacccugcaaagcuggaacccagauuuuucagagggaggaaauggcuaguugaugcuggcaucucugaggggaugugaugaagaugguuuuaugaguguggaaaaacugcaaacuggaaccauuugccacuccuuuuccuaccagggugaagcuuuguugcuguggagacaugaacaggaagaagaagcaaacaaaaaggagaaaaguccuuugucccuccucuuuuacuuuccuaucuccauugguaccaucuauuggcaaaaucuaacaggaaacuaguuacaaaagagaaauauagucuguaggaucucagcuccaaccucgcaaagcaguuucaauggguaagucugaagcugaaggaaaauagcuuaauaccuguaugauuuuauuucuccauuuuaaauauuuaagguaauauuuugcaaauauuuagaguuacaaaaucuaguuaaacuaggcuguuugaguuuucucaugacuuaugaggaaauuaaauaaucaauaccaaaauaacgguaucuauuuuaauacaccaaacuuugaaagaaugacccuucuguccucuauaauaaaggcaauauacaaaucuuacaaaacggaaucaagaccuuaagaauugggggaaaaaaauuuuucccacauccaugcauaccuagauggaaaauuggcauuuaugugaaaacuugaaacucucacuuauucaaaaaucaucagaagagaagauuaauguggauuagugaaaggacugaauugcuaaaauuuuagaugaaugcuauuucauuacuuucaaauauaaauagcuuuuuucuuuagaccaaaucuucuucuaguaacugauuuugauauuuuuauugccugagauguacuuagucuuucucuguaauaguugacuuuuuauuaauauuuaucuugaaacaaacaggccacauuucaccaaaucuauagaauauagcauuacugaauaaacgaaagaaaaaaugcuggaaauuaaacuaugacuucauguguccuuucauggacuuuuuaaaacuuagucaaauaacuaauaagaugauaagaacauaagauaguuacagcacacuuugauuuuuuuuuucuuuuuuugagacagaguaucacugucacucaggcuggagugcaguggccccacaucggcucacugcaaccucugccuccuggguucaaguaauucuccugccucagccuccugaguagcugguauuacaggcauacaccaccaugccuggcuaauuuuucuauuuuuaguagagacggaguuuuaccacauuggccaggcuggucucaaacuccuggccucaacugacaugcccgccucagccucccaaaaagcuaggauuacagguaugagccaccaugcccagccuccacuuugauuuuuauaaaaucuugguuuugaaaauaacuauauuagaggauucucuaauauccuaucuguaaaacuucaucuguaaaucacccaacaguaaauauuuuaggcuuugugggcuauauacagucucugcuaaauacuuuuaagcaaccuucaaaaauguaaagcaauucuuagcucuagagauguaucuuuggcccuuggcucuaaccacauacaauuuuuuuauuuuggaaagcaagcaguccaaauguagcccacagcaaugaugguauuaaugagaggacaccaaacaucaaagcaguuuuggucuuggaggaauguauuucaccuaucauucugcugguggaguuagggggauggaggguucaauacugacuaaaaugauuucuacaccauaaaucagauguucuagaugugucuucucagcauccaagguacagugaugaaagaagaaagaccucacacauuuauuaagaauucaugagcucuuugaccuuaaaaaaauacuugaagggacaaagauaauuacagaaaugacucacagauauacacucuauauaucuaaucaaaguucauaccacuuccaguuacgaaaguaagaaaacaagucaucaauuagcauuuuaaaauuagaacccccuggccaggcaugcuggcucaugccuguaaucccagcacuuugggaggccgagacgggagggucaccugaggucaggaguucaagaccagccugaccaaaauggugaaaccccgucucuacuaaaaauacaaaaauuagcugggcaugguggugggcgccuguaaucccagcuaacugggaggcugaggcaggagaauugcuugaacccaggaggcagagguugcagugagccgagaugggccacugcacuccagccugggcaacagagcaagacuucgucucaaaaaaaaaaaaaaaaaaaaauuagagcccccugugcagggguuccacagaacucuaguauucuaugaagugcuacuuuuucaagagauugugacuuuaaaaaauaaauauuguugggccaggugugguggcucaugccuguaaucccagcacuuugggaggucaaggcgggcagaucaugaggucaggagaucaagaccauccuagcuaacacagugaaagccugucuguacuaaaaaaaauacaaaaaauuagcuggguaugguggcaugugccuguagucccagcuacucuagaggcugaggcaggagaacugccugaaccugggagguggagguugcugcgagcugagacaugccacugcacuccagcaugggcgacagaacgagacucugucucaaaacaaacaaacacauaaauacuguuuuuugaacuuuacacaucucaaaaugcuagagguucacagugcgagaaggcaaccaaguagccccauuagcaacuucugucuuucagucccuuacagcauaauccucuuuagaauuucacauaaacuggaucacauaaggauauguacucuuauacacguaacuucuuuacuuggcauaagaauucugagauuaaucuauguuguucuguguaucagugguuucuuuauuuuuauugccuaagaguauuccaccacuauauggauaugacacauucucauuugcuuguuaacaaacauuggguuguuuucaguuuuucaauacuguaauuaaauuugcuaugaacauucuuguauaaucauuuuauggacaaaugucuuccuuucuguuggguaaaauaccugaguaaaacugcugagucacauggcagauguauguuuaacuuucuaaagaauuccugguuuuccaaaauggccacaccauuuuguauucccaccagcaauguguuccagcaauccagaucuucaaaaacacagguauuaccuuuuaaauuuuagccacucugaugaacaguauaucaccauaauucuaauuugcauauuccuggugacuaaugucgccaaucaucuuuucauguccuucccccuauccauuucauugaggacuccaaucauacuuauguucaaucauuuggcuguguucuguuugguuuuuggcugcucuguucuuuucccaucguuuucuccuuugugcuuuaaauauauccuccuuacaacaaccacucucagcugaguaccaucaagaaauacggcacauacuacaggaaaucacuuccauaggcuugcucuuuacuugagucccuaaaaacagaaaauauuuuucucuauguuucacaaaugaacuucaacaauuuccuugaaaacaaaauuacugggcugggaauuugguccuaccuuuaguuucaucaagcaccauggaaaagcaauaaaguauauucaaggacucaggaagaccucacaaauaugagacaggaucaagguauauaaaaaaggugcagaacuuggcaaaagcauuacuugguuaccaggaaauuuucagacacugaaguuuugucuguuuauauauaucacaaauagguuugccaaucuaauaauuucugaaugucuauacauuauauuaauauuuucuguacauuuauccauaaaaauuaaagaguuuuaaauuguccuuaaauauauauucaauguuaaauaaaaauaaaauugcuuuuuucucaaagaugagauauuugauaaugguacauuaucuucccuaugccaaucauuaaaauaauuauuccacaaaguugauaauucauucaucaauuuaaaaauaacaugaauaacaucacuauauaccuagcuuuauggaguuuacagagucuuuacauccaucauuuuauuugacucuuaaaacaauucuaugaaguaaaaaagauaaauuuaccauuccuauuauauaaaggagaaaacaaaagcucaaaacuuaagacucacccaagagucacuauuuaguaaacccugauaagacaaaaugcaaauccuguguguuccuucacuaaccucacacaaauaagcugguugauguguagauuaugagggaaacacaaaaugccuuuccuuucaauuuuugugaaauuaagcaauauucuugaauagucagaacccucuugauaaucuguuucaaaagaaaaacuacaccuaaaagcaauuuuagcaauaucaaauuauaugaaaguuaacaaauuucacuuacuaugcuaccaaaauguguuugacaaauuauuuccuaaugaggucaacuuaucugauuuuucucuuacguauuuuuaaacuagguuuauagaagcugggcauggugccaugcaccuaucaucccagcuacuuggggggcugagguggggagacuguuugagccuaggaguucaagaccagcuggacagcauagcaagacccugucucaauuaaaaaaaaguuuuuauuuuuaaaaacuagguuuauaugagcagauaauacuauaaauaguacuucuacaggagaccuauaagcauuccuccuuccuccuuugguaggccugugaaucucucuccuuuggcagaaucaaaagacaaauuccagacucaauuccacaauuaguaaggaaaauuuuucuacugcugguuacauuucaacacuucugagaagagauuucagacaccgggaaggccaaaaagccucuagcaaauaccuuccauugcuauccaccuuuccuagacuggccauguauuuuuaaaugauaucaaguuauuuaaaauuauuaacaaacucuuuuugagaacaguacuggcaaguguuagacauuccaccagagaacuaggcuacauccauuuauuguaugaacacagauguuacccuuccuacacagcaggccauuuuagucacuucuuuuguaagcaguaugacccagucccucauauaagggaaaguaaaauauccaucugaaaaccacucuuaguucuagguauaauaaaucacagccgcuaucauauaucucauacauuacuauaucuaguguaucacaguaucuaggacaaacagacaucaaguaaaaauuaucucugaaaaacaagugaaauuauaagcagcuuaaacagcacugucccaaauuuuuuaaaaaaucaguucguaguaccucaugcuuguuuaaauuguuugacuaaggcuaacacccacaguuugauccuuuuuuauaaaucagucagauuuucaaccagugacauaauauacccauaacucuggacaaucagagguaguaaauauuaauauguuaucaguggucuuauaaggauuuaaccaagauuauagauagcucaauaccaucaauuaucaggaagguacacaaacauaugugacuucuccuaaauaucuggaucuuuuucucuuuuuucugaguagaaagauaucaacuacacaagucaguaaaauuuuaauaguuauaaaacaccuacgcauauuuuaaccuccuuauuuccuuuucuuuccucauuucaugacauuucuaacuaaagaccuuugcucuuacuuauuucacuguaacucaguauguccuccaagucaagcacggagacuucuagcaaaguaguaguucccuuucuuauuaagaaaucuuauggccaugugcgauggcucacgucuguaaucccagcacuuugggaggccgaggcgggcggaucaugaggugaggaguucaagaccagccuggccaauauggugaaaccucgucuguacuaaaaauacaaaaaaauuagcugggugugguggcgcgugccuguagucccagcuacucggcaggcugaggcgggagaaucacuugagccuaggagguggagguugcagugagccgagauuguaccacugcacuucagccugggugacagaaugagacuccaccucaaaaaaaaaaaaaaaaaaaaaaaaaaagaaaucuuauaaaguaaaauaguucucaagucugagguuaauuucuucaauuacuauuuagugcucacauucugagcauuagaauuuguuacuaacagucgaaauaagaaaaugugaauuauacuuaaugaacuagagcagauucagaacuauuauuuaauauuacucucaguuaugaaugggagaaaagaguacaauuacaacuuaagaagugagaacugcucacaauucucagucccucuuaucaauccaguaacuuacaguguuccauaugugagauuaccuauccuggcaugugagucacagcagaagcaaaguugaaaucucuagaaaauaaacuucaguaaaacuuuuauauuaaugagcugggcacaguggcucauuccuauaaucccagcacuuugggaggccaaagcaggaggaucacuugagcccagaguucaagaccagccuggacaacacagcaaguccucaucucuacuuaaaaaaaaaaaaaaaaaucccuuauagugacugguagggauauucagagaauaaugggaggccuaaauuuaccaaaagaaagcaugcauuuaaaaacguauacaucaaaaaacacuggucugccauauaacacagguaagaaaugucacacugcaguaugauauuucaagaaaagggugaguuuacgaacaguccaagucuauuucaucuaggcugcaucuauaugaauggccuaggaaaaguucaauaggaaaaaaaaaagaguguguggaagggaaggaauuauuucucuauucaacacagaacaguagauuaagacuaauguuccuuguauuccaagggaaaacuggaagaugguauucugaaucuaccuaaguuauaaagaaaaucaggagaucacaaucuuuagauguggcuauaucuucccauguauuuuuguggcuagauguuaggaagugacugaacuguucccucuuguucccucuuucaaagguaggaaaugagagguuauccugaggucaggagcuucuaauguggcucuugauuuaaauugugugaacuugcucuacuccaggaugaaagcaaucaugaccagaucaaugugcucugcagcuggccagucagcugcuccagaagaggcagccagcaaaagagcucuggagcccucucugggcaccgugccuccuaaaauuugagcacaggccaaucuuguugccccucauucuuagacggcauuuucaguucccuaauaaguaaaauaaaucuaaguaggaaauauccuccuuuuaauauuccaauuguugaaguguuccacauuuucgucuaauauucacuagaaaaugaaguauuuugacacuuugauaugaaaccauaauacuggcuccagagucugccuuagaagcaucagcugauuccuuggaagaggaaauuuagaaagaagcuacucuaagacggggggggggggggggggcacaaugaauaaggcuggaaaggagcacaacagagucccaaacccuagguaacuacaaagucuucuuuaaagaaacaguuugaauauaaaaugucaugauaguugcuggaagcuacaagugguacuaugaaauugcuguauuauuccaauuuuacuacaaaauccauguuaaaguuugaaaaagggcuucagucccacuacugacuuucaaguuagaauucaaaaaguaggccugugauagguguauucacuaaaaaacaagaaucuggugaaucaacuaacucaggaccaguccacuaaucaaauugguaauucaaacaaucacaaaaaagaaaaaaaaaguauauaucuauauacauaucuuuacaauuauguaccuuaaacauguuaacuuaaaacacucaaaugcacugauuuuuugcugugagaugaaggccuguauucaugaaaggaauucuuuacauaaaccaacacagucucuaccauuucugguugauuucuuuaaaaguaaagaaaaaacuugacaacacuaagaaaaaggaaaaaaacaaauuaaguauuucuuauaaaugaaaauuguguugagcaaucuaucagcccauccaguuauuaauaaugucauagauacaucucauguauauguggugaggauuucuuuuuaaaaaaauguuggcugggcacaguggcucaugccuauaaucccagcacucugggaagccaaggugagcagaucacuugaggucuaaaguuugagacuagccuggacaacacggagaaaccuggucucuacuaaaaacacaaaaauuauccaggcgugauggugcaugccuguaguccuagcuacacuugguggcugaggcaugagaaucguuugaacccgggagguggagguugcagugagccaagauggggccacugggcuccagccugggcgagacucugucucaaaaauaaauaaauaaauaaauaaaauaggucuggcgcgguggcucacgccuguaaucccagcacuuugagaggcugaggugggcggaucacgaggucaggaguucaagaccagccugaccaauauggugaaacuccuuaacuguuucuuuaguuuaagcacaagauuaugaacaccccagggaaggauauuuugcuauuuuuguuuuaaaauccccauuuauuugugaaggaacuggcucuaagaagccgcgaguguaagagcuggacagaaggaaagaacggagggcauuuuaaaaauaaaaaaagucacugcagaguaacaaggaagacacaaaucuuaucagguguuuaggauauucugcaaauuuaaccaaaauguaugugagaaaauuggaacaugugucaggcaauguuuucuuccaaaacuccuacuaacagcaagauuugauuagcaacuguauauugcuuuaauuuauuugguucacaccgaagucuuaugaguugguauuacucuacccauuuuacaaaagaggaaacauuccaaaaugugaauacauuuuccugaaaugauacagcuagcaagccuugccuuuuccaaucaaagccuauggcuccaacuauuuauaguagaaguuaccugcgaguaacuuccacaauggaauuuaaugaguuacuacagcuugacagaaacagccuguaagaauaugcaauucagagcaagaucaaaaguaggauaagcaacccacuucauuuugcucuaaagcagagauucuccaaguauguguggucuggggaaccuuuaugggagcauccugagguaaaaacuauuuuuauaaaauacuaaguuauuugccuuuuuuacacuucucucaccgguguacaauggaguuuuccagagacuacacugaauauuguaauaaacuaaaaggcaaaagcagaugugugaauccggcuguuuucuauuuagcuugaaauuaaagagacuugcaaauauguaaaacaaugcuauucucauauuuuugaaaauaguuuuuuuaagauuuguuaacuucguaauguuuguuauuuuuaaguaaauuacaauuuuuuguaaccuaagguuucuguuuucguaucauuucugaaacguuuaagaguauaaacagguccugagaccaaaaagguugaaaacucacuacccuaaagcuauucucaaccaacccucagaucugaaaucagaucuucuaaauugguuuacuuaccaggaucaagugggcuauguaaauaaaaacuuccuggguuucaucguauuauaaacuccuuaaggaaagaaacauauuuuuaaaaucuuugugucccucccugcccccacugcaucacucauaucccccccuuaaaacacuguuguaucaagccagauuauuucucauuguguauuucuaaauuaacauuauacuuuauccucuaauuagcauaagagauucuacaauaccagauuaucucaaaaugaacugaagaggaaugucacagaacaaagcugaaaagaucagacuucaccacauggugacauaucaugacccacugacguaaagauaucccgugaagcccagcuaauuguucacccuuuaaccaccuccuaacuccaacaauaaaaaauuaaaacagcauuuuaaggggcaucauuuuaauaggaagaacuaaauauauauuuaaauauuuaaaaggccacauuugacagcuacuguaagaaugaaauuucagcagggcacaguggcucaagccuguaaucccaacacuuugggaggcugaggugggcggaucaccugaggucaggaguuggaggccagccugaccaacauaaucucagcuacucaggaggcugaggcagcagaaucacuugaacccagggggcggagacuguggugagccgagaucaggccauugcacuccagccuaggcaacaagagugaaacuccaucucaaaaaaaauaaaaagaaaaagaaugaaauuucauuucccuucaaaaauaacugaauuauuacaugacauauuuuucaaucaugaucaaauaguauuauguauugccucuuauguuuuuaaacugcaaaucucacaaaaucaccuacuuucuaaauauucauguagguuucauuaagaauguucuuagcauacuuggcacaagguaaauaugaauuugcuuaucauguuaaaaagaggggggacggagagagagagacagugugugagugaguguguguuuguguguguguguguguguguguacaacuuucuagucuuucucuccaagaggcaucugaacuggacaaaugcuauuuugucauucuguaauuuaugacaauaauaguuauaacaucuuuuaaaaacuaacacuauuaaagccuuuauaagacaaauucuacuaaguaguggccaacuuuccauggcaacaguagaagacuuggcaacauauuaaaaaugccagcauucuucaaucuucugguaaagguuuucuuugggggaagaagagcugugaaggaaaaaaaucucccucuuauauggccaguuaauuucaaagauauugaaaaggccucaaaauagagucuuccuagggccgaaucaauugaucucaaaacuauaaaacuaccauuaucuucagaaaagcuuuuuuugugauuuggugaggggugggaggcacucuaauccuccaucacauuacuugcuaaguggaaaauuagaaauuguucacauaccaauccuaacaggaagggagcauaacaaugagccaauuuccaagcauacucuaucaucuuuauaagaucuaagguaaaggccaaauuguagauuuucaccaaaacaguaagaaaagguguaccugaauaaucaacugaaaaaaaauacuccacagccacuuuuuuucagagguuuucauuuuuauuugcagaacucucuauucuucuaauuuuacuuauuuaggaaaccucaguauauuauaaauagaaaaaauaaagaaauuaacacaaagugaagaaaaagaggguaaaauaugcauauacauuacaaaugauagccuuuaaaaaauguugaaagauuuccuaugaggauauagaaaagcauuuuaaaacaguaauauuugaauuaaccagaauucugacaaacagaauauuguuugggcuaucugaauuuuccauuaggugaauuaaauggauucuaguuaaccaaaggauggcuuuaugagccuagauucucucuuugcuucauuauugcuuacuaccuauucagucuucucaaaagcuuagagguuaacacaucacuacauuuaauuaacaccuacagugaaauguuaauuaugguacacacaacuuuggcacuagugauaaagaguuuauagcacauaggaaguucacuuucuuuaagagaaacugagaauaaguccuaggguaagccuaaccuagguucaaauccugauuccuucauuuaaacacuagagagacagugagaaguaugacacugagaaaacugcauuuaguuuucucuucagagaaggcaauuaacaggccagcugcgguggcucccaaagugccuguaaucccagcacuuugggaggccuaggcaggcggauaaccugaggucaagaguuggauaucagccuggccaacauggcgaaaccccgucucuacuaaaaauacaaaaaauuagccgggcgugguggcaggcaccuguaauugcagcuacuagggaggcugaggcaggggaaucacuuugaaccugggaggcagagguugcagugagccgagauugcgccauugcaccccagccuaggugacaagagcaaaacuccaucucagaagaaaagagagagagagaaaagaauuaacaauuaccucaauggcugggcacagugacucacgccuguaaucccagcacuuugggaggccaaggcggacagaucacaaggucaggagaucaaaaccagccugaccaagauggugaaacccugucucuacuaaaaauacaaaaauuagcugggcgugguggugugccccuguagucccagcuacuuaggaggcuggggcaggagaaucgcuugaaccugagagguggagguggcagugagccaagaucgcgccauugcacuccacccugggcgacagagcgaagaccacuccacccugggcgacagagcaagacuccgucucaaaaaaacaaaaaacaauuacuccaaaaggaugugagaucuaaaucagaaugcauguauuguaccuagcacacaguaagcauuuaacauauacuauuuuugccacuguauacucccaaauuaugaacaucugauuuauguucuguauauaaaauugcaagcuacauaucacuaacccucuuuccccauuaacagccaaaaugagaaauuaaguaacuuucauggagcaacacggcagccaaauugguaaaauuauuucuaugaaaauauuaucaaauucagauaacuaaucugcaaacacauuuucccacuaggcaauucuuaggugaagaaugucaugaacugaauaguucugugaacagccguuauuuuguacaugcguagaaaaauuguuaaguaaaaauuaaucucuggggccaacaggucauucuucaccuagccuuacaagaacuuuguguucugaccccacuacuuuucagcuccaucuccagagauacacagugagugcuucauugccucaaagaaauuauuuguagcuucuauucccuuaagguguuuugcucaggccucuuaacuuugcacaagcauaucccucuaccaggaacaauuaaccccuuccccuucaucccauucucugaccucuuggcaaauucuuauacuuccuuuauaaauuuagucaaaugccccuucuuccuaagaagcaacaucagagaucucaagacucuguggaaaccaggaaaaggggggaacuaauuuacuucuccacagaaguaaaguaaguucagaugggcugaauaccagucaagcaguaagcuuucaagcaagugaggucaugagaagagcccaucagaaauaaaugaaacaacacaaugcuacagccacuccaaaggcagaaagguacauauacuuggaucuacuguaaugcacaaauauauucuuguccaucccaauccuaauccaccuaagacuuucuccacaucagcaccaguucaucucagcacugcugaacagucacacaacagaacaguuugaucagcgaaccuaaaugggccucaacacuggccaauaaucuuacuauauuucucugcugcacuuggucuccuacucuccccaaugucuacuucaaaccaucuccaccauccacaauuauaugaugacccuuucccuaacccauacagugugccuguguguauacauauguacacaaaaaugaguuaaacauagagcuuucagguagaaauuuccugaacuaaccuacaccaguuaucuucacugcuccuugccuauaauuauaggaguuugaccaguccuucauuauccuaaacacauuuuccuuggcuucucuauaacaauaucuugguuuucuuccaaccucucuggccacuccucugcagauuuauuccaccccuuuaccccacccucagccacacauacacacacaccaguguggccuaaguccuggcacaagcauuuuucuucuauguuuccuccuuaggcaagcucauucuggguggacaacaucuacacacagugacucccaaauuuccaucucugauccuaaccuuuuuuuuuuuuuuuuuuuuugagacagaguuuugcucuuguugccuaggcuggaguacaauggcgcgaucucagcucacugcaaccuccgcauccugggcucagcucacugcaaccuccgcauccuggguucaagugauucuccugccucagccuccugaguagcugggauuacaggcacccaccaccacgccuggguaauuuuuuguauuuuuaguagagaugggguuucacgauguuggcccggcuggucucaaacuccugaccucaggugauccaccugccuuggccucccaaacugcugguauuacagugauccugaccucuuuauuaagcugcagacucaccuauccaacugccuacuugggcaugucugacaccuaauuguuaaagucaggccucauuccccaggggaaaaauugaaagucaaacuauucaccaagagaaugcauugucuuugcaaaugagccuaagaaucagacuuuuuauaaauacauguucaaguuucuugugguucuaaauggacacugagaacugaaacugucuacaccaaguuuacaaucuauauuaacuaucauuauacagcugucuucaacaacaugacuuugcuauuccaggaaacuccugcucaggcagauaagagcuacaaaaaacuucauuguucauuucaggaacuucccaaaaaacccauauaaaccaacaucagacuauucaauuuuucaauaaauaguagcaaaugauuguucacuuucuaagacacugaaaaagcuuaccucaaaacucuuaccuugguaugucuguccaaucaaacuauuauaucaugauccucaccuaauucuaauaaagcuuugaaauacuuaaaccagacuccaaaacaucaauaauaaacacuccaacuuugauguuccuuucugguuugccauucuuaucaacacccacauggcccccuacaaaugcuuauaagcaauauacucaacagauaauuuuuggugguauuuuccagcagccaaaauuccgcaguaccaccagacagcuucccaaaugucuguuacaagcucaguucagugacacuagucucaucacaagcaauguggggaaaauauuaauacuguuauaaaagguuaagauaaaucaucacccuauauuaggcaguauccacugacacuacuggccaguuucuuaaugaguuaaaacagcaaacuggccuacuaauuaaacuucugaagauuauaaaauagaguuuaguaaucagaggaccauaaaaccaguaggaguucuaaggaagaugagaaacagaucacagacagguuuaauaaucuaaaaaggaauccuauaagaaacaggauaaggaaaaaaccaauugauacaugaauaauccacaauacugauaaucaguagaaaaaauacuacaaaauauacaauuuaacagugaaaagaaacucuaaaggaguuuccauuuacuauaauaaucaugaucaguaaucagaaaguugagacuucuuacugagaguaaaugccuaaguauuucuuuuacuauaagucaucugaaucaccuauauggccacaaccaugcugaugcagguauaaccagaaagcaagggguaagcauuuaaaaugccucaaagauugagaggaacugaaggauccaaauuuuaaaauccaaaugugaaaaacacaaccacaaguauuagaagaaaauguggaugaacuuccuuauaaccuuggaauggugaagacuuuucuaaauauauuucaaaauccaaaaacauaaaagaaaaaauuacuucaccauauaaaagucgaaaguuaugcaugaaaaaacauaaucuaaaauauacauauuugcaacccacaucacaaauaaagggcuaaucucccaacagaaaauuccugaaaacaaagaccaaugaccuaagagaaaaauaaaggacaugagaauucaaagaagggaaaaaacguaaaaugccccuuaaacauaugaaaaaauguccaaugucauugauaaugagaaaaauacaauaaccugaguuaaaccaguucucaucuaucaaaugcaaaacucaaaaagucugacaacacauucaguugcugagguuaugggaaacaggccuguugcacauuuaggugguaguacaaaauggcaaucuggcagcaucagaauuacagaagcaguuuuuuuuuuucguuuuuuuuuuuuuuuugagauggagucucgcucugucgcccaggcuggagugcaguggugcgaucucggcucacugcaagcucccccucccggguucacgccauucuccugccucagccucccaaguagcugagacuacaggcgcccgccacuacgcccagcuaauuuuuuguauuuuuaguagagacaggguuucaccguguuagccaggauggucuugaucuccugaccucgugauccgcccaccuuggccucccaaagugcugggauuacaggcgugagccacugcgcccggcccagaagcaguuuuuuaaaagugaacuuuuaguaucguuuuagauuuacagaaaaauaguaaagaguucccuuaaaccacacacucaguuuccgcuaguaagaucuuacauuaguaugguacuuauuggcaggaagucaccucauguagcucacacuugaaagguggggaguuguauuauacuuccuugagggcuguguaucuaauuaugcacagauuugucuauucuucccccauuuauuuauuuagucagucauuuacuucuaucagcaugaacucauggauauuauuuuauacuuuggguuauaauucaauauuacuuuuuuguugcucaaauuauuccaguauuggcuacugggaacucuuucaguuggcugugucccuuugacauaacucauucguguuuuuguuugaauaguuccuuccuuuccagcacuacaagauacuccagguugaucuuacaguuuuauuagcugccccaguccuagaaucagccauuucuccacaaaggccugguuccuuuuacuggagaaugguguuagaaaccaagaucugggcaccaggugugcucacugcuacagggauauuguugcuucuagguucucucagcugacaguggaagaaaauacuugaccuaaagaucuacaauugcuuguucaaauagaaaauguuacauguauauuguuauucauuuggcauuguaacagcaaaaaauagaaaacaacccaaauagccacaaaggauugagugacuaaacuacgguacaucuacauaagaaaauacuaugaagcuauuaaaaauaaagaucuuuaucuagauauggaaagaucuccagaauaaaauacacauuuguuuguaacuacaaaaggaaaacacuggaaggauaaacaggauaccaaaaaguguggaaggaaaauaaaguagcaagcaaaggaagaaauaagacuucguguacaucuuucuacauacuugaguuuuaucuaucccaaaaaaauaaguuuaauuuuaaaaagaacuuaaaaugguuauaauaguggaagaaucugaagguucaaauacuaagaaagaaaaagauauuaauuucugaagcauaaauacauacuaugagacagaguagcucaaaccuagggacaauuauguaccaaaaaaaucuaaauuuaguaaaauggagguauuucaagucaaacucaguugaauuuaaagugcugaaaugcaguacagcugcuaaaauuaacauauuaucagaaccuguauguaaguuuacugaauuacuguuaaauggaaagugauuuaugaucaccuauauuagcagggagauaaaggcuaaagaaaugcagaacaauuuauagaaacaauuaauguuuauauucuugauuauaagauaugcugauauuuauaguuaaacaaaagcaucuaucauuucuauauuuuuuaaaucuaauuuuuuuuuuugagacagggucucaagucugucccccaggcuggagugcagugccaucauagcucacugcaaccucaaauuccugggauuaagcaauccuuccacagguugagcuucuugaguaacuaggacugcaggcacacauuacuaugccuggcuaauuucuuaaacauuuuuuguagagacggggaucucacuauguugcccaggcuggucucaaacuccugggcucaagcaauccuuucaccuuggcuucccaaauuugcaggaauuacagccaucagccaccguguccagaaguaaaucuacuauuuauaucucuuauuuccccaaacaaaauggugaaaccaauuucuaacauaucgaaacauuuccucaucggaagauaaaaauggcagaguuucuaaauuaaacacacauuuccaagugcuccuaagagacaguaaaacaauucucccugggcgcuguagcuaacaucuuuaaucccagcacuuugaaaggccaaggcaggaggaucgcuugagccaaggaguuugaaaccagccugggcaacacagugagaccccaucucuacaaaaaauacaaaaauuagcugugcaugguggcacacaccuguagucccagcuacuauggaggcugaggugggaggaucaccugaacccaggagguugagccugcagugagccaugauagcaccaaugcacccuagccugagagacagaggcagacucugucccccgaccaaaaaaaaaacaaaaaaaaaacccaaaaaagaaaaaccaguaauucucaugucucugaggugaaccaaaaaauuacccaaaaaaggcacaaguagcucuuuuuagcugguuuuuuuuuuuuuuuuugagacaaagucuucccuguugcccaggcuagagugcaauggugcgaucucagcucacugcaaccuccgccuccuggguucauauaauucucugccucagccucccgaguagcugggauuacaggcgcccaagcauccaccaccacgcccggcuaauuuuuguauuuuuaguagagagacgggguuucgccaucuuggccagacuggucuugaacuccugaccucgugauccacccgccucagccuccuaaagugcugggauuacaggcgugagacacugugcccggccauuuuuuagcauuuucaauauuguaaagcaacccuuugagaguacuucugaagcaccaacaucacaaaagguuguccauuuaacuugcagaaguucaucuguaauuguacacaacuuucccaauggcuucacuauagaaaacaaugauauucugccuaaaaaguguucaacagccuccuuacuggaauaucucccucuuugaccucauuuccugccacuaccucuaugagcaaccuuuaucucuauuucuaucacauggaaauacucauuaggcugguagagaauaacauuuuuaaaggaauauaaauuuuuuucauaucccuuuuuuacauguucuuuuauccuaccuaggaagugguucucuucucucaucucucuauuuguaaagcuaauuaccuuuagugucaguucaucugagacaucuacuuaauacccucagcuaaaugucacucuuuccucgucauguuaauccuaaauucaucuuuaaccauaaguucaucuuugguaauaacacaaauaaacuaauacacucuaucauaaaccacauaaccuuuuaucaagaugcucucuaagccuucugaggacauuccaagacaguauacaguccuauggucuccuuggaaauccauauagauaacauuucaagggcgauaccuuguugguuuugacuggauauucauauaaacuuuucaaagagaugagugauacaacuaacccuuaucuguaaguuuugaguuuacauuguuucaucccauguacaaaaccauuuuuuccuacaaaaaaaaaaaaaaaagaugcucuuuacaguguacaaccuagacaacggguaacaggaagucuauuucaauuacggaggcaacucuuauagauauacugacauaccuacaguucaaauuuuauagcagggagaccaguuuugaagaaaaaaauagagacuucuagugagcugaaaggaucauccgcaauuuuccucccauaaacucuacuacuguccauagaucuacauuuuuuugccugccauuuacuaaaguagaauuaaaaauacauauauaagaauaucaaaauuauuagaaaaaaauuaaguguuuugccacacuagauauuaaaauauauuacaaagcauugaaaaauaagcuggaaugaauauaaaaagagauggaucaccaaaacaacuuaucuaguuuuuuuuauuauauaacaacuugauaaaaaccaaauaucagaaaaaauuaaaaaaagaagaugccaggauucagggagcagucaaagucuccuccuuagcaauccguggggauaaugggggugggaggaggaccaacaucccagaaaucaaagaaaugcaaauauaauuauauuuuucuaaaaccaaugaucaaaagcaaacauuuuagauaauuauaucacuaaaaacagauguggcacauuauucgugguacugguacaacagagauaucagaaaaggguucacagacuuugguuugggaauuccacuucuagacaucuaucuacccuaaggaaaugcaaaauggugugggcgggugggaaagggauaucgcauguucaaguuugucacagcaccgauuuaaaauagugaaaacauaaauacaaaagauauucagccuacuaucaacaccucuaugcacacaaauuagaaaaucuagaagaaaaggauaaauuccuggaaacacacaaccucccaagauuaaaccaggaaggaagugaaaaccugaacagacaaauaacaaguuccaaaacugaaucaguaauuaaaaaaaaaaaaaaaaauccuaccaaccaaaaaaaguccaggaccagauggauucacagccgaauucuaccaaacguauaaagaaaaauugguaccaauccuacugaaacuauuccaaaauaucaaggaggguuuccucccuaacucauucuagggagccagcaucagccugauaccaaaaucuggcagagauacaaugaaaaaagaaaacuucagaacaauauccccgaugaacauagacacaaaaauccucaacaaaauacuagcaaauggaauccagcagcacaucaaaauguuaauucaccauaauuaaguaagcuuuguuccuggggugcaagguugcuucaacacaugaaaacaauaaaugugauucaccacuaaaacagaauuaaaaacaaaaagcauaucaucuucucaacagacagagaaaaagcuuucgauaaaacccagcaucccuucaugaaugggcaaaaguugcaacaauucccuugagaacuggaacaagacaaagaugcccacucucaccacuccuauucaacauaguacuugaaaguccuagccagagcaaucaggcaagaaaaaaaaaucaaaggcaucugaauagagaaagaagacaucaaauuaucucucugcagauacaauuauguaucuagaaaacucuaaagacucugccaaaaggcuccuagaacuguaaacgacuucaguaaagguucaggauacaaaaucaaugaauaaaaaucaguagcauuucuauauuacaacauucuagcugagagcaaaauuaaaaacacaaucuuauuuacaauagccccccaaaaaaugaagugccuaguauuacaucuaaccaagaaggugaaagaucucuagaauaacaacuacaaaacacugcugaaagaaaucagugaugacacaaacaaauguaaaaacauuccauggucauuaauuagaagaaucaauaucauuaaaauauccauagugccaaaagcaauauacggauucaaugcuauuccuaucaaacuaucaauguaauucuucacaaaauuagaagaaaaaaaaaaaaaacucuucuaagauucauacagaaccaaaaagcccaaauagccaaagcaacccuaagcagaaagaacaaagccagaggaaucauacuacccgacuuaaaacuaaacuguagggcuaaaguaagcaacacagcaugguacugauacaaaaacagacacacagaccaauggaacagaauggagaaucuagaaauaaaguugcacaaccacaaccgucugaucgucugaucaacaaaguugccaaaaauaaacaacgggagaaggacucucuauucaauaaaucauguugggauaacuggauaggcauacacagaagaaugaaagugggccccuacuuuuuguccuauacaaaaauuaacucaagaugaauuaaagacauuagacuauaaaauccuagaagaaaacccaggaaacacucuuccagacaucagcauuggcaaagaauuuauggcuaaguccccaaaaacaauugcaaagaaaacaaaaauugacaagcaggacguaaugaaacuaaagagcuucugcauggcaaaagaaauuaucaagaguauacagacagccuucagaaugggagaaaagauuugcaaacuaugcauccaacaaaggacuaauauucagaauccauacggaacuuaaauccacaagaaaaaaaaaaucccauuaagaaguagacaaaggacaugaacagacauuucucaaaagaagacauauaagcagccaacaaacacaugaaaaaaauguucaacauuacuaaucaugagauaaaagcaaugaaaaccacaacaaaauaccaucucacaccagucagaauggcuauuauuaaaaagucaaaaaauaacagauguuggcaagacugcagagaaaagggaaagcuuacacauugcugguaggaauauaaguuaaguuagguuagccacuguggaaagcaguuggagauuucucaaagagcuaaaaacugaacuaccauucaauucaauaaucccauuacuggguauauacccaaaggaaaacaaaucauuuuaucaaaaagacucauguauucauagguuuauggcggcacuauucacaauagcaaagacauggaaucaaccuaggugcccacugauggugaacuggauaaagaaaacaugguauauacacaccauggaguacuguauagccauaaaaaaagaaugagaccuuguucuuugcagcaacauggaugcagcuggagaccauuauccucagugaauuacugcaagaacagaaaaccaaauacuguacguucucacuuauauuugggagcuaaacauugagcacacauggacguaagauaggaacagcugagcaggguggcuaaugccuguaaugccagcacuugggaggcugaggcaagaggacugcuugagcccaggaguucaagaccagccugggcaacauagaccuuguaucuacaaaaaaucaaaguuagccagguguggugguacaugcccauggucccagcuacguggaaggcugaggugggaaaaucacuugagcccagaaggucaaggcugcagugagccaugaucaugccacugccuuccagucagggugaaagcaagacccuuucucaagggaaaaaaaaaaaaaaaaaaaagccaggugcaguggcucacaccuguaaugccauaacuuugggaggccuaggcgggcagaucauaaggucaggaguugaagaccagccuggccaacauggcaaaaccccgucucuacuaaaaauacaaaaauuagccaggcgugguggugggcaccuguagucccagcuacucaggaggcugaggcaggagaguugcuugaacccgggaggcggagagguugcagugggccaagauugcgccacugcacuccagccugggcgacagagugagacucugucucaaaaaacaaaaaaagauguuaacaacagacacuggagaugacuagaagggguuggcaaaugggggcaugggcugaaaaacuaccuaucacauacuaugcucacuaccagagugacaggcucauccauaccccagaccucagcaucacgcaauauacccauguaacgaaccugcacuuguaugcccugaaucaaaaauaaaaguugaaauuauuuuuaaaacaaaauaaugaaaaaugagaaguaauaauuaucaaacaacaugaaaugguuaagcaucuuuugcaaacacuaaaaguaacagccacaauuauuugguaccuuaaaaaaaacauaaaaaggaucuuaaacaaaaauacaaaacauauuggagaaaagccaagauaauauuugaaaauaguaaccacuguguuagagaacguacauuguacauuuuuuauaugauuauacauucucacauuuuaaaaauaauuuucuaaaacuaauaacugagaccauacagauaggaaacaguaucacugauaagaaacaagcuaaaagagucagacaaaaacauccacuaaaggaaaaaacauaaaauaauugaaacaaaagacaauuauacauaaaauuaagaaaacugccaacucccgguaaaacuaaaacgcuccaaguagaacaaaaaaaaagggagggaaaaauaagauggaacgacaggaagguuucuugguuuuugcuuuguuuugagauagggucucuaacucugucacgcuggcuggggagcagcggcacaaucacagcucacugcagacuuuaccuuccagaggaguagccaggacuacaggcaugugccaccacagcuggccaauuuuuuaaaacacuuuuuaaagagauggcauuuugccauguugcccaggcuugucuuaaacaccugggcucaggugaucugcccaccucagccucccaaagugcugggauuacagacgugagccacugcacccagguagaaaguuuuaaucacuuugccuucacuucaaaaaauuuccacauuuauguucguuaaaaacugacauacuggccagacacagaggcacaugccugcaaucucggcacuuugggaggccaaggugggaggaucacuugagcccagaaguuugagaccagccugcaaaauauagugaaaccucaucucuacucuccacaaaaaucuuuaaaaaauuagccaagcauggcggcggcaccuguaagucccagcuacucaggaggcuuaagugggaggaucucucgaguccaugaggcggagguugcagugagcugagaucacgccacugcauuccagccugggagacagaaagaggccuugucucaaaaugaaaaacaaaacaacaacaaaaaaacugacauauuacauggacauacugcauaaugguaaauuuuuugauagaaaaaaauuuaaaaauaaaaauugacauaagcgaagaaaaccuauacagaaaauaucucaaaucacauauuaccuugaaacaguaaucuuaagagacauuaccaccaggacccccucucccucugccauggccauguacucuuccucuaccucuucuucugcauuggccucuuccugcaacaaacagcuucccuuuucuuagguuuuuacuuuaggcucaacauccacaaguaguguauccagagguaaacugucugguagaguaaaauaucuaauguuacuuccucaaauuuguguuuccaacuguacagguucucugucuucagggucauuuucacgcuuuaagauguguaucacggugacauccacaccugugacuguuccauagaccuguguuccacuuuucaauucaagguuacaguuucaugaaccauuucaucaaaaaucucaugagcuucauccuagcagugccgucauuccuuggguccaauagcacacagcauccagcaaccaaggaccgaccaacccacuagaaguaugaaucuacuuuaaauuuaauguaugagugguuccuucccuuaacacugugcuaaacccuagaacaguguuucuaaaacuccaggaucuaucaagaauugucugaaacauuaaaaacccaaacccagagauucucauucagaaacagaguuugagauuacacaguuacaagcaugccuuuagauuuuuucuuauuuuagucaacaagaaugauucugaaguugagguuaaagccauuacucuggaauaauauauaauaguaaacaauaauauaauacuaagcauccaggcagauuuuaugacaaagaauaaaaugcaaagucaguuucuucuuuugauggguaaacuuuauaaccaguuacucuauuuugauuucagaaaaacgugaggcagggcaugguggcucacaccuguaaucccagcgcuucgggaggccgaggcucgagaaucacuuguguccaggaguucaagacuagccugggcaacauagugagacccugucucuaucaaaaaaguaaaaaaucagccgggcaugguggugugcaccuguggucccagcugcucaggaagcugaggugggaggauugcuugagcccaguagguugaggaugcaacgagcugggacugcacugaugugcuccagccugggcaacagaguaagaccuuuucucuaaaaaaaaauaauaauaaaauaaaagagaaaaagaaaaacaaucagccagguguggcagcucacgccuguaacccuagcaguuugggaggccaaggugggaggauuacuugagcucaggaguuggaaaccagccugggcaacauagugacaucucaucuguacauaaaaaaaaaagaaaagaaaaacucuagagucacauacaagagucauaaacaaggaaagcaaauacugucuagacuauuaagaugucaaguaaaugauaaagcacaggccuaaacaaguggaacagaacagggaaaaugguucaaagaaauauuugguuggcccuaaggaaagcuuacagauaugcuuacaaaagauuaugaccuauuuauuccuaauggucauuagauuagaaacaacaaugcacaucuuagacuauuuagucuacugguaugucuauaugugccaccuccacccccaaacauacaagaaggaugcaacacacacccauuaauaacuugaacucacugcuacaguuacgcucaaaucuggugggaguagaggcauauuagaaaaucugggaaauaugcaaaguucaaaaagccagagacgauuuucauucaauuguccuugugaaucacugauuuagacauuccuucaaugugaagcaauggauuaaacaauuuuauuaccacuaccaauaguucuuauuuuauaaagaguuauagcaaaaacaaucaauguuuuacaugcuguguugggcuguucuuacauugcuauaaaggaaucccugagacuggguaauuuauaaagaaaagagguuuaauugccucaugguucugcaagcuguacaagcauaaugccaacaucugcuuggcaacuggggaggccucgggaagcuuuuacucauggugcaaaaccaagugggaacaggcaugucacauggcgagagcaggaacaagagagaacagagaagaagcuacaaacuuuaaaacaaccgaucucacaugaacucacucaucaccaaggggauggugcuaagccauucaugagggaucugccccaugauccaaauaccucccaccaggccucacuuuuuuuuauuauuauuauuauuauuuuuugagacaggcucaagagagccuucugccucagccuccuggguagcuggaacuacaggcaugugccaucucaugcucaacuaauuuuuuuuuuuuuuuaauuuuuuuguaggcauggggucucccuauguugcccaggcuggccucaaacuccuaggcuccagugauccuccucagucugccucccuaaaugcugggauuacaggcaugagccaccuugcccagccaagaguuaaaauaacgagcuuauaguaauaugguuauuauaaguuauuacugaaguaggcuuuaugaaaagaaaauugaaaacauauaaccaauucuaaacuuuauacaauagaaaccuaaguugcagaucuuuuccaaaaaauuguaccugaaauaaauguuucaaccauuuuauagcuucuuaggaagaaaggggaugagagcaaaauggaaauggaaaugauaucuggagaagggagggaucaacaaaaaaauccaugcucaccaacuuaugggcaaaaauuauugcaacacacaauaccccacuguuucugaaaugauaaauguugguuaauaaaccaugaucucaaaagcucaauacaaaaaguguuuuaagaagacuguguaagcugaggaauuuaaaaaggcacugacucccacaaauuaugaaaauucauuuuaaaugucacacuucaaacaagacguuaccaagccauaaucucgaacuaauauuuaaaauaaauuuauuacuuauaacacaccuacuauagaagaggguuuuuuuguuuguuuguuuuuuguuuuuuuuuuuuugagaggaagucucacucugucaccaggcuggagugcagcggugugaucuuggcucacugcaauuuccaccucccagguucaagagauucuccugccucagccuccugaguagcuggaauuacaggcaugcaccaccacacccagcaaauuucuguauuuuuaguagagacgggguuucaccaugugggccaggauggucuugauauccugaccucauaauccgccugccucagccucccaaagugcugggauuacaagugugagacagcgcgcccggcugaaaagagguauaauuuaaaacucaauuuuuuuuuuuuuuuugagauggagucuugcucugucgcccaggcuggagugcaguguggcgaugucagcuuacugcaaccuccaccucccagguucgagugauucuccucccuucaggcacgugccaacacgcccggcuaauuuuuuuguauuuuuuaguagagacggguuucaucauguugaccaggguggucucgaacuccugagcucaggcgauccacccaccuaggccucccaaagugcugggauuacaggcauuuuaaaaaagccuuggccaggugcgguggcucacgccuuuaaucccagcacuuugggaggccuagguggguggaucaccugagcucaggaguucaagaccagccugcccaacauggugaaacauggucuccacuaaaaauacaaagauuagccagacacaauggcgugcaccuguagucccagcugcucaggagggugaggcaggagaaucgccugaaccugggagguggagauugcaguuagcagagaucgcaccacugcacuccagccuggacgauggggugagacuccaucucaaaaaaaaaaaaaaaaaaaagacagaaaagaaaaagaaaaaaaauccuucaaguuuaaaaguagaccauggaacaguuuuuauuuaauuacuguaauuccauuuaaaaacaaggcuggguguggcggcucaaaccuguaaucccaacacuuuggguggccaagguggguggauuaccugagcucaggaguuagagaccagccuggccaacacuacuaaaaauacaaaaauuagccaggcaugguggcacacgccuauaaucccagcuacucgggaggcugagacaggagaauuuacugaacccgggagguggagguuguagugagcugagauugcaccacugcacuccaaccuaaacgacagagggagacuccaucucaaaaaaaaaaagaaaaacaaagcuucuagucaacuguauacauaaacuaccacagcagaaugaauaacauuaaaugcacuguuugauccuuugaguacaauucugcacugcaguaagcgcauuuaagccaauacuacacaguuaaauagcuagauuucauuaaggacgauuuuggggcgggggguuguuuuguuuuugauuuuuuuuuucuuuuuuuuuuugaaacagagucucacucugucacucagguuggagugcaguggugugaucucagcucacuacaacuuucaccucccggguucaagcaauucucaugccucagccucccagguagcuggaauuacaggccugagccaccacgcccggcuaauuuuuuguauuuuuaguagagaugggguuucgccauguugcccaggcuggucucgaaccccugaccucaagugaucugaccgccuuggccucccaaagugcugggauuacaggcgugagccaccgcggcaggccaguuuuuuucgguuaaaccaaauuuuacuccugauacacugaccaauauuuuuagaccuucagaaaugaguacuuucuuuacauauuaacauuauaauuuuauauuuccauuuugucuaaaagacaacaaucuuugaaggccacaccccuuuucucuccauuuucacuaacaaguuaguacagcucacaugcaauuaaacagucucaauaaugccaaguuacugucccuccaaguuggccuacaaacugcucuagauugcucucacacaaauaccaccaaaacuguauagcuccaauauuugaaaccuuuuacacuuuuuauuaucuacuauaucaaaauguauucuugauugcuucuaagccuacucugaccuuaauuuaccaacucgguguuguuccuccuaauuccaucacuuuauucaauuuaagaguaugauaauacgggaagaaauacagaaaugaaaaaaaacacggccucucuggagcacaacgccagccaaaagagggagagaccugaaaauaauuaauuacaacauaacauauuaaguacuacaguauacauaaauacuauauagcagaaccaccauaacugucagaauggaacaaagaucacguuggagaaagagacguuugggcuuaaaaaugagaauuucucuacaagugucauagcauuguaauaucaacauaccaguuucuucaucuuuguauccuagccccuaccauagugucuaguacagaguaggcagguacuucagacauggauggaugaauggacggcaguacggaaaaaaggauaaaauaagauacauauauaaacauaaagaaagaauaugguuagauuaaaaugggacaaaacuggagccaguaaaucagauaagacauuccaaaacccuuacguaagaaagugacacaggaaaaaauaaauuuaaaagauauuuaggaauuaaaauuaacaggacuuggugugacuaacuggacuaaggggaaaugagcauaacagaaaagcguaagaaagaagcugccaaaguuuuuggcuuacgugacuaggcugacagugguaccauucacugaaauugggaacagaaauaggggauucgaguucaguuuagguaagggagcacuaaggcaauaucgaguaggaagcuggaaugcaacucagaaaaagaggucuagauuagaaauaaagagguggagauuauugcauaugggugaugagaacaaagcccuaaauauagaccagauugccaggaacacauaaaaccuggaaagaaggcuguggacagaauacucagacaaccaacauugcuguuaucuuauauguuacaauauugccacauuaaauuauauuguuacaacacagauaacggcuaauacaauauugaggacguaacaaaugcuuuaaaaauaccaacugcaaaccugaguuaauugaaaaauuaaauuuauuaacucaaauugagacauaaaggaccacuucuuaaaaccaauuuaaggccaggcacaguggcucacaccuguaaucccagcacuuugggaagcugaggcggguggaucacgaggucaggaguucaacaccagccuggccaagauagugaaaccucaucucuacuaaaaacuacaaaaauuagcagggcauaguggcagacaccuguaauuccaccuacucgagaggcugaggcagggagaaucgcuugaacccgggagguggagguugcagugagccaagauugugccauuguacuccagccugugaggcuccgccucaaaaaaaaaaaaaaaaaaaaaaaaagcuaauuuaauaggucagacucaaggugcuuaagucuaaggaauccaauuuuacuucagaaucaguaaaaaaucugggcacaguggcucacaccuguaauuccagcacuuugggaggcugaggcaggcagauugcuugagcucaggaguucaagaacagcuugggcaauauggcaaaaccccaucucuacuaaaaacacaaaacuuagccaagacugguggcgcugaaccuguagucccagcuauuugggaggcugaggugggaggaucacuggagccccagagaucaaggcuacaagaagcagugaucacaccacugcaaucaaccuggguggcagagugagacccuguaucuuaacaaacacaaacacacacacacauacucaaugaaaagcuucuuuuuccaccagaaauaacauuacaagucaauaauauaaaauacuaaaaucuaaguuguuauacuucaaaaaauguuuauucuaaaauaauacuaaaaaacacauauuaacuaauuuaaagaagagcaagucuaaauuuggagugauaagggcuucaaugcuguuacuugauaguuucucacaaguauagaccaggugcaguggcucacaccuguaaucccagcacuuugggaggccaaggcaggcagaucaugaggucaggagcucaagaccagccuggccaacauggugaaacccuaucucuacuaaaaauacaaaaauuagcuggacaugguggugcacgccuguaaucccagcuacucgggaggcugaggcaggagaaucacuugaacccgggaggcggagguugcagugagccaagaucacgccacugcacuccagccugggcaacagagugagacuccaucucaaaaaaaaaaaaaauuucucacaaguauuuaccaacguuguuuacauuauugaauauuaacacauacuaauaacaaacauuacccaucaauuauaagaauaguagauuaauaugacuugagaaggccaaaguuaguaacugaacuagaauacaaugaaagagaaauuaucuuuggguccuuuucccuuguuuacaaacauguacacaaaauguagaguauucuugaacauauuuacacuaacaaaugcauaaaaagaaacaaaaauguguuauuaaaagguagagaagcacggguacggugucucauacguguaaucccagcacuuugggagaccgaggugcacagaucaccugaggucaggaguucgagaccagccuggccaacauggugaaaacccaucucuacuaaaaauacaaaauuuaguuggacguggaagcucacaccaccuguggucccagcuacuccggaggcugaggcacgagaauagcuugagaucacgcaacugcaacacugcacuccagccugggccaacugagggagagacuccgucucaaaaaaaaaaaaagaaaaaaaaaagguagacaaaaaauauuuauuauuuuauuuuuauuuauuauuuauucaaaaaaucuauaauuuuuuucccccgagacagagucuugcucugucgccaggcuagagugcaauggugcgaucuuggcucacugcaaccucugccucccaaguucaagcaauucuccugccucagccucccgaguagcugggauuacaggcaugcaccaccgugcccagcuaauuuuuguauucuuaguagagaccggguuucaccauguuggccaggccggacuggaacucuugaccuugugaucugcccggcucagccucucaaagugcugggauuacaggcgugagccaccaugccucgcccauauaaauguuuuaaauuuuuuuagcaucuugauuuuuaauucauuuugagcaacauguccuaccuuacauauuuuauauacugcaaucuuuuaauguaguaaaaccaguucaauguacuuuaaaucgcauuuugaugagcuuuucuaauaucucacucauuguuuauagagugcagacaguaacauugacuuuuuaacaucucauccucauggagacaguguagaguagugguuugaaugccuaaacuggaaugucaauguuaccacagaggucggucccuggaaacaaugacuuaaccuaaggucuuuguuucuucauuugaaaacaggcagaauaccuauaugaagcgcuuauugugaggauuucacaaaauaauacuuagcauagugccuaguagaggagguaaauaauuaacguuaauuucuuucacaaaguuuauguuauggacugaagaucuguguacccccaaaauucacauguugaaguccaaaccucccagugugauggcuauuagagguggaccuuugggaaguaauuagguuuagauuagguccuaagagugagacccucucaugacgggauuugugcccuuuuaaguagaaaagaaaaagacauccucaccucucccuccccucccucccacuucaccugcagacagggaggaaaggacuuaagagugcccagggagaagacagcugagagggcaggugcuuagcugauuucagacuuccagccccggaccugugagaaaauacgucuguguuuuaagccaccucaauguaugguauuuuguuauaguaccccaaguaaaauaaggugauaucaaaaaauauuuucaaaaggagacuuuggagagcaagauaauuuucaccucaucccaauaugccauagaucuguaaaucuacauccucaaacaguauucaguauugcagguuacugcagaacacgguaacauuacuuauuagauuuacugguagaugucuauugauuuuccauguuggccaacagggagaggcagacaggcugggaacaauaaacuacacugagguauauucaauacacuucucuggcccuuggcaauuccucuugccaggucaauauuuugcagauaucaaaaguaaccaccaacuaacuauauuggaagcaaaauaaugacaaagaauccacugaugacaauaaaaauucuuaaaagccagucuaacugguccucuccccaucaguucaaagaaauugccaacauuguagauugaaugcuagugaacuacacuagguucgcuauuacaggcaguuuuuuuaacuucaaaaaugcuacauaaagcacauuuuuaaaugccauaaaccuauuguuuaucuucugcauuuaaaaugcaaaaugccauuaucacuuuaugaaauauacuuuaaauaccgauuuccuguuuaaaaguuuaggcaaaaauuauccauucaaaauucaaaagaaccuaaaacuauucauccuucccauguaugaaaacugagacaauuuuuuaaacagguaaaauucccuagagaauauaauuuuuacaauauagcaauaaaguaauuauccauccugaaagucuaaaacaaacaaaacaaacaaacaaacaaaaaauacaaagaacauccuggaaaucuaaaugccauguaaaagaaugcuagcccaugacgguaaaauuuucuaaagacuaggaaacaucaauaaagauucaaaauguaaugucuuauaaauauucagcauuaguagacaauaacaaagaaaaucauaggguaaaaauuuuuguguucacagauaacuguuauaauauuaagggacaucgucaucuccacuuuugaauagcuaccccaguugccauuacagcuuccauuguucaaaauaaaauaguugcauuguuuuucagugaaaggaaagaaggaaaauauugcugaaaauaaggaaaaaaacaagccucaacaaagcaacaaaaugauuuuauaugccaucuaguuucgccauaauuguaggacugaacugguaucugaaaacuaaauauaucaacaaacauauacguuaaaaucugcgcuuagucaacauagcuaucccugugcuaccgggcaaauaaaauuuaaauuuucuauuuuuuuuuuuauuaaagcaaugacuuauuagagacuacugguauaugaagcugcaauacacauggggaucaauuccuccaauuucauguuuccuuacuauguauguaucucuuuuuguuuuuucauucugguaaccagaguacauaugacaggcugcauuauuucaaauaccuaacacugaaaguuacuuucuggccugaaucuaaggaugagaaugauacauuuuauagaagcuucuuuuaguacagcaauaggcaaauuacgauauuaacaagacuuuaauucuacauuuacauuuuuuucucauuguaaauguaaugugaaacuuauaaaauacaggaaaaaaauguuuaaucaccaauaaaucccaccauucguaaaccuugcuacuuuuugguagauuuccaucuaguaacacugaagguucaauuuucuaauucgauacugauaaauaugcaggaaaaaaaaucaauggagccucaauauggccuuucaauaaauguacauaaaacaacaauuauuaauuauaugaccuguuaauuucacaaaagucucuaaaauguuuuaagugguggaguaggguaaggaguccauaauucagacacuagcccucaaacugaaaucucuuccacaauguuuguaugucaacccuuuaacggcagugagcagcaagcuaugacuguucguacagugauaucaacauuaaugucucuauauuaaacaggcuuugcuuuuauuuucuuuccauuuauacuucaauaguguuuuauuuucacuguaaaaauaaauaauaaccuauauuugcauaguaauuuuacauaagcuuaaauucaaagacucccguuuuuuuuuaagccaaccauucaaacuguuagugcuucuggccuaugagaugguuuaccagauaaaguaacauucuuuauauuccaauauucucucucauaacauaaaaaagaauuuaaggaauaucccuuagucacauuuucuuuuguuccaacccacuguuuauggaagcaugcagauguuaagaguugcaaaaauugaaaugacuucauuaacaaagcaacaucccaacguuuaaugucaacuccucagacucauaaaaaaaugaaacaaaaccaauuauauuaccacuagcaaauuuuuuccccuuaaaaucuaguuucgucuuauuucuaguuucaaggcaagcuuugucuacccaagguaucaaaggucuucaaaucucauucauuuucuucugcccaagaguuaagaaaguaagucuaaaacagaacaagccagauuuguugcugugaucuucucacacgaacgccuuuuaaaagaaaucuuucaacaaagacucaaaaaagaaacagcaaaguuuggggaaagaauugucugucuuuaggucaagcauuuccugauaagugacugaaggucuggcugccaggaauacacuuugcugacccuaggaauggccaagucucaaaacaaaauuugccucuucuguaucuugaaagugaccuguuaggaccugaugucaauuugacgaagaggugauagaacaugaccaacgaggugucuuugguggacauauucauguaaaggaggcgagagccacagauuucagcuaaacgcuuuuugccacuuuugcaaaagaaaagcuaauuguuaacggccaugugacauuauagaucccagaaaaggaaagggugggaggaagagagagaaguucaaggcaguucagggucagaacaagcucagacauccugucauuaacaaauguuccccaagcugaaagcaaaauacugcuuacccgaaaaggagugggugaaaaguagggggagaacgagggaaaaaccacaggagagucaauguggcagugugggggugacaggagggagggaaucuggagcuauccagcugaguuggggagcaaaagcaucgggcauagcaucgggcacaaaaaugcugagaaaagcaacugcgacggagacagcacuaggcacccuccuccccccauuuuccccuccccaucgguuugcuggguuucccaccuucccucuaccuccgcucuugaccaacacuccggggugugacccgccagcaggaggcugcccugaucuuugucucuacccgcucccacgcgcgggcuccuccuccuccuccgcgcuccccacccgcgcacagcgccagcgucuccaaggagcugcaggcgccgcgaccgccgccuccucgcccaccucccgcggacccgcgccccuuccuuccccucccgggcagcgucgccugcgccuccagcuccacccccgccgaggggaccuuugugucucgggggacuuucugccucuuuccccuccuccgccucgcgaggagaccggccucccccgcagaccaaagcggcagcgagcaccggaggcggcggcgucuauaucugucggcgccuccugggaagcagcucgcagacacucacaccccacccgagccccggaaauccccgggcgacccaagguccucgcuggaccggagaggugacaggcgcacgcuagccccccgcgccgcgccuccucgcucaacuucccgaccgggccugagccacccgcgcccccaguagcccccgcccccgccucugucccacgcagccucccggccccgcggccgacccgacaccaggggaaagcgcggcgcggacgccagccgccaacucaccagcaagagcggggaccgcgggucccgaggcgaggcgaagagaggcgcggggggaagcugcuccgcggacgcccgcggcgaccggaugcaaguccgggucucagcggccggcagacgugaggcgcuuccgagcgcaggccuccgccgccacagccgccuuccggcucucgccgcggguccggagccucgggaggggccgcgggugucucacgcguugccaagucccucggucaacauggcucccgcgccgacgagccgcgcggacggcccacuaauccccucggagcagccgggcgcgagcgcggcgggcgccgacggcgggcugagacugucuggccgggcgcuggcuccuucuccgcggcucugcggcggcccgcggggagcucaggagacugcgggcggccgcguucgcuccuugcgugugcgucgcuuucacacucggcggcugcggauugacgccuccgccuguuccccggaggagagcgagugcaagagaaaaaacacuuuuauugaaacgauccaaccagcggcggcggagaaaagcgaccggccgcgggagcuuaccccacccccgccugagcggcucgccgggggcagcgc

SEQ ID NO: 16365 - RNA, 75642 nt, Homo sapiens
cgggugggggcggugcggggcgcgcacggggccggggcggcgggggaggcgcgggccugggcggccagccccggcgcacagccgcggccggggcgcgcggcgcggggcggaaaagccuguuuacacagacugcacaccgccuggggaauaaugcaguaaaggaagugagccggcucggccugacugcuccaacuuccugcucucacacacaccagaggggaaaaaaaaagaggagcgagagaaagaaaaaaagggggaaaaaucaggaucucauuacaagagccacagaccgucugcagacgccugucagcauggaaagucgggggcuuucgcccggguccuccuagaaauuccccccgaagaagacucccccacaucuggguagguaacagggcuucugccuguugcucggacacuuaaaaaguuuguuuggggguguuuucuuuuuuucuuucuuuucuugggcgcgguggggguggggcggggggcgccgcggggugggcugcgggccgggguggggguggcggugcguccgcgcgggagggccggccgcggggagggggcgccgcggaugcuccugcgcccgcgucgcugccaccgccgucgcccgagcucgcgccgggcccggggcugcggggacccugcgcccgcggcuccccucccuggggcugcgcugcgaccccagaggaaggggcgccgggcgugcaacccugggagcucgcccagggccccgcugcaggcagcgcggggagcgggggacggcgagacuucgggucccugggaagaaccguggcaggagcaggcugagugccuggaggcuggaccaccgccgaccuuccagcugggaccgcagucaggcuccccucgagugggcaaagugcacuggugcucggauccagggaggaagacagggauggagagggcgguggaggacaugggucgcgaagguguggggcugggggcugcguccacucucgcuuggcaggugacccccgcccaggucaccgccccaggcgcacgccccaucggacauuuaaaagccgguggucucuauugggcaugguuuuggagaaggaccaggcaagaaaugaucuuggggccccuuccacuccccaucccuguuuaccuucgaacucaacguuggccugugacgcuacuguaacuuuuggggaggcgggauuaagauuuuggaguaguuaaaaagcaaaaauaaaaggucuugguuuuguuaucuuuucugaaccgaaucauccuagggacaagcugcaguuaggcggcggguggagguggaagcaagaaauguuauuucagaaacugcaaaaggggcuuuuuagaaagaaaaaaaaacgagugucgggagaguuucuggcuugucuggaaacggcaagacuaauugccaugcgcuuccgcuuugaaacuggcagcagacagcaucuugaaaaugacucacuagaggagcucacaaagaaacugugguuugcuccuucuuagguuuauguauuugugccuuuuacaguuuccuuuguaguguucgaggggucccccgccccuuccccgccagcccccucccacccucccucauuugaaagccccuggccggucuuuaacuacccccaccccaguccuccagccuggggguggcggggaaaggggaggcugaguuguuuuuggaguuggcugcggagaggguuaaagggauucugcugcugcagggggaaaaaguuccuugaauuuuccacuggcugcugcaggaagagagagcccccuuagucauugcuaaguaaugucugcacacacaccaacuaaucucauuaggaguuuccgcugcucggcacaggagggguuuugugcagccacugucagccugggagcccggcgcuggggaaggagacaaguuauggcuuuauuuacuuaggggugcagccgcccaacgagccuuuucaggacaugucuugaaaacuuugaagucacuuuggccauuuuggauuucagauuugcagguuuuucuuucccgcguguguauguguguugagagguggggggagauaagcagcucacacacacccaucuucuccaucugugcuugucuuugggggugggggggguguggagcauguuccaggcaucuauucaugagccgaaaucgauuugugagccuuacaaaauacccucugaucucuuuuucuuucucucucgccauggcacccauuuauuuggaaaaggucaguuaggaguuucaauuuaugaggaugauaaaauuacaaauuguguuaggagggcacaugggucaggcaguuaaggagacuguccauaaguguucuuagaguuuccaguaaugauccugccuagaaaccccccugaguuugaaaagugauggccuuucuaugccaaauauagcaaaggccuucugcccucuaaaaguguuuuuuuuuuuuuuuuuuuuuaauuuaaauguugcguagaaauguguggcguuacuaaaaagggucaaaaggaaccugauuggaaugauggggccccuuuauugacaaagacauguugcuuuuaagguguuggcaguucuuuuacgguggcaaaguuguccuaaaaacagcccaaacagcccgaccgggguaugagucaguggacaugaguacaggaugucccuaaugcuaugccuucacagaguaggugcucaauaaauuguagcauugaaagcugugaguaggcuaacaaaacuuauaauagguaagaaaaaagacuuacgagaucucauacauuuugcaugaguguuccuuaagaauggagguuguaaacucucuccagaguacauuuccuuuaaauaaaaaagggaguauuuagaauuccuccuucuaaguaauuauuugggacacauagguucauuuacguuagugguucacaacuaggaguaauuuuaccucccaggagacauuuggcaaugucuggagauguuuuugguuguuauaacuaagggggugcauuggcuucuggaggguagacgccaggggugcugcuaaccagucaacaaugcacaagaaagaauuuuuuuugcccaaaaugucuauaguggauugagaaaaaucuuauuuacuuuaaugaugaugaagaugaugaaagcucuuuaacacgcauucagucaacaaauaggacauuuaaaagucaucaucuguaauuuuggccacauacguaacauagcauucaugaauuuucucuuucucuuuuuggucaguaacaugcaauaauagagugacauacggauggugaccuugugaugguguacccuuuauguccugaauuaggccauccaucucugaaacucugcaaguauagcaucuucaugcacuugguaccaaugcuguugagaccagaauggcaguaguccagauaggggagagcagugauuugccagcuccauuugaguuuugaaguuaaccuaaacauuuauuaaagaccuccucuuuuucuuauauaaaaaauuaaauaagucaaaagugcuaauauacaguacauguaacucugaggucauauauuaaaauuuauauuuguaauaacuuuuuggaacuugaaucuuuuccugaaauugguuuuaaaggacuuccaggcaguguauguaaauuaaaauauucccuucuuagcugucagauauuggauuuuguguguucugugggacccaauuauauuuauauaucuaucugauucagaagaccaguauggugcugugaaauguugcaaaacaugaccugaugacaacccaaaacacuucauagaaaacuauccaagaaugugacuuccuggaguagagucuuuuuucacugagggugaguugcugcuuacuaaucguuaguuuuguugccuuccaauucuaaggaaugacucagucaucuccauguuucccagaccuggacuuccucaugaaacuuuauuuuuuuaauuguuuauguugccagggcuggccuugcacuccugggcucaagugaugcucccaccucagccuccgcaguagcugggguuacaggugugaaccucuguaccagcugucucauuaaaguuuaaaagaaaugggcugucuguccauucuggcuuuguucuggcuguagagcccagaugacugucuucugacccuuuccuaagguucuguacauaaauacgcagaugagaggggaaggggacuccauuuuuguuagauuuucuuguauguuucaggcaaaaguuuuuuauguccugguuaucuuuaauuccucuuugccuguauagaucgacuuauaacacacuuugagaccaugcuagcagaauaguaucuucuaaagguugguuguuuuuuuuccuauuguaaaaaauauuaaugugaauugccuuacaaagauacagaaaacugcuauaaaaaaauagacaucucccauaauuccacuguuuaccuuuugauguguaauuguucaguuuuuuaaaaaaaugcauaugugugucuauguauauccacacaugcacauaccauuuuuaauugaaagcacacuguacuuacuguuuuauaacuuuuuucacuuaacauguaacacauuuuaauaauuaguaccgagaccgaaauuaucacauagagcuucuauuuauugaucuaauaaauguguuggcucaaccauggauugacauaauuucuucauagacuuguucaguguuuuuuguccucugugguucaaguaauguucuaagaaugcugcccucuugaaagacugaguuccuaugugcugugaaauuuuggauuuugaugaguuucucugugauuuaaggaugagucaugauuugcaguagaauaucaagauguaguaacaggaaguacagggcacuacacaugaaaauagaauguuaaaugaugaagagaaaccagguuaaacugaaaauauaccuugaaauuauccaacuaugaagggagaggaagguguguuuuguacauuuuaacaacuccuauuacuguuucauuuucuaucaguggaguuuccaaacuuugaaguugguguuuuaaauugauuuuuagcucaagauugcuguuguucauagccacuuugaauugaggucauucagccuuuugauugaaaccauggcagugagaccaugaaaacucuaguuuugccacuuauagagcagccccaguaaauaaaauuagcugugugugugugugugugugugugugugugugugaccuucugugaaauucuaaaugucuucaaaaaugguagauuacucagucuuuuaaauaacuauucugugcagaaauucaacuccccaugguuccugccugaaaccaaaauaaaaauugccuuucauccauuacuggagauuuacauauaugucagcaguuuuaaaguaaacuuugaacuagucauuucaauaaauugugauuugguuugaauucccacuaggaauaaagucauugacuacuuuauugcuauguauuaauuuacauuuccuggaaaguacuacuuuuuucuaagaauuaaauaagauuauaacauggcuuuacuuguauauuuuuaaagaaauuuagacaauguuauauuaguguauucuaauuugaauuagacugaaaugaauuuacucacacacucuaaaacaaggaucuauuuaugacacauagugucauaaauaugcuuaaaguuucuauagcuaagaacaauuucugaauauccauguguaauaugggagugaugggauagguauaaaacacuuaucuagauaccuucucuuuuuauuuuuuaaauugauauaaauguacauauuuaugggguacauagugauuuuuuacauauauaucauguauaguaauuagaucgagguaauuagauccaucaucucaaauguuuaugauuuauuuguguugggaacauccauuaucuuccuucuaguuaauugaaacuauauaguauuauaggcauccugcagugcuauagaacacgagaacuuacuccuccuguuggagaccuucucuuaagacugaugaagcuagggcuccuguacuccaagcaauagaguaaagaaaacgaggcucuugguaucuuccccucucucuuuuuuuuaaguugagguaugauuuacauauauuaaaaugcgcagaucuuaaguguuauuguauacauacauguaacccuacccaaagagacaauauuuccauguccccaaguguuuuuuggcuuauguauuuagagacagagccugguucugucacccaggcuggagugcacuggcacugucauagcucagugcagccucaaacuccagggcucaggugauccuccugccucagucucccaagcagauaggacugcaggugugcaccaccacaccuggcuaauuuuuuuuuucuuuuugagacagugucuggcucuguugcccaggcuggagugcaguggugcaagcuuggcgcacugcaaccuccgccuccugugucuaagcaauucucaugccucagccucccaaguagcugguaucauaggcauaugccaccaugccuggcuaauuuuuguauuuuuaauagagacgggcuuuugccauauuggccaggcuggucucaaacuccuggccucaagagaucugccugucuccaccuccaaagggcugggauuaacaggagugagccaccaugccuggccucuggcuaauuuuuuuauuuuuuguagaaauggggucucauuaucccuggccauuuacaaaauucuguuacggcaauuucaugauucuaccauauagauucuuaaacuucagaauaccuugauaaaauauugugguauuuuauuuaaucugcuuaguuaaaaauaaaucagaauguguagauuuccucaucauacaguaagaggaaaaagaaaaauccuuucuguauuaccugauauccgcaaaauauuuaaccaaaaguaauaugugugcuuuaggaaaaauguauuaccugaagacuaauugggaugagaggauauuaguaaaucuucccagaccucaguuucuuuagccugaugguaaaguaguugaaguggaggcugggugcaguggcucacaugugucaucccagcauuuugggaggcugaagcaggcagaucacuugagcccaggagucugagaucaaccugggcaacauagugagaccccaucucugccaaaaauuagcuagacgugguggugcgugccaguagucccagcuacccgggaggucaaggcugcagugaaccaugauugcgccacuacacuccagccuggguaacagagugaaacccugucucaaaaaaaaaaaaaaaaaaaaaagggauugaaguggagaagcugagauauacucccuuucaagucggaagcccuauuuguguacugcuauauuuggaggaaaggucuugacuccuaagaguugugaaagugugauaugaacuucuugcugucaucuccagacaucugacuuauagacauaugcaggaauuuaaacaaacagcuauuuugugguggaaaagggggaucuccauaaguuuccccuugaauuccauuuuggccccuuauugaauaaggaacacuccaguggaaggccaguauuagcugccaugcuuccuuuccuccuagucuuuugagguuugugacaggcagcacugauuucuaaugacccacagccaccucauucuuggggacaucagugacugucugaguuggugcucuguagcaccagauaagaguuuggucaccuggugaaauuccuccuccuuccuucugauagucuuugaaagugcugucugcccccacugcuguaucuugaggguucuuacauuccucugcacccgcucugaucccuucucuccccaggagcuagaacaauccuuucaaaacacagaucugaccaggucauucuucuacugaaaaaucuucuagugacuucagcuuaggauaaagaccaaaaccccuaacucaagcugcaagaugugauuugggccagcaaacugacuuuuccucaguuccucaaaugcuuaagguguccucugcccucuguccacugggucuuugucaauacugacagaauuuuccccccgaccccucuauuuuucagacuccaugccuaaccaauuuguaggcgucuuuuaguucacacucagcuccaccauguuuuauuggggaagccuuuccugucaccuagaguagaucucccucagucaucugcuccuggccuucagagcccuuaccacaagcuuuuuuuuuuuuuuuuuuugagagauggagucuuagccuguugcccaggcuggagugcaguggcaccaucuugggucacugcaaccuccaccauguggguucaagagauucuacugccucaaccucccaaguagcuggaauuacaggcuugugccaccacaccuugcuaauuuuuguguuuuuauuagagacaggguuucgccauguuggccaggcugaucucaaacuccuggccucaacugauccgccugccucggccucccaaagugcugggauuacaagugugagccaccaugccuggccaccacaggcuuuauuuacagguugccucauuaccugaauucucucucuccaaauucuuguuacccaaacacaggaacaugagauggagucucgcuccgucgcccagucuggagugcagugaucucagcucacugcaaccucugccuccuggguucaagugauucuucugccucagccucccaaguagcugggacuacaggcaugcgccaccccaccuggcuaauuuuuguauuuuuaguagagacgggguuucaccaugcuggccaggcuggucucgaacuccugaccucgugauccacccgccucagcuucccaaagugcugggauuacaggcaugagccaccauaccuggccaggaacuagacaguuuuagagacaucuuucugaaauagggcuggugccccucauuauucauuaaugcuauuuucuccaaaacccgggaaccaaauagaugugauagcauggcaucccucaugaucugaaguuacuguccguaacugcggucccauucgauuuggauauugggggaugccugcacgugucugugucaugugcugcaugucugcggugccaucagucugugagcucccucugggccugcguccguuuuucucauccuuuguauuaucucagcacuuuguacaauaccuggcacucaaugaauuaaaaauaaucugaagcggggguuggggggagcuugucaauauagccccaccuuguuuugcccuuggacuugauaaagccguuuguugcuaugcauauguccaucucuuuucuagacaaugaguuacuuggaugaauaggcagaucucuugguuaaaccauaaagacaggcugggcgcgguggcucacaucuguaaucccagcacuuugagaggccgaggcgggcagaucacuugagguuagaaguucgauaccagccuggccaacauggugaaacccaaucucuacuaaaaauacaaaaauuagccgagugugguggcgcaugccuguaauccuagcuacuugggaggcugaggcaggagaaucgcuugaacccgggcggugaagcuuucagugagccgagauugugccauuacacuccagccugggcaacagagcgagacugugucucaaaaugaaaacccauaaagacagccaaaaagcuccucuaugccacuucccauacuucuuguuuagacuugcaagaaaaguggauauauagaaaugagguuaguuugcuaguauccuggaggacaggguuuggcucuauuguugguaucaguguuacuauacugagaguggucgguuaacaguaaaguuauucgugggauaggauauguugaaagaaucucaauguaaaguuuuuuuuuuuauagaauuaaucauuguagagcaaccaucauuaguccuuuauuaaagacuucaguugaucagguuuucguaguucccuuggauaaccaguuuuuaauccuguaagauccacaguucaggguccuucuuuacuuauagaaaaccuguguguguagcuuccaucuauaccuuuuugaaauuaaugauguuucugauugaguuuggaaauaacaaaagauucugcuuacgugauuaugaagacuugauugacuaaacacccaaacgggggaggacuaggucuccuaauaaauuucagcuggguuuugccaaggagcaauuuguugauaggucaaaccuugacuaagcggaauguaugauuaaggagauuuuucuccuugcacguaauugucagaauagagagauuacaucaacaacagcagcagcagcagcaacaucaaaauaagcccgaaauuauucuaggguagcugcaggaauucucugugggaaucaacaguaggaguucuccucugcuugcaccuguagguugucaucauccucagaguuaaugauccugaggcucaggaagaucauacuauucuauuaagccagaaaaggagguguaaauguuagaaugauucccuaacacuaaaaguuaacaauauuucucugguuaacgcucauugaacuggaaaugucacuuccccucuucauccccuuauuggaguuuggaaggcucgccuuuagaggcucagaugcaaauccuuguuggaguugauucacagaugaaagggcuaugcccuggaaggugaggaguguguaugcgccuuuacggaugugggcugcaagagggaggucugugucugagagaaugggacaauaggugacuucaguuggugcugcuccucuuugcagagucacuacccauguaggauugaagcccugguucugugagaggguaggagcauaagugaauguuuacuaaccgucuccacccuugaagaaucauuguuucacaacgagaagucaggagagaaccuagauuuauuacagaauuugcaggaaagaagaaagcauagauuccugaucaccucagcacaucccauuaugaacauacagagaggggaccaaaccauuuaguauuaucuuugggacugugugugaggugcaguaccucaguuuccuuguaugaucuugaaacccucuggcaacuagaauucgugagcacugggaggcaauuuauuucugcuaacauuccuguagauuuuuucaagccccagcuacugaucauuuagaccagagggcauuggaugguuucuuuucuuuuuuucuuuuagagacagcaucuugcucugucacccaggccggagugcaguggcacaaucauagcucacugcagccucgagcuccugggcucacaugaucuucccaccucagccucccucuguaauccacugggauuacaggcuugagccacuacacccagcucuucuuuucuuuuuugaaaaagcaguuuagaacaaaugccuugaaaugcuccaagugacacccgagugaggguuagaacugauuaaacuccgggcagagagauguuaucauaucuuugcugcaugcauagcccagugcaaaaaugcccauagauggacugacuucaucuuagauaguugaggcaaaaacagaagagccagucagccacuuggcguuucuguccucacuuaauucaccccuuuaguugcuguaccauuaauucucgaugcuggauuggugacaaaugaaguaaucugaagaguguuaaaauuuucuuuaaguguauuacuuuaaugacaaaacuauaugcugcuugaaggcaucuugaaucagaugacccaaguguacugugaauucucaaaggauugggggucacggcucucaaauaagcucguugcccugcuuugauuucaaucagagcugaaccacaagaacagcaucuuccuucagccucugccacauccuuuguguguuuuuuuuaaaccuaaauauuaaagccuaguaguuugucuuucagaaaggagaaacuuuaaaaccuugauguagaucagacgugcaccagaugauucaaauauuuuaccuaaugaaaggggcaauuuucuuuuucuuucucuucuuucucuuucccuuuuauuuauuuauuuuuuuuuuugagacagagucucacucuguuguccaggcuggagcgcaguggcgcgaucucggcucaccacaacuuccgccucccagguuaaagcgauucuccugccucagccucccaagcagcuggaacuauaggugugcgccaccaugcccagcuaauuuuuguauuuuuaguagagauguuggccaggcuggucuugaacaccucaccucgugaucugccugccuuggccucccaaagugcagggaugacaggugugagccacgauuuucuuucacaagggaaaaaaaagauccucuaaagcaggaucuggcuguuauuuuguacaguuaauauauucacgcugaacaauuauuggaagagcagguagaguaauaaguuguauaugacauuucaaaaagggacugcccaagccaguggauggcagaugcccaugugggaauuaagggcagcgaggaugcuuugggguacagauugauguuugauguuaaugccaccaacagccagucucuuccaucagaugcuuuugguggucuuugcauaacaccauucucuggacaugaaugaaugaacgguuggucugccccucgaugacaguuuuaauguuauuuugcucauuuauucagugcaucuugaugguuaauuuaaaaaucuauuugaaauaugaggcauuaugagaagacuguuaaguuuugaaaucacucacugucuuauuuuugcaaguuuuggaaauaacaguacccaccaggaacaccaagcuguuuuaaaauguguuccacuuacaguuguuugucuacaagucggguuugguuuaaacagacauugaaugagaggugagagggcugugcuuguacuuuuaccuuaacaccacuguguuuuuacuuccuguuaaaauuaacuuuauuagaggugcuguauacuuagaaucccucugcauuuggcaccauaaccaucauaugcagcuagacuugauguccauuguacaaaaaugugagcgagacauaggcauguggggaggguaaagcuauucaagggcuagugacuaccuuugugacuucagaugcaguuaaaaucccacacacauguccaccacaugagcaggugaugauauguugaagacugcagagucacuguuuuuuauaguucucuuccaaagcgaauguauuaccauaccagauuuauguauaaauguuuaugccuggaauuugcauuuccuaaaccaugaaagaguuuuguugagaagagcacgaaggaaaaacagugaaacuaaccaguuccuugcuucaggaaccaccucuguaaggcagcucuuugugcuucucaaaaaccucuaaagauguugauggugaucccucggucaugaauaccaguaacucauaaccauuuuugcaagaauacuguauagagugggacccaaagacuggguaaugucaguauuauccaacuaaaccuugacauguuuuggcaaauguuaaacuucagaaaaagaaagaaaagaugaauaaugcaauuaacccuuuguauaauaaauuaucagcaauucaaauaugcuguaaaguguuaacacugauuguauccucuaaauagugucuagcucagccaacuguuauccuuugccauaucuguguaccauuuaaaagagggauuaaaaauaguuucaguggauuuacucuacgaagggagaaagguaacuuuuccagguaggcugauguuagagggcaguuuuuuguuuuuuguuuuuuuuugagacagagucucgcucuguugccauguuggagugcaguggcaugaucuuggcucacuguaaccuccgccucccagcuccuagcgauucuccugccucagccuccugaguaguugggauuauaggcgcccgccaccacucccaccuaaguuuuguauuuucaguagagacgggguuucgccauguuggccaggcuggucuggaacuccugaccucaggugauccacccaccccggccucccaaauugcugggauuacaggcguuagccacugcacccagccagagggcagguuuuuuuagugacuuaaccauccagaaaugauuaaguuuacuuuguuauuuuaaauucuauagagaagauaagaaaguucccaguuuuccugagaagagcaugcaauggcgucucuccuucuccaggccacugccagggcuuucugugaaggagcuggaagggagagggucaagaguucuuguugcuucauccaguucccaagaaaauuauagccugaugugucaugcauugugagaagcaggcacuggugaggagagacgaguuuugguggaggcaguaaaugaagugcaaccagauuuaaaugaccuccaaggagccuaugagaugcacuguggccuugguaggacaggggagcagaagucaugcucacaccagagggaguuuugcagggacuggagaaaggagcugcaaggggaggaagaggcucuauaacucucuccaagauagaaccagggagguagaauggcugugcagauguuggaggucccgggccaggugcagcugggccagggaaaggggaaggugcacagaugguugggcaccucucugccaggaaacacucauugcugcaucaggacuggggugcccagcacagcugugcagacuucccgguccccaggaucccuuggggauccuucugagaggaaggggugaugucacagcccacaccugaccccaccugggaccccuuccuccccaggguugcaccauccuuccugacccugccguggugcagcgugugugcacacgugcaaaacagagacagggcagacgugauguuaaaggccauuuguaagcacaacagauugcaggaugccaucgaugcaaaaagaguuugagagaggagcuaacacaugagauuuucuuuuauuaaacauauuuuaucuugcuuuuuuuuuuguaauguuuccacuggguggugcugcaggaauuccuaccuuuugccuuggaucuacccuucccagaaagacgccucuaaagcauaauaggaggaaguccugauuuagaaagauuuuacaguuucaacacaauagaagaguuggaggaugcucuggcaggaaauguuucaguuucuggauguggaaaaaccgccaucauuuuguauccaugcaaaaagguucucauugcacuggguaaauacuuucgacuuucaucagcuucuucuuuagcacagaaaaucuuucaaguuuaucagaaagauuaggguuucauucuaguggaaguggucuguaagauuuccuuuauuuugauuuuuguaacaccaucuuaaaguaaguaaauaaacauuuucuuacauugacaaccauagauuuaagaaaauacuucugucaaggcugucuuuaaagcugaagacauuguuccauccuuauuauaaagaucauuuauacaguguacugaucaaaaggauuacauauuuuuacuuucaaauacuuucaagaagucuuuuaguuugauaguauguaaaggauaagacugacuuuaccccuucuacagaggagaagguugaaauacagaaguuaacaucccugcuguagcucacacgacuuuuucuccuuuuuuuuuuuuuuccuacauuugaccaaggcacagaagaucacacaacuuuuuaagguuuuggcugcaaugaggauuuguuuaucuugaccucccccaacuuuuuuucuguuguacacaggauugaauuguauugauauuaauaguacaaaaauuuggggaaaagauuuuccauucaagcaaaggccucugaaacauaagaaucaaaaguaguaugagggucggggggccagaugcccacuggggauuugagagcucauuaauuuaaagcucaaacugaaagacaguuuguaagauccuaguaaguuucacugacugcggaacagccuguuuuuuucggggcauguugugguccuccaugaaauccuaaacacugcuuucuuagaaccugaaacaggcuucccuagagguguuucuuuuuaaaggaaaguuuuggaggcacugcuggguacuagggaccuugccagauccugucaugcacgguuucccugggauuccagccugucccuauucacacuugaagugcuucucaugauucguuucgugaugugaggugcaugcauguuuggggccccucuugggcuaggcuagcucacuucuguuuccucugacuuucauccuguuccaccgcccugcgcgcgggcgcacgcacacacacacacacacacacacacacacacaccccgagugggagguccaggggcaccgacuuccagaacacgcagcuucucaacggcccacuuguaucgagaaccacccuugcuuauuuaguguugggugaaccuugaaccuauuuaaaccacgauacagaucuuugaaaggagggcacugguuaacaaaaugguggaugggguggauucaaagauucuuucuugaaacaacccaacuggagcagcuggagacacagaugaggcaacaccagaaaugaacaaggaaauguccugauuugauuccuaguaggaauguauuucccacgcauuacaaugagacguuucccuuagcagcagugaagugugcauaugagaaaagaagccucuacugggggcauaugcgcguugauuaagaaccuggacuuuggagccagaugccccuggauaugaggcucuguuggcccauuuuacccauguggccaugagugucuuauuucaccuuucgaagucauaguuccucgugggcacagccaacugagaguauuaaauuuagacagcauguauaaagcacucagcacaauuccugguacauaguaaguggucaucaaauuuaauugcacuaaaaagaaaagcuccuauuuaauaaaguaauggauuucuuuagguaugggcgcuguucuucagaauuccaugggaucucagcauugcuggugguggaggauauauuaauagcuaacguuuucuuagaacagugcucuuaauuugaaauuuauaaguuauuuuuagaguuuuauaaauccuggugaaauuauguguauuuuguauagcuguauauuuuuccuagagaauuuuagauugucagaaagguccauggaccaaauaugugaagaggaaacugcccuggggaugucauuguguguuuguguguguguguguguguguguguguguguguguguguaucaguuuuauguaugugaauauauuuuagguugaauauaugagauugcugguauuuaacuaguuuugaucucuaaaaagaauaauuucuuacaguucaacuuaauaguugugauauuaugaaacaauuugaaauauaucacaaugugauauuuauaaugaaauaugauuguagcuuauuuuuguacguuauuuaucaaagccuagcaaguuaaaauucaucaggcagccuuggaccacuaguaaccauauuuaccuaaaauaacuugugcuuuuccauugaccuuaaucacaggaaauacaaaauaaaaacuuuucuguguccaguauuaugaaacagucuuuaauuuucauuguggauuuauuaauagcuuuauuacaucuaaugaaucauuuuucugauccaaaugacuacuguuuaggagaaucugcuuaguauuuuuucccuguugaauucacaauguuaauuacuuuggggaggaacaaaaauucugaguuuucuugggcgauaagaaccucaguguuguuucagaaggcagaguugggcugcaguacugaagguuaaaacagagcuaaaacacaagacaaaaugaaaccagagcugcagugacaaagugggacagauguaggaggccagguuuccuguggcccauuuuccaguuuccugccugcaaccugcagaagaagaggaagcugaauguuaccaaguaugagaacugcgggacgugcuucaagcuagaauuaagagaaugcaaacaacacaggcaacaaaaacaauugcaaagaaagugaauguucagguuuuaguccaaaaaugucugggaaggaacagcccaucuguuuaaagaaaaagcauugucagcagagcuuguccuuccaugugagacucugagggggccuagggacugccucagguuguaggaaccucuguuuuuuauagccccacucaucuuucaagacauggucugcuguuuuaauacagaagguuaccugaaaagauuuucccugcaauucccaggacuucuaaaucuguuuccuggggauguuguuauaggggggagguggaugugguuaaccaagcagcucuaaugaacggcagccucaauuugggaaggccgggugaccaguuggcugcuuugaucuaggaggcuuauauuccuuuaaccacccaauaaaauuuuugucugauguuuucaaagaagagauuaaaugaagauguguguguguugaagacugcauagugcacacucuguguggcuaccggugagccacguggcgggauacaggacucaaagaagaucacacuggagaagggagugaguucaucuuucucgcgggggagggggaagcaaaauaaaauuauuuuuucuaggcucuuuagcucauuuuggaagagucugugaagucagaucuuacaauacccaucuuagagaaaucgagagccaaagaaauugugauucauuacacaccuuuuaauugaguaccuauuguuugucaggggcuguguuggaagugcuggguaaugcaagugaaaugauggcuaaaaauaaauagcuguuuauguguuguggaaggcuucauauaaggcauauacgaagggggcauagaaaccuuguugaagguuuaaaacauauauaagccuuuggcgcagugccaugcuuuuuccacacaccaucucauuuaaauugccuugcugcuuugugcuacagagaaauagggugugcuucugggacaaucaguuauuucuuuacccugcagauugaccaccucuucuucucuaagcccagaaagaacaaacucuaucccaggaaucuuaaaaaguuuuggacuguuagggaucaagagguacccacacgaggcagccuuggauggaaauaggcccuuuucugucuuacugugggcccgcucugaaaauguaggauaacauagggcuggguuguauggugguuauuaggguggggugcggugaauucugugggaaaaagucgaaugguuguaagacauuuucucagccaguguuaacgaagccaucauuuacuacucacccauauaaaagucacugacaaaccaauugaguuacuucuaauuuagccagagacagcauaguuccagaaggaaagagggguguuccuacacacaguaaauugcauauguuguuauuucagugguugucagugauuuccucugaaaaaucucucuuuuuuuuuguuuuguuuuugagacagguucaugcucuguugcccaggcuggggugcagugaugugaucacagcucacugcagccucaaacuccugggcuuaagugauccuccugccucagcuccccaaguagcugggacuacagguaugugucaccacauccagcuaacuuuuguguuuuuuguggggaugggggucucguguugcccaggcuggucuugaacuccuaggcacaaacuguccucccuccucggucucccaaagugcugggauuacagacauguaauccguucauuaaaaacccaguaauccuugcauugugcuagauauuacauugugcuagauauaacauguacaggcauguaaucccagcaaccuuucucuuucccaagauggaagaguuauuuaaaaaacauugcagacugggccagacacgguggcucacgcuuauaaucccagcacuuugggaggccgagguggguggaucaccugaggucaggaguuugagaccacccuggcgaacaugcugaaacccugucucuacuaaaaauacaaaaaugagccggaggcaguggugugcgccuguagucccagcuacucgggaggcugaggcacgagaaucacuugaaccugggaggcggagcuugcagugaaccgagaucacaccacugugcuccagccugggcgacagagcaagacucugucucaaaaaacaaaacaaaacaaacaaacaaaaaaaaaaacagcaaaaaccauugcagacuguaaagaguaaguaaauaggugagcaauaccuacuuuuguuuaccuuuuuuaaaaugaacaauuuguagauauucacagaaugcaaauacuuguuaauaaaugaaaagcuugggagacaugaaguuggccucaugccuuuuuuauacacagugauaaugaucaaaauaauuuaaauguccuuugaaaauaaauuuaauagucuuccaacucacagaaauaauaaaaaacuucagaacuuguauaaguuuuuuuuucaaauauuauccuuauuuacuuaauaccuuacacuuacucugugcugaguuauugcagaucccuaauaauauaaaauguugucuuccaguucuuugacugagguacaggguucauuuucuauaaugaaauggcuacuacccuuugucuuagacaaugauaguaucaugacauggaaaugcauagcagauacuggcagaggaguugaacucagcagaauuuucaguaagaaguguucaaauccaucuucauuucucuaaccaugcaaaauuuaacaaacgaaaaaagacauggguaccucaugagcaccuauuuuguuuauuccuuacccagaaguuuuucuccuuuucuugggcucucauugccuuuuuuuuuuuuuuaaguugccucguuucuuauuucccaccacauagaagcuuaagaaaaucaaagcuaauucugcccccucaacucccaccucaguaaaaaugaaacaaggaacaugcaaagggaagugcuagguugccaucaguagaaagaagaacaaauaagugggcauuucgacuucuaagaauggaggcaaaaaccucauacuuugcauaaggggucugugcggcccuugcucacauuaagacgucgggcgccaccuuguggccgacaggaaggaggucagcuuccaagaagaggccaguagcuuuucggugacagaggcaggaggcagcugggacaccugaagcugggaucgugucaugugaccugacagcucucacguaggcggaggcgggcacagcguaaugagaaugaucaauauuucugucaauagcaucuuucuuuuugaggcuccgucggauuaaagaaugaaucaaaguuaaauaaaaacaugggaaagacuaaagagggacauaaaaccuuuuuuuuuuuuuuuuuuuuuaaagagagauggucucgcucugucacccaggcuggagugcaguggugcaaucacagcucacugcagccucuacuucccaggcuuaggcgauccucucaccccagccucuugaguagcuggguggacaggcgcggaccaccagacacagcuaauuuuuguauuuuuuguagagauggggucuuacucuugcccaggcuggucucgaauuccugggcucaagcgauccacccaccucggccucccaaagugccaggauuacaggcgugagcuaucacgccuagccucaaaacuguuuucauaacugcauucuuuaagugcaaaaagcugaaaacagaauaagggcagaaaauaaucacucagagucugcaaaaaugucccuccccucugugccagaggucaagcguuuuacucucggccucucuacucugugucuuuugcccugaccagcccgugaaugcccuccuguagggccccaucugcagcggcuaugagcgguguugucaucauugucccuuggcuugucauuuagaacaucuuucuuucuucgcuaucugacccaacagcucucauguacuugacucuccuuccugcuccagagaaaccacauagaugggagccgaauguaccccagggaaggagagagccccagggacccucuuugcugaggucacacagcuuggaggccucagggucagcauuuaaaccaguguuuguuaagcuggagucggagaaucagugcccuagcaucugaguuuucugcaagcauuuacgauuuuuugugcuuucauauuugaugauagacuacaaaacagaagcauacuccaagucaccuuauaaaccacagucgccauguggcugaagagucucccuggauuucagugccuguguggggcucauugccuaauggacaaagagcccaggugggugcuguagcuacacaaugccuucuagccuggugaaggccaugugacuccacagcaagcucugugaggaggauucccuguagcuuaaaagguaauuguaguuaacauuuaaauagcacuuacuuugccccagguguaguuuaagugcauuauuaguaacuucuguaacucuuacaacaacccuguaugauaugauacuuuuaucauaucagucccauuuuaccuaugaggauacugaggcacagaaagguuaaguaacuuccccaaagucccacaaccagacaggacgagucuuugcuguugaacccagagagucaggugccagaaucugcgcuuaccuuccaaauagacaaaagugcuucacuagcaccugcuuugaguuauagaaaauagcuaaacagcuggaugcgauggcucaugccuguaaucccagcacuuugagaggcugaggcaggagaguugcuucaggccaggaguuggagacuccugagcaacauacagagauggucuccacaaaaaauuaagaaaugagcagggcgugguggcacauaccuguagcccaagcuacuugggagcuagagaugggaggauuguuugaccccaggaggcugaggcugcagugagccaagaucgugccacugcacuccagccuggcugacagagugagaccuagucgaaaagaaaagaauuaugcuucagugaaaaacugcauucuugacucuagagaagacucccuccggaugaugugauucugauuuuuuggaagguauuuuacaacguuguugacuauagguaacugaucaugaaauaauucucgucuauagacagccaaauucugucuuacagagugccauugacucccaccccuaguuuugccuccauuuaagcauuuauuucaauguucuucuucuauaaaugccucuauuauucagaugcuuuuuugaacucauuauaacgucugccugguucccuacugaauuaugagugaaauaaaaucucgaacguguucauuuugauaucuguaugagagccaugauuuaacccucuuuugaaaauuauuuuuuaacaaaccaauuccucagcugggcacaguggcucacaccuguaaucccagcacuuugggaggccgaggcgggcagaucaccugaggucaggagaucgagaccaucuuggccaacauggugaaacccugucuccacuaaaaauacaaaaaaauuagcugggcgugguggugcgcaccuguggucccagcuacuuggaaggcugaggcaggagaaucgcuugaacccgggaggcagagguugcagugagccgagaucgcaccacugcacuccagccugagggacaaagagagacgccgucucaaaaaaaaaaaaaaaaaaaaucauuugucaacacugagaacgaaaaucacuuuuccuccuccuccuuuaaaggagguaugcauaugauucacguuugacaagcugcucuaaaucaucuaacuucacucuaccauggcagaucacagcucugcauuacaaagggaaaggaguuggggcaaguaacaggugguuuugcccucuggaguaggaguggguggaccucagcccccugugaccaugguccuggucagugcugguagaaauggugagagaccagccagagacgggaaggcccugcaggcugcaagguugaggugaggucagaggaauccagaaaguaucagaugugaagggggcaccucuuccuguaagagcagcaaugccuuuaaaagcagacugaugggccucaguaugaaagcacagaguucgauucugcaaaaagaauggcauuaaaauaccugauaaaauuuuguacauucaaaauaaggucugauaaggacgggaauaauagacuggggacuccaaaaguggggagagagggagggagugagggcugccagauuaccuguugggugcaguguucgcuauuugggugguggguaugcuagaagcccaauccccgccauuaugcaguauacccauguaacaaacaugcauguauacccccugaaucuuaaaaaagugggggucuaggcaggggaaagauaagcauuuuuuuuuuuuuuuuuugagacagagucucgcucugucaccuaggcuggaguguaguggcgcgaucuugccucacugcaagcuccaccuccuggguucacgccauucuccugccuuagccucccgaguagcugggaccacaggcgcccgccaccacgccuggcuaauuuuuuguauuuuuaguagagacaggguuucacuguguuagccgggauggucucgaucuccugaccuugugauccgcccgccucggccucgcaaagugcugggauuacaggcgugagccaccgcgcccggccaagauaagcauuuucucauuagauaaagggaauuuuaaaaaaaagauuucuagcaugccuuuuauguguucuacauuuuugaagcucagaguggugggaaaucagcuaaguaaaguuaggcagaugaaacauuuuaacuuagagcaggccuccaugugcauaauaaucuaucaaacauaaaucucaaguaccaccacuuuuucaauuguugauuuaauaaaagccacaguguacugucugaauuacucacauuccuuaaaguggcauccagauaaaugggcuuuauuguaccugccuguuaagacauuggacuucauuaaggauucuagguaucaaggaauuaauuuagaaaaaaaaaucguuuaaauuuuuuuuccggugagagagauacucauauagaugaguuuacgaaaaucuguaguguuagcgguuauuggaagggcguaccucccagcaugaugguacaaagucuguguuuuccaacaccccagagggcaaaauuuccaacuggcagaggcgcaguggaauguacagugugauuguaugugaaaauaguuguguaaauuaugaaacuugaucucauaguuaaacuacgucgaguggaacgaaaacaauauggagagcgcuguggcagcugguggcccacugcccaccugucccccuacccaaaccucugccacagacaaccacgcauuuucaucaugcagauggcucuggccagagaggauggugggucccagagcugccugggggcuccacgauaccccagagugacuucugagcguagacaggagugacugaucuuuguagaugcaaugauaagcucacaggaaaguaguuuuucgacuuagcucugaguaaugucuggcugcgauuuccaccgggaaggcuacaugacugcccagucaucgaaacugguggauccaccagguugaaggaguggcucaagagagcgcgagaagaggagaacgaggcccucagcacggggcgaggcugggcaugccucagacaggagaggcuggagcccuuagucaccuccgccggagcaguguugcgcauagcaaccccucugaguaauccucugaugauccccugugccugcagcugccacccaagcucugcagcuugguugaacugugggggcauuucugugauuccuagugaacagcucuugccuucucuaggcgaguuccuuuauuccagaaaucugggaggcccugaagcaguagguccccauccccaccacugcuccucugccuguucccuuucuacucuuucaccuguccuuuuuguccuuuuucuuucuuucucuccuucuaccuuugccugagguuauggccauagcacccauggcugccacuuagcccauguguggccucugaguaaaaaugugaucagccgaucccuccacaccuaguagcauacuuuuucgugauuuuuuuuuuuuuuuuuuuuuugagauggaguuucgcucuuguuguccaggcuggagugcaguggcgcgaucuuggcuuacugcaaccucugccuccuggguucaagcuauucuccugccucagccucccaaguagcugugauuauaagcgcgggccaccacgcccagcugguuuuuuguauuuuuaguagagaugggauuucaucauguuggccaggcuggucuugaacuccuccugaccucagguaauccaccugccucagccucccaaagugcugggauuacaggcgugagccaccacagccggccuuucucaugauuuugaacacaagcucuagagcauaaagauaacagcaccccagcaaagggagaauuuuuuuuuuaaacaaagacaucauguauuuuaauagucagcuuuugcugcaguggugcuguguaaccaguugccccaagaucacuggcuuacaguggcauuuauuuuucucacaagucagugucacggaugcugcuucagaugaugggcggguggggcuuggcuucggacuuuggguugaguucaggucaccuccaugugucucauucuggggcagcagcuuccuggcagcauagcacaggaggaaaagugccaacuuaugaugccuccaagaccccaacucggcaaugggaugcugucacuuucccgugucagucuccuggccaaaugcaaucacauggcaaagccccaaugucagcacuccucccacagccacuccagugcagggcuacacagucaccuaaggagagggcaguugagaacauuuaacaagucugccauauggguucucauaagucaugcccagaacauggucucugacacaugggguuggauugcaaugaaaagugauucugugaugcacaagaagcuccgaggaggccaggcagguggaaaugcuaaguguaguaaaauacauggauagauguuucugcugcccuccugucccauucggaacgugaugucaguuaaaagugggggguggcgguggccgaccacuuucccaccuggcaugugagcagaggccccacagucccuucccugcagaccuccaaacccaccggcagccuucugcccucaggagcagauucaucugagcaggcacuuaaaguuucaaagauauguuaaagcugacugacugacauguuuggccaagaaaaucucaagaauuugcgacaacuguuagccguucuuagugccagugaagagaagaaaguuguggcucauauccaagucaucagaagggugguucauaggaggaguugggacucgucagcugccaugcaucccagcaaagugggggcuugcaagauuugugagaugcagaggugguuuugacccagcagugaaaugacugucuuacagaccauugugguuaauacugauuucuguaaagaauauccccuuuaaagagcccuaaauaaaaugcccuguggguaauuggagagcacuccuagucuacuuuccuuuaauugagaggaguugugggguugacaauauugguacaaauaacccuccccaaggcaauuauucuggcuuccaggucucccagagcugcccccuggguugcggucacuccagguucaguccccugccccccgcccaccaggacuucagugucucccuccuauccaaggggaugaucccuagcucucugugccacucacaacaguugauccguggcaaagcuuuugaggccagucuaaccaccuuuuuuuaaauguaaugaggauugauaacacaaauggauuauuauuauuauuacuacuuagaaucaauaccuauugucaugaaaguccucaaaggccugaaauugagaaacugcccaggaguggggaaaaacuuccuugagaaggcccuauuugagcugggucacaauggaugagaaagaguucaccaggcuccaaagcuaaggaacagcauuuuagccagaagaaauagcauuuaaaaaguucacaccagaguugaaggaaaaggauaacauuguauauauagguuuuugucucuucaugggagaaauugcuuuucccaucugugcaucugugauggugggcuuugaccugcagcauggugagugccgggaaagggaaggucucugcaauuggcagugauuguucgguuucacaagcauccacggacugggcagcuuugagcauuguauggguuaucagagugcuggcaauacaaaauaauccagcaaaguccuuuccucgugaagcucaucacaguaggaaaggcaguuacacuuagacauauaccacaaccacaggagagauauuccaggcaccuguauaaaguaugggguccagcauuuuaguuagagaccgacuauauuaguucuuucucacauugcuauagagaaauaccccagacuguauaauuuauaaagaaaagcgguuuaaugggcucacaguucugcaggcuguacaggaagcaugaugcuggcaucugcuggguuucuggggaggccucaggaaaccugcaaucauggcagaaggcaaaaggggagcaggcgugucacauggccggagcaagagcaagaaagcgagggucaaggugccacacacuguuaaaugaccagaucucaugagaacucagucacuaacucaaggaugguaccaagggagauggugcuaaaccauucaugagaaauccacccuuaggauccagucacuucccaccaggccccaccuccaacguuggggauuacaauucaacaugagauuugggcggggcacacauccaaacuauaucacggacccacaaagaaauugaugggaugggcgggaauagacacuuguguuaaguggggaaugguuugaauggggacucauucugcaaguggucaugucauuaaucauuguucugcaucauuccccaugcaucgcugucacucguggggacauguggugaauagaggaggaucacagggccucccuguauuucugaauuguggcuccuuacagaaaugcagccaggaagcuccugguucagaguggccccuugagauggaagugaaagcuacuuuuuauuagguucacugggggaaggaggggacagcugaguugcccauucugaagcccccucucuccucgccaaguuuggucggcaucgugaccagcagcucugaccuggccuccucucccugcagguauggagagugcaaucacgcuguggcaguuccuguugcaguugcugcuggaucagaaacaugagcauuugaucugcuggaccucgaacgauggugaauucaagcuccucaaagcagaagaaguggccaagcuguggggacuccgaaaaaacaaaacaaauaugaacuaugauaagcugagcagagcccugcgauacuauuaugacaagguaaacccuugaccuugcauggggccgucuuggggaggguggaauccccucugcguaguucacugaugaaagaaaauaauagcgugcuaugaaucaaguuagaaaauaaaauaggggcagugcauaccuucuuuuuggagaaaagcugugcuguagggauuuuccccacccucuggacgcccuuuggauauuacugagggucacauuuuguuucuucugcauuuucgucugaguuugcugaagaacuuugcucacaauacaaaugagaugcaggcaggcucuggggcuuuccucauguugaauugcuugaaugacacaaugcguguuaaaauccggaaagucuguuuauccugucugguuugugguucaauuaaagggaccuuuccuggaaggugguagcuuuggcagauuauuuuuuaacaauucagugccucaguauccucguuuauaaaacaggaaucagcauaggaauaauaauaggaauaggaauccugucucaggauuguggugaugaccgaccgagccauuacauguaaguacuuagaacgcugcuaauaggaguaggaauccugucucaggauugugaugaccaaccgagccauuacguguaaguacuuagaacacugcuaauaggaguaggaauccugucucaggauuguggugaugaccgaccgagccauuacauauaaguacuuagaacacugcuugguauguggugcuugcaacuucaugggaaacuucccuaauuggaagaaaaaacauguucauuuuuaagucauagagaugaggcagagugccuugauaagugauaauauagcguaguugccaaaaccaggacaguuggagugaguuuuaaugcauuucuggaaaagcaguuuuaaugugcuugcuagggcaaaauuauugcuguuuaggagaaccauuucaggccuuaauuguuagccauuucaguuugaaucuguuguugcugaauauuuagccucuaagacauaaaggcauagagccaugauaaugguaagcuuuuguucugguuuuauuguucauauuaaaaggugaauuaaaaacugauuuaaauauuaguuccugaucuauauuuaggguaugccgucugccaaccccuuuggaauucaagacauaaggauuauacguuucaggaaguagagacaucauuaauuauaaaguguuccuuuaugugaucguaauugcacgugauugugucauugaaaugcuaaaggugcucuccuuuaacguagcaauuaauuaauccugacuuacugcagaguccuacuaagauauaaaagcacuucuugcaaauugcacugucugaaagccucgcagauggcuuauuguuuugcguguuuucccagguucuaaauucugcagugggaacuggggccgcugaaggaaaacacucccguugccugcuggcagagugccuaaaagcugggcuuugagacucaaaaagcauuuucauuguuuucaaucaagguaucaaaaaaagaaguccucccucugugucugggacuugacucaucucuucccuggccugggccugggggcuuaaggguugugucucuuuagcaugaaggguuguccugggcuggaaaugacugcucacaaaauuagcaaagccauuccuguuuagacuauaucuuaucucccuugggcagauuuuaaaaucucuagagagagcaguuucauagccuucagucaacaaguauguucuggcacuuucugucagacgucuaaggugcugugcugagcacuucuuccccuugucuccuuuaaacuuuacaacaaccccauagacaggugcugcugucaucauccuccuuauacacaugagaacguggaggcuuggaugagaaaccugcccaggugcacacagccagugagcagcagagcccggauuugaacccagcugguccacccagguucccagccaaaaggcacacacacacccugccuucugggccauucauuuccuuugccuuugagugucuugaguuccagguaggcagucaggcuguccaaaggguauuacaaccuaagaaguuuuguuuauuaccaagagccucaggcugggcauagugccucacaccuaaucccagcacuuugggaggcugaggcaggaggaucacuugaguccaggagucugagaccagccugggcaacauggugagacccugucacaacaaagaauuaaaaauuagccgaguguggaagugcaugccuguagucucagcuacuugggaggcugaggugggaggaucauuugagccugggaguuugagacugcagugagcucugauugcaccacugcacuccagcuugggcaauagagggagauccugucucuuaaaaagaaaaaaaaaaggaaagaaacaaauucaguacugaaaaaucccagcaaacgauguguaucagguagagcccaaggucaggaguccagguggcugguguggccugccugccugcacugccccuuucucucuugccaggcagagcaugggggcuggccacaugaccuuugagcagccccaggcaucaagcuggagcuggcaguaagggcaggagcagccuccuauccuguuguaucauguagacuuuggccaccagaagaaauugcuccaugucuuuccuucuacagauauaccuguccacaugcacacacacacacaaguauacacauacacaccuguccacaugcacacagagauguccacaugugcacacccaugcccacacagauguccacauguccacacagauguccacaugugcacacccaugcccacaugcacacacagauguccacaugcacacacacauaugcccacaugcacacaggcacacacacccacuugcacauacauauccacaugcacacguggccacugccauaugcacagacaugugcacacgcauacauguacaugugcacgcauggcugguuaauucuugcuuauaaaaugcucucaagugaugagcaagacggaaaguuagacucuuaauacaguuuaaaaagaaaagaaggagagggggaggaagauaagaagaaaagagaugguugagggaaauggaggggagaggaaaaaaagaggggauggagaaggaggaagaagaggaggcaugucaaaaagagaugacgaaaacuacacucuauuugacauuuuccgaugaccucuuucuuccuuccguuuugccagugucacucugugaugauagguguaaguugacugugugcauugcccgucugugaccguuuucgacucacagaaauggcagucugaaguggcucggccucuugcuugagagacagauuggagcagagucuuuguggaugcaaagccaccugggccacugccgugugugccacccugaacuucaagcugcccugaaccgcgugcguuucucagugucacguacagcucggccugaccguuugccuuuuaguguucucuuccuucucgguguccuccuccucuuccucacuaacauucauccagagccuuucagugcagaaaucagguagcugcugaacucggcagcugcguccuuuuucccaucaucucuucuguccuuugcuagcugucauuucuucccucuuggcuucaacugcacaucccuggguuuguccuaauagggaauuuuucccacuugaguagacaagcaugagaauaucauuauuuuuauauguuauauguuauauuuuuagcagagaaaaaaguggaaaaugugugcaaacuugcagaaggccccccggaggagggucgucccugugcccaugcugucaggaaggccccggaggagggucgucccugugcccaugcggucagaaaggccccggaggagggucaucucugugcccaugcggucagguuggggcugaggcacuuugaucauugcuccuccucagaguguucuuuuccuccccucucagauuauaauaacgagguaguuacagagugagcuccagccuagaucgucuggguuugaauccagcuccaugacuguggccguguugccuaaucucucugagucucagcuuccuuuucuguaaaguggguauaauaguagagucuacacuguggggcuguggugggauucauuguguucacacgugugcagggcugagaacagggccccaaacaggguaggcacaaugaagcaugagucagaauaauaauacagaugacaguuucucuaucacuaauuugaacauugcagacagugcaaagaagaaaauuagaaacugggaggaucacuugagcacaggaguucaaguccagccugggcaacguagugagaccccugucucuuuuuaaaaaauuuagcacaauuuauuaaaaaaaagaagaagaggccgagcaugguggcucacgccuguaaucccagcacuuugggaggccaagguggguggaucaugaggucaagagaucaagaccagccuggccaacauggugaaaccccgucucuacuaaaaauacaaaaauuagcugggcgugguggugcacaccuguggucccaguuacuccagaggcugaggcaggagaaucgcuugaacccgggaggcagagguugcagugagccgagauugcgccacugcacuccagccuggcgacagagugagacucugugucaaaaaaaaaaaaaaaaaaaaaaaaaaaagaagaucaaaaccuuuguugcuacguugcugcucaggcacauggagauagggaaacgccggaucugaguauuauggcccuuuucacuuaggaccuaucaggagcacuuugucgugcuuuuuaaugacugaagacagaugacaacaguuucuuuccucaguugcuuauuuucauauauuuaaucuguucugaaaauucagcugugaagaugcuuucuuauuuaaaugacucucccucaccgcucugaaucaaagcucuggcacuucucugagcaccugcaguuggagccagucuccaccuucuggacugucuuagugacuggugggagcuuuguauccagagcccucgagguuaagaguccagcugucccucaaccucagcgucucaguucacccauuggaaaguggugaugggaacagcacccuuccuugucggacugugugaggauggaaagagaagauaagaugacgcggauaaggugcuuagcacagugucaggcaccuacucagugaaggcuccucauuccaguuauguguauuuauaaaacugacuguauuaugucguagcugucuguauauagcugacuucaucguggccuucuggaugcaccacuuuugucgcucugguaccucggacagggucuggcauguauuaguugcuuaguaaaugcuagacgagugaacaaauggauaaaacacugauguguccacuacucaagugcacaccauuuaugucaugaaaguugauauuaaugagugauaaacuaaaaaauaaaaguagucacugcuuuuuguuuauugucccguaguuuccuagggcugccaggucagaugaccacaaacuguagguggcuuaaaacaacagaaauguguugucucacaguucuggaggccagauguccagagccagggugucagcagagcugugcucccucugacucagguggacucuuucuuggccucuccccagccccgggcuugccagcagucccuggcgugccuuggcuugcagcagccucacucggaucgcugcccccaucaucacaugacguucuccccauucuguguguccagauuuuccuuuuuuuuuuuuuuuuuuuuuuuuuugagacagagucuugcucugucgcccaggcuggagugcaauggcauggucucagcucacugcaaacucugccucccagauucaagggagucuccugccucagccuccugaguagcugggacuacaggcaugugccaccacaccuggcgaauuuuuguguuuuuaguagagaugggguuucaauauguuggccaggcugguuuugaacuccugaccuugugaucugccugccucauccucccaaagugcugggauuacaggugugagccaccgugccuggccgauuuuccucuucuuaugaggauaccggucauuggauuagggcccaccuuaaugcauuaugaccucaucuuaacuugguuacgucuguaaagaccccuuucuaaauaagguccuagucacagguauuggggauuaggacaucagcauaguuuggggaaggacaaaauucacucuguaacaccuccauauacagucauguaccacauaauguucugguccacagugggccacguauauaacagcggucccauaagacuauaauuccauauuuuuacuguaccuuuuguacguuuagauacguugagauacauacauacuuacuauuauauugcaguugccuacauacaguauucaguacaguaacgugcuguacagguuuguagccugagagcauauagcauagccuuggugugugauaggcuagacccuccagguuugugcaaguacaugcuaugaugcucgcacaacaacgaaauuccccagcgacacauuucucagaacguagccucaucguuaagugaugcaugacuguauuucagacacugcugggcuuuuuguuuagauuuuuaaaauuauacuuaaaaggagaguguugguuucccucuauaagugaugguucgauucagcaaauccuaaaaggaaacugcuccccaugacaggcacagcaccuagauucugcagcagguauaaacacuagacuccgugacaggugugacacuagaaucaaagacacaucgcugagccaaguccccaggguggagacagguccacccaagaggaguccugccuuggagggauucagaguugcugggaauugagcagcucccuggucucgaagugcacaugauuuuaauagaugacuuaaaugggaagaaaaggcgacccugggggcgccaaucccggauuggcagugcugggaucggaggcucugaucacugugcucagaggcuccuuccugcaucuacaguugugcggagugcacgugacgcagguguggggaaagucuggagggccaggguuccgcauccgagcuccaccagggaacugcuuuccccaguuaagcuuuuguagaggcugcggggcaaacccaauuauaauuccaagaaaggagugaugccccauccagggagcggcauguuuugcaacccggguauggaugaaaggccccuguugauuugagaaacacacaggucaugggaggugccuguggcugagcccgugaggggcagaaaccagaguccguagaggccuaaacaggacauuuaacugaggccugggcauuuuacacuuccucucugucaaacagcuuuuucccuuggucuuguuuuaagcccuaggagauagguuuguuacuguaguucugauggugugaauuuuuggauaaguuuuuuuuuccuuagguuuaaacugagucuuccagaagguaguuuuauaaccugauguaacaguaaggaucuuuuucagagauuuuauuuauuaacaagcuaacaagucuuucacuccuuaacaucagacagauggacccuucaucuuagaguagagaagagcggggcccaugcccagagcauuucugucacuggcccugacaacugccaggcaccuuaugggucaagccugaggggcaggaauuccugcugggauucacagcauucaccacuucuugaauaaggcuuuuuuuuggagacacaguuucacuccuguuggccagacuggagugcaguggcgcgaucucagcucacugcaaccucugccucccagguucaagugauucuccugccucagccucccgaguagcugggauuacaggugcgucccaccauucccagcuagguuuuguauuuuuaguagagaugggauuucaccagacuagucucgaacuccugaccucaggugaucugcucgccucggccucccaaagcgcugggauugcaggcaugagccacagcaccuggccuaggguuuuuaauuauacauccaccuccaguugacacggccucuucuuucaccucugccuuuuccucagccauccagccaucccuuuggaaacauaccuccuuccuccugaggggcucagcagcugguuggggagacagacaugaaaccaauuuuaguagagaaccccguguaaagugcuggcauggccaaugcuggggucuucugggagagcagggagggauguagaggcagagggaaggccuccggaggucaagacacuugaucuggaucuuaaggaaugagaaugaguuuacccggcugaaaaaaguuagaagggauauaccaagaagggaacagugugaguaaaggcagggacguguggaugaguuugaccuuucaagcacagaguaucuugggagugagggcaagaugugguuggaaaagugaguggggaauggaguguggaguauaucaugcuaaaggguuggaacucuguggugagagccaaugaaaaguuaaaagcuggcugggugcgguggcucacgccugcaaucccagcacuuugggaggccgaggcggguggauccugaggucaggagaucgagaccauuccggccaacauggugaaaaccccgucucuacuaaaaauacaaaaauuagcugggcaugguggugugcgccuauaaaucccagcuacucgggaggcugaggcaggagaauugcuugaaccugggagguggagauugcagugggccgagaucacaucacugcacugcagccugggcaacugagcaaggcuccaucucaaaaaaaaaaauaaauaaaaauacauuaaaaaaaaaguuaaaaacaggagaugggggagggggcggggaaugcucacaccuguaaucccaguacuuugggaggccaagaugagaagauugcuugagcccaggaguuuugagaccagccugggcaauauagugaggccuuguuucuacaaaaacaaacaaaaaaaagcccccaagaaccaaaaaacuaauaauaacagaugagcaaaaaugacaaaaaauuagcugggcaugguugugcgcaccuguaguccuacuuacuggggaggcugaggcaggaggaucacuugagcccaggaaguagaggcugcagugagcucuuacuauaugacugcacuccagccucggcaacagagugaaagagcaaaacucugucucuuaaaaaagcaagagagugcuaugagcagauuuccauuuuagaaauaaaaaucugugucuccucuuacuguucuuggcauggaucauuuuacacccaaccauacagccuugaucuuucuggccagguaccaugaaucuauuucucucugcuggccgaguuggcccuaucacaccuucagcaugagguggagagggaaaaaggaugggcucugguauccccauaaugugggcaacugucuuuugcucacgagaagcugaagacacggguucucucuguuguugcagaaggagaccuggaagcuuucacaaccccucauccucuucuguccagcagaccuuuuguccuugcuggcacugaacauucaaccccgggggaggcugaaagcucugcuggcucccuucucaucaagagaggaaaauggugauaggaugaaaaauccucccgucuccacagcaaccucuuggcuuagccucacgauguacugaacaaucuuuacuuaauuggaagggauuucggggagaacagucaagacaaagucauuggcaaccuauuccuggaauuagaacgcaucaccuucuuaacuuaauuggauaauucauuuuaaauugggcgugcaaucacgacaagaaaauguuaguauuaauaauacauaucugagaucaacugccucucccaagaaaccuggcccugguggaauucuuuaauuccuccaaaauaaauuuugcaaagauaaaaugauguugucaaaguggagaaggaacaaacauccagcaggcauucauaucccagaacuuucuagaacaccucuguuggucauggaauguuagggaagaccuggacucccuuugggguguuuuaucgaucgagggggcccucugugcccggcccugggugugaguguugagggccugguguguuuuguuaagugucuuucuuuccuaccauagcagcuauucagaugguuggaagcauaacagauggcaaugggcuauugccugggggcgcaggggaugaccagggccucucucacaagcuuggguccuggaagcugcuuagagaccuguggaguggcugaaccgccucauggaggucuuccaaucuggucacauugugccgggagauggcagcugguaucaggggaccaggcugcugggagcagggggcugcguguugacugaaggugcugccugucuugcacgugcuuccaggccagcuucccuguggcacucaguguucccccaaaauagggcaguugcuaagaaacagggaugagccagaggcccgggagcgccgucaacacuguguugaugaggaugcuucugcgccaggggcucggcugccaaagcucuugcggccuugccagauccacuuacgucaggcuguugcccaagcccacaccgagucugcguuugccagcaugagcguuccugcuucugggauuugagcugcaggaaaauuuagugguuguguagacaaacucacaaaaacuccaacauucacagcauagcacccaccacccgccguccacccacgccucagcugcuccucugcacggccucucccccaccccugccugugcuccuccacggcucuucucaguuccuaccccaaauuuguaacauaaaaaagagaugcuuacgugugugcagcauuuuguuuuaagccaggcacugugcuagguauuuuuacaucuauuagcuuauuuuccaauuugugaugcaccagugcugguggucgauauugagcccauuguagagguggggaugcugagucuccaagagguguaagucacggacucaagaugcagcagcagggcgguggcagagcuuucagacuaagaguguugacccccaaggcccaugccugggcuuccaaagcuggagggcgacacagcuccagagcccugggcccagacuugaguccuguaugcccaguacugcugaugauuaccccaagggcagccagggaggagagacaggcccccgguauuuuuuaauugaaaugacaguggaaaaacugcuggcaagauuaucugagucagcugaaaaugugaguuugaguggccccggaauaccccacgcuuccagaagacgcuuccuauggaaaguacuggagcguggcacuccucugcgugugcgccucccagcucucggcggccuccaggaaggaguccaaacucccuucaccaucucaccccaacccaacugccuucccugcacccccacagccgccccccaccccagcaucuucucaggcccccuccuucccccugcccuucuugccuggcucacuccuggccacccuucagacuccucucucugccuccuccagcuggcgccucacuuggugauggccgugucuguuccauggccccucccagagggacuugguuucuccugcugucauugcgucucccuuacggggccgcaugcuggguuuucuuaccauuuccugcauccugcagagccgagggcguggcagcaccaaucaaguguaguaggaaugaguaggaaacaagcauccuucuccauggcacagaagggagucugucaccuuggaaagucacucaagagaggauccaagaaagcgucuugcccuaccuaccccuccuuuagcaagugaggaucuucgaggggaggggaguuuccaagucaacuggugacaaagccaggaugagaagacacucccagaccaccuguggcuaaugacacacacugcccggccaugccaucugccagcgcuggagguggccgcucaacacaggaaggucaaggucaguguuagcagcucccccacccagcaggggaaagggaaagacuugcacuggggagcaguuuuauuuauuuuuauuuauuuauuauuaauuauuuuuagauggagucuugcucugucacccaggcugaugcaguggugagauuuuaguucacugcaaccucuaccuccuggguucgagcgauucuccugccuuagccuccugaguagcugggacuauaggugugccaccauacccggcuaauuuuuguauuuuuaguagagaugggguuucaccauguuggccaggcuggucucgaacuucugaccucaguugaaccaccugccuuggccucccaaacugcugggauuacagguguaagccaccaccccgccugagcagcuuuauguucuauguuauuaacacuuaaaaggccuuugaauaaaaguacccuugaguguuuaaggagagccaggagggagacaggacuccagguccagccagcagcagcgcccagccaagaaggcagggagaaaaaugcugcgaacguccagucgaauccucccggguugggguguccugccaggccagcaagccagcacuucucacuagcacccucagggugccacguguacucaggcagcagggaugaagagcgccucaacuucaggcuggccaaauuuggugagauaguucacgcugcaguuuaccggugccagaaagcaaagaaaccucaacccaaaccacaagaaaaccucucccgggagccgacagaguuggccuguucagagacagaguuccagccuuuguuggcagcacgucauucuuagaagucuggaaugggugugaguggguguguacgugugugugugugcacacuccaaaguucggcuuugcacaagggacagccuaggcuccaccuuacccggugccuguaccaucgcagugggaagggcuaguugcaccccaguggcggccccaggcugugccuccucugccucgcugaacagagacaauuuuaagaaagggguguauuaguuucccagggcugcuguaacaaaugaccccaaacuugguggcucaaaacaauagaaauguauucucugaagguuuuggaagacagaaguguguaauccagguaucugcagggccccgcucccucugaaggcccuagggaaaaauccccccuuccucuucuggcuucuugugggcuccagccacccuugguguuccuugacuugcagcugccucacuccagucucugccuccacgucccaugaccaccuucccugugugugucuuucugugucuucaugaggacagaagccauugauuucagugccuaccucaaauccaggaugauucugucucgacaucuuuaaccaauuacaucuguaagaacccugcuuccaaaucagaucacauucuaagguccuugguggacaugaauuuggcagggacauuaaacucacugcagcggugggugggggaagauugccuuggugagaagcagcucagguuuaugggucagaggagcccuuucauaagaugcucuuaaauagcuggguguggcggcucacgcuugucaucccacuacuuugggaggccgaggugagaggaucguuugagcccgugaguccaggaucauaagaugcucuuuagugggggugggugugaggugagccugccccccagacauuuguagcagagucucuuauggccagcugacugcucacuguccccucugcuucaauggcagagacagagcagaggcaggggaugucacacugcauccaagccacugaggggcacuucaaggacagaagcuggcuucacuccuucuccauuccucagagccuggcauggggccacccauaggagaguguguauucaguguucacugaaagccaggugugguggcuugaaccuauagucccagcuacuugggaggcugaggcaagaggaccgcuugagcccaggagcuccaggcugccguguguaacagucgugccugugaauagccacugcauuccagccugggcaaugccagcaagaccccaucucuaaaaaacaaaaacaauguuugcugaaagaauguuugcuugucggagagauacaguaacuacuuguucuaacuuuggagaaaggacacuucggguuucaugucaggaaggagugagucagacuguggucuggaagggaacccaaaagcaggaguugaagaaaauguguuggccaggaagccgcggccuggagauacuccucugcuacuuguggguguugugaacucagcugggagccucgggucucacaucugugaaguggguaucaaagcguugugaggcuaacaugagauuuugugugagccuucuguaaacuguaaaguaaggugcccacccaagaaauuuuccuggaaggcagaauaaaaugaaaagugugauauaaugagcaguguguacgauuagauuauugcaugcuaagcaagauucacugggugagggucauguuguaaggaccugugugagugaggcacugacugcguugagucuuuagaaaaaauuagccuaugggguauuuuuauucccauuuuaggggugagcaaacugagccccguguagauguucaguaacuuucccaaggucauaguaagcagagaggcuggaauucaaacccagaucuguucaccccagcacuggguccacaugacuucuggcccgucaaggcuccuggccugugcccuugugugagcugcugcugggcacgggccuggagacagccgggggagcuuggcagugggugccaucaccgggcuguauaugguggacacgagcuuccuguuguuuuccugucacccucgucccuuggauggcaugccacuuauaguuuggcugcucauguccagucugcugcacugggagugcugggucccccgugccucauguuagggugucccuccaaagcaggcaccuucucuacccuguggauuggcagaggcaguucuauuucuagguaaugaauggaccuuacggaagauuggucucuuccgcccgaagagcuagaaauaacuguucucaagcaaggcccaugcuuucucagcacagagcugguuuucccaggcacucugcaguuaaccccacuauuacucuggaaugcagagaccccuuggcccugucggauuuacuuuaguagcagccucugcuuccaaaugcagcugcuuucuggaagagggugugguaguggaacagaaauggcuuaggucuuggcacuagauacaauuggguucaaacuucggcuccaccaguuacaagcugugugaccuugggcuagucagcuuuuuaguuccuauuucuuucccuuaaaaagucuuaauuugacaaguaauacauaucaaauauacauucuuuaaugugaaaauacacauaagcaaaaagaaauaugaaaaaucacuguuaaauuuuaguauaccucuuuuaagauuaauuuuucuaccuccuuuuauuuacacauauaugcauauauacaguagaaaacauauaaauauauaugcaauagaacauuuuuaaaauaauggaauuauucauacuguuuuuuuuccccaccuaauguauauuuaaagguauggggaaguguuagcaaugucguguccccugaaguagcuacgugguauuccauuguauggcucucccaauauuuaaccuacccccaggugguggacaguuggauauaaccucacuguccagggggaccuuggcuucuccaucucugcaaugggauaacagugcccauccugcaaggcagcugugugugcucagcaugcagcuggcccucauaaaugcuggcuucuuuccuuguccuuucucuguacugguuccuuucacguaggguaucuaccacgauaaaaugagugugccccaaauaaaugcauugucucgugugucugcucagcaccugaacagguuccugccucgggucuugcugacaagugcgcagggccagcagcuucccguuggccucucccaggaacccugagcagaggccugagcccaagcagacgcugcaaggcugcucuucucccucccagucugggcagcaugguuucugcucugagaagccgccgggagcaguugagaugagcugggugccugguuagugucugcaccaccuuucggggccugacauguggcgucucgccuguaggcugcggccagcaucuaagcggagcacuuggaucuagcaguuauucacaucugcggcuccgugugucccccuccuagaaccuccccacaacccccaaauuaauuggauuguguaagguuuucgucacaguggaugucaagugcuggccguguuaggcacaauauaauauaagccuuguaucuauuucuugucugaaccuaacuaaauaaaaacaucauguuucccugcucaguugagauauguaaaccagauguaauucugccugcugugcaacugaucauguuacccagaacuuuggacaaagcuagcagaauaugcgcagccuucugugaggguuaauuuugucuauuaaauugucauuagggcugacacagggugauauuuauguuuuguucuguuuuugcuuaaaugggaguguaaaaaugaugauaauacuaauagcuaguauauguuauggggcuugucaugcguggaugcaucgggcguucugauagaagcuguauauggaugucucauucagucccaugaggcagauggaucaguccccauuuuauacaugagaagcugaggcauugaacucaggcagugacucuggagccucuccuuuuaaucccugcagcagucuuugugauagggucaaguggguauuuauuggaaagguccccugcucugucccccuuacccagugcagggguuaagaagggccuguuuguuaggaaaagucuucagcacaaccgauccugcuugcuuacugagcugcugacauucucaguuuugagaacgagguaggagaguugcagaaucagagggcaggagcgcuguguuuccagggugcccugaaauggcagaggauccaggggccagaccagaaugacgaggaacucgccacaggccuggcuccucgcggggaggaaaacggaagaucagauaacaagacuaagcacgugaacuccagaugcauaaccuuggaucaaaauuggggugccagaccagaguggguggacagacacaugcagcaaauauuugccacguaaauggaugggugaaauuauggcucauuaagcucucacgggaggugugagguuguauguagcauguggaguuugcauauggccucuaauaucugccugggaguuuucaguuuaaaaaugccagcaaagaagaacaagcagguauauguaugggauacacccacagggagcuuuaaccagccuaagaaugagccguggaaaauugugucuuucaugccuguggcuuuaugccugggucaguucuccuuauaguugguaauucauucaacaaacauuuaauuaacucauuuaaauauaauccuaauaacaucaucaagaagguaaaucuaauuccauaugcaucuuuucauuaccuagcacugcauaugcuuuuuuuaaauuacaaaacuuaucgaaauauuucucaucuaucuacuauuugagauuauuuacacagacuccuuccucuucaaagggcacaguggagcguuuguguguguguguguguguguguguguguguguacauauguaaacacacuguggacagccauaccuuuucuuauagguagguaugccuguaaccugucaggguaacagacagcacugaaauggaaauggaaauaugaccugcucucuuggcauuuucuaugcaguuaaagugaaauaauugagggauccugucacgagauccugucaugggcugcugucaugggaugccuugguccccagagguggcuggugaguugggaaggguucuucugcacaggucugcccggaauccugucccaaagggacgacuugcccuuuaggcuacuacugcauucucaaaauggcaacuuggacggggugagggauuaauuuugguaucugguccuccucuuuugccuggaacugccacugggcucuguuugaaggggauguugcuuuuuccucucacuaaaauuggucccauccuugcugcccguaaccucacauggaaugccugccgggcaaagaggcagcccuuuugcaaauacguauuuaaugggaaauuacaaagagacuggucccacccauguaagagggaagcggauguguguaacacucuaaaaccacgcuggagaugcacucagcuccacccgacacagaccagcaucgcucagguuaccaggcaacugugagcaacaaauacuugugagucugggauugaaggggguggaaacccgacuuuuucuaaauauccucaucacuuaccauaauaagagcccuuacccaagugugcuugugucccgggcugccuaaguuggccugaaucuugugucacccuucauaguagccaagaccucaggagucagauugccuggguaccaucuguucucuccagguacaagcuuccaacaguguauaauuuauacuuuccgagccucagcuugcuuaucuccaaaauggggauaauaaucauuccauucucuaagaggauugagugaguugaugguugacagguucuuagaagauagccugacaaauaauacgugcucagcacauacuagcuuguauuauuccugacacugagucuucucagcaaacucuuggaaggaaacuucccucuggaagccacagagagaucuucaaacauacauggcgcugcuucugggggcagcccuggaagauaaggaagaaggggcugucagugcagcugcagggacacacguccucugagcccagguuguuccuaauccuccagccgugggcaccgcuguggggggcuuuccuuaccagcuccccucgucuagcagauguccccggugcugagucacugggcugcacugcucugacccacuuacuguacccgacccugcccucuucccucccaguuccacucuuuagccuucgacccuggcagguuuccagguagccagaucgaauccgucuuucccauuggucucuagagaagcaugaccugccucgguucuuuccaauggcugucacuuccuccuuuuggccagcuaguaaauugucuccauccccgucacugcguaaccuuuccccagaaaacucuugguguccucucugcucccccagcagaggcagcagcuacugaagggcccuucccagugucucccuuuuuacauucugaguaggguuaugacaguugcuucuagcuauagaaaguucccacugucuuccacuuaaacacguaaaauacuuaagauucuuauauguucuuuucuuuaaaaaccagcuucauuaagauaaaauucacauaccauacaauucacccauuuaccauauacaguucaguggcucugaguauagaguucugcacccaucaccgugacccacuuuagaacauuuucauuaccuccuuccuuccaccccucucagcccuagguaaccaugcucuacuuucugguuuuuuguauagauaucaugauucuggacauuucauauaaauggaaucauaugugaccuuuaucauguaauaucuggcugcuuucacuuugcagugaaucauagaauagaauauucuauucuauggcucaugccuauaaucccagcacuuugggaggcugaggcgggcagaucaccugaggucaggaguucaagaccagccuggccaacauggugaaaccccgucucuauaaaaauuaggcagggcgugguggcucacgccuguaaucccagcacuuugggaggccgaggcaaggcagaucacgaggucaggagaucgagaccauccugacuuacacggugaaaccccaucucuacuaaaaaaaauuagccaggcaugguggcgggcgccuguagucccagcuacucagaggcugaggcaggagaauggcgugaaucagggaggcggagcuugcagugagccgagaucacaccacugcacucuagccugggcaacagagcgagacuccaucucaaaaaaaaaaaaaauuagcugggcaugauggugggugccuguaauuccagcugcuugggaggcuggggcagaagaaucgcuugaaccuaggaggcagagguugcagugagccgagaucacgccacuacauuccagccuggacgacagagcaagacuccaucucaaaaaaaaaaaaaaaaaaaaucuaugauucuguuuaaugaaauugaggcccauuauguuauguuuguuccuuacuauuccaaacaauauuccuuauuguucuuacuauagucuaguaauucauuauuccucaaauaaugaauucuaggccuuggugcagagcuucauucuuuacuacagcuggauaauauuccauuguaaggacaccccacauuucauuuauccuuuugcugguugguggacagguggguuguuccucauguucuuuuuaacacagcaaggccauaugaucugucugaggcugccuuucaguucccaaccauuuuuugagcaggagagacauuuucugucauuuuuaucacagcccuugguuauuucuugauguguucaugaauguaaucccaacuuagacaugauguuccaaaccuauaagaaaauuagaauuuuuuuuuuuuuuuuuugggaaagaagaaacaguuauuuaagacuuguuagaauaaaugauucagauccuuuuucuucuguguuuuuauuuuggcucuaaauaaaacauuuauagaaguuugucuuuuguguaauuauuuaggcucuaaaaacuucacucaguuuagaugaguguucaaacucgcugagggaaaaaaauaaaguuuuuccccagggagaaaaauauuaugagcuaaaacuaaaaauaacuuaaaauuuuagcgaaggaagcauuaacacaccaggccagcacacuuucuuuuuaaugggaacugacccugggucagguggguccaaugacacccuuauuuaauuuauuuccugcugggagcugauuuuccugggcauguucugacccagggcacucggcagagacgcugcuaacaaaguccagguggaaaacaucugaguuucccaaauuucucuaaagguuuuuaagggcuguucagcuucgaguagcagcgugagugugaggucgcuggcguaaaugagaccccgcggguuaaguugcaggugggagcuccaggaugcagcaagguggccgcggccacuggaacuguuguuuggccuugacucuaaucuaaggugcccugggcgucggccuguaugcuggugcucagugagguuucuccaugacucuguaugagaucuccugugcugaaugggacccuuaaaugugcccuucgcugccaucauuuaaggagggaaaaggcaaaucagaaugucauaauguaaaggauggcaggcaaacacauguuuuuagaaccacacuaugauuucaaaaggcacaucaacauucaguugaauuucaugucuauugggggaucuuugauuucucucccccuaaauuuguguggggaugugaaaaagcuuacgcuuuagaaucugucgaucuuggugguucuugggcaaaugacucuccaucccugggaucuuguuugugucagaaggaugacauccuccaccuccaucagggcuaauguggggaucuaaugaggugccuuauguacaaccccugguacagaagagaggcacucaaucagagcugcuucuaaagcucuucuacuugaaaugaucuuuuuuuaauccucacucauacccugguuuuagguggaauaguuucuaaggaaacagaguccuuuucccauaggauggugcuggguuuuugugcuugagagagaccaucuuugucucucugagccccuuggacgccaagaugcauccacagggcaaggcacacgcaagcauuugguagguaaauauagaacccaguggguucggcagggaauuaaaguauccauuuaauaaaccucaagaacagcauagccuuuaauauaaagucccuucucccaaaggguugcaaaaacuuuugcaaugauuauugcuuuucauuuauagccuaauguuugaggacuggagccauaaacugaagagccagaaguagacgcuagcaacuaaaaauacugucaaugaaugucacagauauccaaaguagacaauucguuuuccuuccaguggcuuucuuggcaaaaaaaauaaaaauuaaaaaggaaaaaaaugacugaguuaagaaaacguuguaguguuugaugaugauaacuugcauuuuauaaugcuuuccagcuuacagaaugcuuucucauuauuauuucauugaauucuucugacucgcagagguagguaagacaauacuguguuaugguucaggacaugcugccucuaccacuucacuuccuagcagguggucaugugaguuagggaagugcucuaagcuuauuuuccaaauuuuuaaaauaggagucacaacaccuuccuuuuaggauugcuguucagauuguaugagauaagauaugaauaaucccauccacauaguaaaggcuucauaaauggcagcuguuacuauguuauuacauagaauaauccucacucggccaagguugggggauugcuugaguccaggaguuugagaccagccugagcaaccaagugagaugcugucuccacaaaaaauaaaaauguaaaaauuagcagggugugguggcauguaccuguagucccagccacucaggagguggaggcaggaggauugcuugaguccaggagguugaggcugcagugagccauguucgugccacugcacuccagccugugcgacagagugagacccugucuaagaaaucaucaucaucaucaucaucuuccuuacuuuacagacgaggaaacucaaaguggcacuuaauuugccaaagaucacaaagaucuaguaauggcagaacuggaaugcacaucuaauucuacuuccaacuucauuccuccuuccacuuuuccuuagccaagaauguaaaucaggaacauuuuggugcuucugccagcgacauuuaccauuaucaugagcucuuacaugguuucucgggugcacucagauuuucaacgucuacuuuuguauuugcagaacaucaucaagaaggugaucgggcagaaguuuguguacaaguuugucucuuucccggagauccugaagauggauccucacgcgguggagaucagccgggagagccuucugcugcaggacagcgacugcaaggcgucuccggagggccgcgaggcccacaaacacggccuggccgcccucagaagcacgagccgcaacgaauacauccacucaggccuguacucguccuucaccauuaauucccugcagaacccaccagacgccuucaaggccaucaagacggagaagcuggaggagccgcccgaagacagcccccccguggaagaagucaggacugugaucagguuugugaccaauaaaaccgacaagcacgucaccaggccgguggugucccugccuuccacgucagaggcugcggcggcguccgccuuccuggccucguccgucucggccaagaucuccucuuuaauguugccaaacgcugccaguauuucauccgccucacccuucucaucucgguccccgucccugucccccaacucaccccucccuucugaacacagaagccucuuccuggaggccgccugccaugacuccgauucccuggagcccuugaaccugucaucgggcuccaagaccaagucuccaucucuucccccaaaggccaaaaaacccaaaggcuuggaaaucucagcgcccccgcuggugcucuccggcaccgacaucggcuccaucgcccucaacagcccagcccuccccucgggaucccucaccccagccuucuucaccgcacagguaagagucauuccugucaucuaagccacagccagcuucaguggcuuagcaaaaaaggaagagcaacuaaagagacuuccuucugucccucaaaacguuguccuaugacucguaccgaggucacuguguaaaugugaagggaagcugcuuuuccauccucagaccaaggggugcacaugagacaggguuugguuugucgacucuagugggaugcuugauugguuucuugcuuuuagcggccuaaagugaccauagguggaacacgcacacuggccgacaaagcagaucucaccagcgauuuccaagggaaaguugagcgggccaguuuacauuucgggaggcgcuugggcuuuaugaaauuuuuauggcagaaucuucucugggggcgcuuaauaaggagccacuuguguucuguuaacaagaaaauagaugucaacugaugccgccaucgcaugucaguguggagcuguggucauagcguagguaauaagaaacaaaggggccaccccaaacagcugcuucgcugaaagcagcacuacucugagaaagccccaguccacagcacuggcgagaggacagcaaacuugcagagccaaaaaagccuucguuguuauuagucccaaagagaaagcagccuuuuccuuuaaaucagauauucagaugcucuuucuuguccagcugacaauugcagugcaaaggcguaguaggugcugggaaaccauauuucuccuuccccuugaaaauuggaugcaauuuuaguggcagagguuaaaagaguauucguuuuagguucacagaccugcauucaguuccuggcuacccugcuuccuaggagugggacugugggcgguugcucucugggccagguuccauguguggaaaaugggaccauggacaggcuuugugagcuggggacaccugguagcauuguuaaccguggagcugcacccguccccugccucuguaaucucaucguaguugucccuguugucauuagcagcagccgcggcagcauaugacgggcuccccacgugugccaggcacugcuccagaugcuuuacaugcauugccuguauccacacuuacagcagcccugucacguggauacagguugagcauccuguuuccaaaaugcuugugaccagaagcauuucagaguucagauguuuucagauuuuggaauauuugcaugauacuugccaguugaauaucccacaucugaaaaucugaaauccaaaauguugcaaugagcauuuccuuggagugucaugucaggacucagaaaguuucagauucuggaggauuugggauuugggaauuuuuggauuugggaugcugagccugugcuauuauuaucauccuguuucccagcugagauaaaugaggcacagagguaaaguaguucguccagggucccacagccaauaggugguagagguggcuuuggauccagugucugccuccagaauccaugcucucaaaugaaaugcauucccgcugcgagaaggcagugucccugaucacgauggccguccauggagcaccugaaagcagcucugggccacuguccucuccacgcuuucucuggacuggauucugcccaggauuucaugacagcucaagccugugagcugguggugacgcgcgccacugcggagggggagggccaggggaucaggauauaggucagagugagcacgugugcucuuaaaucaggcaucuuccaguuaagcaaggcuguccagugaccaagggcugcugagcaaauggcucagaaacagcagcuccugauguagcucaggggaguaucuugagaggcagggccaggguagaugaucugagcaucuccuccccuggccuccuguguguuuacaacugucagggugagaaagguccgaagccaggccagggcugacucugauuuaggugucuguguucccugggagccuggaucaccuucucagaacagagugaggcagaugccagcccugucucagaggaagucagcucagccagcccuguggauaauguggauggagugguggcucccaucgguggggcugagggcgugagagaaggaucaaggguggaugcccaacaaauggaugcagagggcacgaccaggagccagaagccaccagcauggccugaaacuaggugggaaggcguaggaaagccaggaucuuuacaagaggaccugugccuuaggcagugagggugccugguccucagccaagcugugaggguggggcugugaugauuuagugccaggaagcccagaaaugguccugaggggagggaggcaacaggcagcaucuggacccagggcaggagaguggaaguaaagggaccuggcucagagagggccuucgggucaaaggaggaggaggggcaccaggcaguccucuaaaccacgcaaaacuaagggggucaccagcuacacugggagaugguagagccucgggacucagaccccacuuugaacuucccucacauucccagagugugggcucugcuccuggcauggccauggguggccaacagggagggagagaaggggcaaugagggagacaccagaggggcccgggugguagucaggggugugguacuuauucagaguugaguucuugcagccgguuucacccaggcggauucccugagaucagauaggauaucuugaagccaggggugguuuaggauuaggguaugucagugucagauuuggacucucagauucccuccccugggagcugcuucagggggugccccagaaacucacccaccagcaccagcucaguaguuugucuuccaggugacagccagaaacagcguggcucucaacagccaggcauucuguggaauuccuuucggccucaggagugaaggacaacugugggguucaggguguuccacaggcagcagugaggcuucagugguuuuccucuuaccugagcacuuugucacagaaacucuccuuuucucuguguguggggggugugcugugugcagugugaugcugugugcacauaaacauuugauaaucugugggcugucagcuuugcuuaguggugggcuuuggaagaggugaaagcugugugugcuguaauaacccgauacccugaagguacaaauuccgaagguugguuauuuccagcuagaaucauggcaggaagaaggggagaaguaagggagccuuggcauggccugugucacgugguuaccuuaucacaccucauacaggcaucccucauuuuacuguacuuugcuuuauuacguuucacaauuaauuggugguuuuuacaaaucgaagguuuguggcaaccuggcgcugagcaagucuugucagcgccagucuguucuuccaacagcacacacucacuccguguuucaaugucacauuuugguaauucucaaacauuuccaacuuuuuccuuacuauuaugucuguuauagugcucugagaucagcgagcuuugauacuacuauugucauuguuuuggggcaccaugaaccacaccuguauaagacagcaaacuugaucaguguugugugugucccaacugcucuccugugucaaacuugaucaguguugugugugucccaacugcucuccugugucucccucuccuugggucucccuauucccugaaacacaacaauuuugaaauuaggccaauugauaacccuauaguggccuauaaaguguucaagagaaaggaagagcugcgcaucucucauuuuaaauccaaagcuagaaugaugacggugaaggcauguccaaaaccgagacaggccuaaagcuagggggcucuuauaccaguuaaguauguaaauguaaaggaagaguuccugaaggaaaugaaagugcuacgucagugaaaacaugaaugauaagaaagugggacauccugauuguugauauggagaaaguuuuaguggucuggauagaagaucaaaccagccacaacauuccuuucaggcuaacccagagcaaggcccuaacucuucaauucuuugaaugcugagagaggcgaagaagcugcagaagaaaagugugaagcuagcagagguugguucaugagguuuaaagaaaaaagccaucuccauaacauaaaagugcaaggugaagcagcgagugcuaauggagaagcugcaguaagcuguccagaagaucuagcuacgcucauugaugaagguggcuacgucaaacagcuucacuguaggugaaacggccuucuacuggaagaagaugccaucuaggacuuucauagcuggagaagagaaguccaugccuggcuucagagcuucaaaggacaggcugagucuuguuaguacagcuugugacuuuaaguugaagccagugcuacuaaauacacucugccugugcucuguaaauggaacaacaaagucuggacgacagcacaucuguuuucacaguuuauggaauaguuuaagcccaggugagaccuacuacucagaaaaaagauuccuuucaaaauauuacugcucauuacagugcaucugguuacccaagagcucucauggagauauacaagaagauuaauauuuuucaugccugcaaauacaacauccauucuacaacccagaagucaaggaguaauuuugacuuucaagucuuauuacuuaauaaauacauuucauaaagcuacagcugccauagauagugauuccucugauggaucugggcaaagucaauugaaaaccuucuggaaaggagucaccauccuagaugcuauuaagaauauucaugauucaugggaggaggucaaaauaucaacauuaacaggaguuuggaagaaacugauuccagcccucauggaucacuuugaaggguucaagacuucauuggaggagggaacugcagaugugguagaaauagcaagagaacuagcauuagaaguggagccuggagaugcaaccaaauugcugcaauuuauugaucaaacuugauugggugaguaguugcuucucacagaugagcagagaaagugguuucuugagauagaaucuacuccuguugaagacgcugugaauauuguugaaaugacaacaaaggacugagaauauuacauaacuuuacauuacauuacuuaguugauaaagcagcggcaggguuugagaggauugacuccaauuuugaaagaaguucuacucuggguaaaaugcuaucaaacagcaucacaugccauagagaaaucuuucaugaaaggaauaaucaauugggccaggugcgcuggcucacgccuguaaucgcagcacuuugggaggccaaggcggguggaucaccugaggucaggaguucaagaccagccuggccaacauggcaaaaccccgucucuacuaaaaguacaaaaauuagccagguuugguggcagaugccuguaaucccacuacuugggagccugaggcaggagaaucacuugaaccugggagguggagguugugaugagccgagaucacgccaccgcacuccagccuggacaacaagagcgaaacucgcaucucaccaaaaaaauaaauaaauaaauaaaagagucaaucaauguggcaaacuucauuauugucuuauuuuaagaaacugccacagccaccccagucuucaugacucugccuccuugucccugguucugcccugcuuccuccccugucccuuucuguagcuacccuaggcccccaugggagucuccauuuugucuccuuuuccguaggaucagugcuacagacuucugugggauuaacucaccuuuuaaagaccuuaaaaccaugguuucacuugaauucagacaacuuuaggagcuuccagagauucagucaccuuuuauuugaggacauuuuuuuaaccucaagguggcauugucauggauucuguuggcaucugugggagcuuaggauuacagauauuuguggguacaaccugcuagacaucuuguuucucucuccuuuacuuucuuagagacugagugacuuaccgguaucucagaucaccaaaucaagugaucagcaaauacuucugcaucuucuuuaaucaguccaguaacaaauguuuaucauguauucauucauuugggagauaaucacugaaaacuaagcauucgcuuagauaccuggagauacagagguuagcaagauagaaaccguuccuguucucaugaguuuacagguugcuguccagcauacggggcaauauauaacauaggguuauaauuuaggguggugugaaauuauggaggacccugagaacuggcuaaggaauuuugacuuguuuggauuggaaauuaacugcuagaggcugggcgcaguggcucacgccuguaaucccaauauuuagggaggccaagggggcggauagcuugaggucaggaguucaagaccaaccuggccaacauggccaaaccccaucucuacuaaagauaagaaaauuagcugggugugguggugcaugccuguaaucucagcuacucgggaggcugaggcaggagaaucgcuugaacccgggaggcagagguuacagugagccaagauugugccacugcaccccagccugggugacagagugagauucuaucucaaagauaaauaaguaaauaaacagcugcuagagguauaagugaaaaaaaucucauuagaaucaacaaauaauuauugagcaauaacagagccuagaaaggacaccaaaacuacaguugcuuguuuuuaugaccuuaggaccuagccaugacaacaaggcauuacaagugcacacacacacacaauagcccuuggcaagagucaaacaugcagcacagagaagcgcuuuaggagcugaggggcaagaucguuuaguucaggucaacacacaugaacugagugcccaucaugugaaagcugcuguguuuggagcuggggcuacaaacguggauaaaauagucucugauaguuaggagcucauaacuuaagucccuucaucuaguaucucaggugcaauacaaaaggaauacuaaguugcaaaaggaauccuaaggaggaagguauuaacuuugccugagauggaggaagaauguccagagggcuuccuggagggggugagaccacugguacaggguguugaaggaucagccuguggcaggguagacagggagaggaaggcaucgucggcagaggaacagcuugaggcaaggcauagauacgugaaauagcuuugugauuaggggagguauagcaauaggaagcauugaagggguaugagugacagucugaauuguuuuaggaaucacccugcuggcgagauugggaagggggaaggcuggauccaaguaggaugcuauuggaauauuccaggcgaaagaccaugaguaucuaaggcuguauggugggaggggucagagggauggaucugauguugggagugccgucagcaggaguuggugacugacugggugggaggaguggggagagccagaauugagugugaggaacaugggaggaagacuaagcucccugggaaaaggcuaaacguccagucggggccaugcugaguuugaggacccugcaggaaauucggguggaaaaguccagcugcaucuggagagcggagaguguuuuggagccggagaggaaguuaggcagucaucaacacgcaagggguggugaaaccaugggaacggaugaggucacuuguggagagggccuguagcccagggaacuaugggcugggcuggguggucagggaaguucugagggagcguugaaggacuguuggguuagaaugccuguuccuccgugcauaugaggaaagcucaggacacaucaaagcaaguaagaggguuuggggagggaagugucuacgaagagucaaacucuguaaaauauuugaagagauuuauucugagccaaauaugagugaccauggccugugacacaguccacaggagguccugagaacaugugccccagguggucgggguacaguuugguuuuauauauuuuagggaggcaugagacgucaugaaauugccaggcaacuucaagguauggcaaggaaauauauuuugggguuaaauauuuuuuccucguuccauaauguuacuccagagucagauugaaaaguaagucaccauauauagggucaaauaaaacccaucugaugagaauuuacgguuuguagggcaugacucccuagaccccuagguaggaauuugggcaagauaaaaaaugagagcuuaguccucagaaguuagcaagugugugaacccagauuauggggaaccucaaaucuggggcuaaggaggacaucacauccuuucugaaauggugacugaauguugagugaacucaguguuugagggugguugauuuggcgaugggguacagaauagauggggagaccggaggcagguggacuggccugggcagcuguuguggaaugccaucuguaaggugauaggggcuuggaugcagcaggaauggaaaugagggauaaacaggagacugaguugugggacuccuccagaggcuauguccggagcuugcaguuaucggaaggcauuuugcaugguggggccugggaugcgggugguaaauggggcugugcaugcaggguuuaugucuuguuuuauccucaucuguggcaccugaaacauaguuugcacucucggucaguauuuauugaggcagugccuacacggugguccuguugacagaaggggaagagucuuaagaaacacugauguggaaaggugcugagcuucaugaaguuggagcaugguggggcauccaaguggagaugcccaacaagcgauaagccaggggggacccagcuagagcugcagauggcuucaguucauugguauuuaggagaugaaaguacaggaggaauaaagaugagcagauaccuuaaaggcuacagaaagaauaagaaaaaugugccaaucaccauaauaggaggcagaacauguuaaauguuaagaaaaaaauggucacaaaguguuacaaagauucagaaauaagaaaucccaucugguugaggggagaucaggaaaguguccuuggaggagguggcauuuugaugggcagaggaaggcaagaggaggaggcagcgggccggggcaggggugcacaggugggcaugccuggaugccagcucacccuggcgagcucagaugugcaggcuuuuuaggagacucuaugaaguggaaguggaagaugaacugaguggggaaaaugaaaaggggaucuugggaugagggucuuacucuuugcaaaugcauugccuguggcaucuccuuucccagcagccgugggaucaggagcuccuuaucugccaugcuuguuaaaacgagacugucuuuggggaaggaaagaaaacagcacuuuuugcuguggcuucuuuagcccuuggcccucaggcucagcccacucugccugacuccaggagcguguggagagaggcugugaagucucacacugucccggagauaacccagagcagguguuauaggaacuuuccuuaaaaaagcaaccacaugguucuuuaaggccacaggauuuucagggagaacuucagggauagaagggagaggagggaaugaaaucauuuuacaguguuuauuugcauauauuauagaagacauuucagacauauuaaagaugagaaacaagaaggcuacaguagucugaguacauccuguauuccuaagaaacaaaugugcaaacaucucaaauccagacauggguauacguuuuagaccagagaaauagaaauucuagaccuuguacauugcuuagaggauuaaaaaggaaugggcauaugauggccauggaggagagaaggauagcuguguuuugugguuuagaagauugucucuuuaaagcuuugagagccuucauugauggauaaacuaggaggccuugaacacacugguuauuaaauguuaaugugacauauugagguuggaaccuugcuccagaguaacaugcaaauauuaguuuucagaacaccugagcuuguggccuugagccuaacacaacugacaguagccuccaaguccaggcugacucaguugaguuggucuguuucagaggauuaaguccuucucuguauacaguugagaauuucucccucacauagaugaaguacguuuaguaaguaugucauguauacuuucaauuaauuaccaauccauuuauucauucaaaaacauguaugaaguaccuagccagauaacugccucuggcacuuguugagcauuucuauaugccaggcacauaucuuauaagagcuugcaguagaucagcuuauuuaaucuucccaacaacccuguaacgugggcauuuuuauucuccccauuuuacagaugaggcaacugagacagagagagguuagguggcuugccugagguuaccuggcugggaaguagugguucugagauuggaacccuggcagagcucaugcugagccgugaaguuuuaacuguuaggccagauggccuggcaugcuugugaaauugccuuggacuagaacaaaugggaagcuuauucaaaacauguauuuauucuaguaaccucauaggucauucaguauguaggaaaugccauggaaccaacgacucaaauaauuugguauaaauguguuuacauuucagcagcuucacaguuugaggaacuuuggauguuugucuccauucugcugaacagagcagaccuuucaauuuagguuuaagccaaaugcuguugguaauuaaugaugcuacggaggccaauucuaggaaaaaauaacacuuuagcauccagcauggugcagucugaaaggcuggcgccuuugcugugguucuucuuacacaaagcaccuuauugacaucacaaaaccacugagggacuccuucuagucaccaaagguacaaaaccacccugggccggggaguuugucuccacugagaauaaaagccaugcagacuuagcagcugggcggguguuucuucugcccuccugcuggcuugcaggccaggacuccugcugugugugugcaagaaauucaguccuuggaacuccccugggaaacccaggguuuuggcuuuauacccaaucugacaagaaagggcccucccugcccccacccaaaccauugccagggcaaugaauucucaucaacuccacauccggaaggaaucuggaaaacccggcucagagcuucugaagaggcugcuacaggguauuuuaacagcaaaucccaaagccuuaacagcuguugauauggagaccauuuaaaaacguguguucguaacccaaguaauagauguccacuguagaaacacaggaaaauauagauaagaagaauuaaagccccuuuaugggauccuauuuuguuuguauacuaauccuuguuuaaucugggaaggggaacaaguuaacaaaccauucggacgaaaguugauacaaacuugaauuuuccaccagaauguuuagggaagguaaugugucaauaccuuuuuccuuuaugaaaaaaguguuaauaaaauuagcauugaagaaaacuagccagccagguaugguggcucacgccuguaaucccagcacuuugggaggcugaggugggcagaucacuugaggucaggaguucgagaccagccuggccaacguaaugaaaccccuucucuacuaaaaauacaaaaauuagucgguggugggugccuguaaucccagcugcuugggaggcugaggcaggagaaucgcuuaaacccaggaaguggagguuauagugaaccaagaucgcgccauugcacuccagccugggugacagagcgagacugucuccaaaagaaaagaaaauuaaaauuaaacuguucacagccccucagaauuaacguugccaguuuuccugagaugguaaggucguuuccuggcccaugccuagccuaccuaaccucucucugcugcucuguugaucauggcccaagucaggugaaccuauaugaagaagucuguuugcuuuacuucccagacaccaaauggauugcuucugacuccgaguccacugcucuccagcauacauuucuggagcagccuuaguccaguugcuccgcugaguccugccaggcugcaagggccaagcacgcuguuccaggugagcguuuggaaaugaacuuuugaacauuaagcuucugagggaugguuuuuucucuaaauccugcagagguaacggugaguuuugccauauguugaguugaaauauuaaauguccagaggggguucauguuagugggguugcacgcccuucagaggcagacauuuucauugaggcagaaauugcagacucaugccagacacccauacguggaacaauuaguucuuaaaguguuuugcauauuuucauuugucuaugaaaacaggaaauuuauuaaggaaaaggcaaaacuuuaagaauuauucuuuaggccagugugauggcucacaccuguaaucccagcacuuugggagguugagggugggaggauuguuugagcccaggaguuugagaccagccugggcaacacagcaagaccccaucuauauuuaaaauaaaaugaaaauaaauauuauuauuuauaaaaguccacaaaagacuuuaaaauauuaauccuccuaguuaauguagcaacuuguuugacauaaagugaaaauaaaaauagugaacaauuuccccauccugggauagaaaaauuacuugcaucauuuuaugaaucaucauuaaguucuccuuguucuguaaugaaaaaggagaauccagggcauuugguuaaaaaauaaugaagacuuagcugcuuuaucuuauagaacucuccauacuaggcgagcaccuucauuauucauucacacaccagaaucuugcaggaccgucacuugcuaucauggagaaaucaguauuuccuccuugagacccauagaucauuacucacugauuaagguguuacuguuugaauauguugagugcagguggaaagaauccuagggacaggacugaagaaaagguggacccagugcaaacucccucuuucccaaauucuagcuuuucucaucgucccugccuguauccugugccccacaguguggcuuaccccaaguuaguugcagcucuuuggauaccauuucaucuagcacguggcacuuuguauuaugauugccuguugaucuggcaaucuuucucacuaaacuaugggcccucgagaccagaauggaauccuguucacugugguguccccagcaucuggcacauggcuugguacacaagugaggcucaguaauaauugacugucuaaaugaauucacaaagagaagucugagaaaggccaguauuaauagcaagucuucaugaucaucugagcuggucauuuugcuugucaagguuaaugucugcugaguaccuccucugugccaggagcuguacaugcugggauucagggucucuuuguaaggguggagcuaaagagguuuugauugccaucuugcuucuuugguuuccuaguggaguuaggguagggugucaugaagugaccauauccuuggaguaauuggguuucuaucucuuucacagcccuuauucccaucacaacaacuugagcuauagucauguugauuuuuaacaauuucagcuuggguaggaaaagagaaacuagaaauagcaaaaagcaaugagcaaauguuguauuaggaaaguuuaaaauuaggaauacuaaucuuuugguggagagauaaaaacaccucauuuccugaaagucuuaagauuagagcagcagaauucuaaaauuaauagaauagaaagaaauuguuugguuacaguaaacuccauggcaguagggauuguuauacuacucuaauccuagaaucuaacacagagcuucuguagaguucaguagguauuugugaauaauaaguggccucucauuucucuccuuacugggaauucugccaccugauuggugcaggccuuggcaaccuccuaggaaagcaauggagcacuauuggcuggggguucuuugggauuccuugucuuagauaccuuuuccagcccaacacucccaacaggaaaugaugguucaugucuacagugauucgacacguuaucaggaucucugggaguugggauacgugcauccgcucguuucuucaguccucagucacuacuguagaccaaugguucucaaaguuagcaugcaaaauaaucuccuagagggugaguuaaaauaaagauugcagggccccacucccagaguuucugacucaguaggucugggauagggccugauaaaaacuuuuuuuuuuuuuuuuuuugagacagagucucacucuguugcccaggcuggagugcaguggugugaucucugcucacugcaauuuccaccuccuggguccaagugauucucuugcuucagcaucccaaauagcuaggacuacaggcguguaccaccacacacaguuaauuuuuguauuuuuaguagagauggaguuuugccauguuggccaggcuggucccaaacuccugaccucaagugaccugccugccuuggucucccaaauugcugcgauuacagguguaagccaccgugccuggcccaaaaacauuuuugucauguuccuagugauacuacccagucuaggaaccaauuugagaagcacugcagaccagagguuccuaguuuauauuuagaauucugcaucagaaauuacugcauuuaaaggcuaccugcuuagaguuuuaauuucaccaaguggaccuguucucuuuccugaagccauucagaauacaacccuugaaaaaaaagacaagcugguauuccggauggcugacagguuguauggccuugggcucucuuuuuguggcuggauccaggagacuaaggaaaaacaauuuuuugccuuuuaaaauauuauuagucuuccugugaaaagagcaacugaguauggcaaaaguugaaaauagcaauuuugagaacgguaaacaacaaaauaugguagaggaauaacuuucugauuuuuaaaacuagauguuacaauugauacauauucagaauucagauuacuaucagcagugccucuuauuuuuuuaagaacuuuuuuuuuuuuuuaaauuuagagacggggucucauuauguuguccaggcuggucuugaacuccuggguucaaguaguccuccacuucagccucuggaguagcugggacuacaggcauaccaccacgcuggccaacaucccuuuuaaacugaugaaaauaauuuucuuucaaaauaacaacaaaccucuuucauguacgcuauagauguaaugaaggaagaaaaaaauagauuuggcuuacacauuuuaaaugaugcuggcaaguuuccuauuaccaugauuggaaagguugaucagaauccuugggguaauaguugaacagcugaagcauuuuuguacagaagggccccuaauaugauuacuauagcagguuauagcagauaugaaagaauuccaaggaaggagagagaagacgccuuucuggaagagguaugcuuuaaaauugagaaauguuuagguaaggagagaggcaccgaagacauugugcuaaauguaaacaaagaaccuugauuuauauaaauaaagugaacucgguuuuucuuggacaguuuauuauuuucuucuugucuaaggaugucuguuccaugacuuuugaaacagauuuuguuccaauguggaauauaccuaguaggaauagguaugucuugaaacaagguagagcuaauuaaguuuucaauuaagaaugugugcuguaauuuuuaguucaacaaaucuaaccccagcaaauauuugcaaugcucugcgacaaggacuguagggacagagaauaugugaauaguggaugaguaaacaaacugcugcagaaaguaaggggcagacgcgcuuuuuccagcuggccacuggacaggcuccaaggaagcaguggcgccucagcugggaggaagggacaggauuucgaucgaguacauuuagaugaauagagccgaaugacggggacgugagagucuguucaggaagggaccaggugauaggagauaagguuggaaacgcagcugugggccuugaauauaggcuuaggaauuucucucuuuaucuguuaaauguuuacgcuuuuuaagcuggagguaggaggaugagaucucuguuuuagagaacaaucacugauauuaguguggaggaagaacugaagagaaaguggaaggaacaggaagauaagaggaaauuuuuauuuuuauuuuuugagaugagcucgcugugcugcccaggcuggagugcgguggcacaaucucggcucacugcaaccucugccuccugggcucaagcgauccucccaccucagccucucaaguagcugggacuacaacuacaggcauaugccaccaagccuggcuaaguuuugaaauuuuuuuguagaaacgaggucucacuauauugcucaggcugguuuugaacuccugggcucgagcaguccuccugcuuuagcuuccuaggaagggcuaggauuacaggugucaacgaccauaccuggcuagaggaaaugauacuacaaauauugaagggagaaucaucuuugagauuaaaacaguggacacaggauauaauuagaagacauuuuagaggugagcucaagagaggcagacuuugagcugggucugagggguaaaguagguauugaaaauuaaguagaagcaaagauuacuaagugauuaacauacuggaaaugcuacuaaauaacaauaguuaaggccgggcauggugguucaugccuguaaucccagcacuuugggagggugacauggguggaucacuugagcccaagaguucgagaccaucaggggcaacauagcaagacccugucucuccaaaaaaaauacaaaaauuggccacgugugcuggcgugugccuguggucccaacuacuagggaggcugagguggcagcacugcuugagcccuggagguugaggcuguagugagccaugagcaugccacugcacucaaaccugggcgacagagugauccugucugaaaaaauaaagauaaaacauaacaauaguuaacauuuauugaugauugaugacuuauugugugcaagacguuguucuuagcacuuuugguggcuucucauuuaauacucccaguaauucuauuuuagagauaagaaacuaaggcacagggauauuggcuaguuuauucaagauaacacacucguaagugguggagcccugacucaaguuuuaaguuuguggucccagccaccauucucacugacuuggaguaagcaauggaagaagggcgaguuuugugggaaagaggcauugguuggagaugucuaaaauggaaaugguugucaaguccaagcaugguacuggagaaaagguggcuggggacaaaaguuugggaaacguugcaguuuaaaauaggggagugucaugggagaagagccuaauaaagaugacuaaaaaaauguuagaaaagccaggcuaaucaagagaaacuauguccauugaguauacagaaauaauaagggcagaaaucaguaauuuauuuugcaaaacagaugaauaccaaaacugauucucuugaaaacaccaauaagguacaccaaagagagagaagaugcaaauaaacaaaaagaaugaaaaugcaggcugggcacaguggcugacaucugcaaucccagcacuuugggaggcugaggcaggccaguugcuugagcucaggaguuccagaccagccugggcaacauggugaaaccucguauuuaccaaacauacaaaaauuagcuaggcaugguggcauccaccuguagucccagcuacuuaggaggcugaagugggaggauggcugggagguggagguugcagugagccaauauugcaucacuaugcuccagccugggugacagagccagacccuaucucuaaauaaaauaaauaaauaaaugaaaauuuaaaaucuguucaucuucccauguucacucuaacucaaugggaagagugguuaguagcacggaccuuuuaaacaagaguauaaacuauaugugcauagauuugauaaugcaguugaagugaauacaauucuagaaaaaguuaaaauucuaaaguuccagaaaagaaacaaaaaccuugaauaugccaauaaucauuaaagaaauuaaaacaguaauuaaagauacccccuaacuccuaccaaaauaaaaaguuguaaaauguugguacagaaagauuuguuuaaaacuuggcuguguugcuuauuagcugugugaccuuuagccaacagaacuuauuugaaaucuguuuucucaucuguaaaauggggacaacaaaacuuacguuacagcuccuagguaucaaaugaaaugacaagccuugauaaacucuaagguacuagacacaaguuacugaaauuguuugaaaauugcaaaaacauauuuacuuaaauauaaguauuuguuguacuucuaacaugugucaggcucuguaauuugauauuuggcgcugaaguuuaacuuuccuggacuaaauaggaaauaagcuagaaaagacagcccaggagaucuuuuugacacaucauccucaacaacgaaaaucuaguugcaaguagucacauauuaaaaggccuuguucaguugggauugcaacuaacauauuuguuucagaccugaaacucauuaucagagcauauacugucauccuacuauauuuaucaucuuagugaacaacaauacagaaaucuuauucuuugucacuuaugagugaucugugugauauuuuaauuagaauacuuucuuagcuccaaaauaaucuauucuaaaucuuuaaauacauuucuuacuuuagaauaaaugcugcaagaaucaucuuuguaguacccugaaaaacugauggcaaauuucaaaauauaguauuagaaauuacugacucacauguaaagagucuaugguuuucaaaacacucuuuuaauauuuaauauuaaacauuauuuuaauauuuauagcauuaucagcauccugaguagcuuagaacuuuuaaaaaauaguguuagaagaugcuuuagcaacauauaaauuauauauuuuuuccuaguagccuaugcauauagaauaauuagggacauuuucugggccuuauccuuuguuugcucuauguaaaucuugaucucauugucaucuuccaauuauucuguaaaauacauuggcaacuaaucucuaucacaggggugaugagagaaauggacugcuauggacuguaugggaauguaaagaaccuaaguucuucccaauggauuugcaauaauuauuguaaaaaucuuuuguccccuacaguuccccacacugcuuaauggccacaugccagugccaauccccagucuggacagagcugcuucuccaguacugcuuucuucaaacucucagaaauccugaugacgucuggccacaauuaaggacucauuaacugaugaaacaaauuuguccccacgggcuaguuuaccugugucgugagaaggacauugugaaacucuuguuaauuugguuugcacuuuucauaacauggauagucuagauuuauguuagcauuuuaaaaacuguuuuugauauauucaaguauauaugaaaaucuguuuggcauuaagugaauuuuaauguuuuuguuuuuauauccuuuuagcucuuaaguguugaacacuguugacagugaagaacuuuucuuaaugguuuucaguauaacuaauaaggaugugaagcuuuuuucucuuuaguucugaguaugcuaaacugugugcuuauauagacuauaaccaguugugccuuccuucgcauuuaauguaaaugaaugauuuauauauuuuuuaguauuaagaggaaauguuugaaagaugaaaauuaguaucaaacagcucucuaguagaauuucauuauuuuucaccagugggcaauaugaaagcauauaucacguuuuguuuuacuuucaauuguauaagaauugccuuagaaccucuuuugaacugaaauucaguaaauguccaaguaauguuuuuauaauaaacuaagccauauuuagacaauaaacauugauaaaagaaaauguucuaaaguacauuuucaaaagaauggaccuugaaaggcuagccuccuuagcuguuuacaguaucuuaucuuuuagaugccucccagacaaaaaucugagauggaaaagcuacaucaaguucaugcuauuccaggcccaagaauaucuccuagguuagcauauucuuauuucaaaaaauuagcccugguuuucucaguuuuccauagggaaucccgaccaucugauauauuuacugugucaguauaaguaaguugggguuccccuggaacuauaauuaacauuuaaaaaaucuaaugcuuuagaagaagcucacagaguggugaugaacccaaacaacaaagaaaccauuuuuaacacuagguaucuucaucaguauagguagguguucacaauuuuugauggaucaaaaacuugcuguaauacaaauagagaguggagguacuaaaggccuugcuuguggaaacugagagaggauacacugcuuuauguauuacuaaaguuaggggagaaugaaggaaaucugacagaugaaaaauucuacaggaaccucaucaucguggaacugaacugaugauaacuuggaacacuccaguaaauucuguuguguaauguaauuuggagcagugauaauacagacauauuuucuguuccaucagaaaaucagcaggcaccaguccaaagguaccacaccuguacaugaagaaggaaaguucuaauacaagaaaacugaaaagcaccaagcuuuaaauucaagauuaauuacaauccuuaacuauaagugaugauaaaaacuaacuugaaaugugacuaaauaacugauccaaacugggcauuaaguggcaggauuaugagaaaggauaaaaaaagagauuugagaaaacacauuucuugaauuuucagaaaaaaaucuagacuauugcuuugacacuuagaaauucugagguuuuucaauuggaauugagcaucucuguauguggggaugugggcccuuaucaagggauaaaaauccaaacacucuaacaugccuccuugacuguaaaguaaugacacugguuccaaaauucacaaauaauagacacuacuguccccccacccccaccccauaggcuaagaauaauucuguaccagaauaaaaggagcugguccagggaacugauauuuacugaacauacaaaguuagugcuagaaggggccuuugagaaugcuucccgccaccuguuuccagcucaagacaggugcacagcagaagcugggaguugccuauggcugcacagcucacugaagguagaacaaugauuggugcucaguccaauucugucucccccaugccuagcuguuaaguaauuacugguucaaaacuacguguuauuaguaaaacaaacaaaacagauaaagacagcauuuaaaacuguguugucagauaagagaacacauccaaaaugcaugauucuuacaaacuaaaggaaguuaaugugcaaaaaucucaaccaaaacuacuauuuuuaguauacuuguuuacguaaaugcugauuggaaauauuuaaaugacuauagaucugauucuuucuuuuccuuuggaaacugggauuaauguaugcucuagauccauuuauuagaaaugcaaaaauacuacaauuuuuugauggaugaaaauacuccuguaacacaaacagagaacuggaggaacugaagaauaacucacucauauagcucugccucauucugugugugugugcauguguguguuagcagagguauuuuacucagaaaauagguuucaaagaacauuaaugacuuucuuuucccuuuuaugucugcuuaaucaguguuaaacugcuaugggaaaaguuuuauagaacuauauaaccugaauguuggucucuuuguacacaucuuuucuaugacugcaaaucuucacuuuauguaucauuuuuacugucauauuauuuuuguucaauaaaaacuuugugauaaaagguguuuagagguaacuggauuggcuuacuuccauuugcuuggggugacccaaaccacuuuuccauauggauacaaguuggaaaaugagucuugucaccuacccuuaaagacagcacauccaaaaaaaaagugcuuuacauacaca

SEQ ID NO: 16366 - RNA, 34914 nt, Homo sapiens
ccuuucccggcgugcaccgcgaaucccuccuccucuucuuuaccucucucccuccuccucagguucucuaucgacgagucugguagcugagcguugggcuguaggucgcugugcugugugaucccccagagccaugcccgagauaguggauaccuguucguuggccucuccggcuuccgucugccggaccaagcaccugcaccugcgcugcagcgucgacuuuacucgccggacgcugaccgggacugcugcucucacgguccagucucaggaggacaaucugcgcagccugguacaguggggcgccugcccagugcccgccucucccgggcucccugccccucgacccuaguccuugcgggcucccggaucuccggcucaccccgccgcggccccugccuagccccacguccccgucugcucuucuguagccuccauccaacucauguugugcacuucagcccccagaucucucacagcaccccuucucaaccccgcuuacgccucugcaucccuucccucagcccccacuuauacguaugucuccuccgccccucgccuggauccucucuccgaggucccugggcacauccagcgccucguccacuccucucaacucacccagcccuuaggugucaucuuugcaguagcccccauaauuuuaguuccuggcucuaauuacuccauggccuccccauugcuucggccugcggcccagaacccccuucuucaggccccagacuuuucccagcccccugggcaccuuccucagucaacaaucucacccaagucucagaucccauguccugucgaucccugaucccacgguugccucccgggaacacuuauuucaauccacaggucugcagggcaccacccauccgucucccuccuaguucccuggaucucccugcuagucguucucaagccucuuaggauuuccagccccggccgggcaggccucuucuuuccgcccuacuuugaaacuaacagucccugcuugcuaacucuaggcgcagcucucucucuucaggguccuuucuacuuuuuaaucuuaucaacuuucuucuaauaauuuaagaacggaugggacguucaaauuuucuaaggaugauucaauacgcuuuuuuaauaguugguuccaaggagccaaguaguuauuucacuuagaaaacacauacuucuacaaacucuauaaccauuggaaugaagaaagguuguagauucauggaauauuauucaaugauuuuaucuguaucauaaccuauauuuaauguucuugcucaaauugcccaauaguauuugguuuauaccuuucaucugaagguaccuuucaccugaagaauuucauagaagaucauuuuaaaaauaagagggucaugaaaagacagccaaauucggcuucuucaccagggcaggaugcuacauguguauuuuacacaguguagcauggugaaaucuacuaaagcacaucaauaagcaaucagaucagaucgggcagauaagaauugguggcuuucaggccucuuuuuccuacuuguguaggaaggaucugaauuuugauuucauuaauaugaacuaauaaguacuuacuuucuuacucuucaucccucaacauuuugcuaaacugauugauuugaaaaauaggucgauuccucuauguacugauagguaaucaacaaaaguaccauaagaaagaaaauuaagauauuauaagcaggaaggcaucuauuuccuugcagaucgcacuuuggucuucuugaaguaccaugcuaucuuuaauugcaguagcaacuuugccugggcagggcugaaguccuauuucaaugcaguuucaaaacuaaacaccgcauguucucacucauaagugagaguugaacaaugagaacacauggacacagggaggggaacaucacacaccagggccuguuggggguaggggccuaggggagggauagcauuaggagaaauaccuaauguagcugacggguugaugggugcagcaaaccaccauggcauguguauacuuauguaacaaaccugcacguucugcacauguaccccagaacuuaaaguauaauaauaaaaaaagaaaaaccacacugugagacugccauauuugaacaugaguuuauacguccuacauucaaaaguacuagagauuuaaaaauuaagcaauucaggacacuuguguucagaugugaauaauugcaaaccaaaaccgaggucgcuaguggaagaaauuuaaagagguuuuucuaauauaugaacagcaaauucuuccuugaaucuuuagcugcaacauauauuucagaagaaauauuccaauugguuuaagauauaauaaaaccuugacuaagccccaaacccacucaaagcucuuaguuaacuggaaaguucuuguucuucaccuuuauuuaaaaaaauuaaauuauaaacuaugcugauaaaaguaaaagaaugaaaauuuuuauagcuuuuugcugcuuaaugugaccucacacuuaccuuuguuuuguaaaauaaaaacuuaaaaaauuuauuauuugaaguucagguguacuucaaaugugcagguuuguuacauagguaaacuugugucaugaggguuuguuguacagauuauuuugucacccagguauuaagccuaguacccauuaguuacuuuuccugauccuuucccuucuccuacccuccacccuccaguaagccccaguguguguuccccacuguguauccauguguucucaucacuuuuguagaauaaaaacuuuaucucuguucuauaaguaagcaagagucaggauguuuaaauuuugaaaagaaugucccaaucuaaaaaucugcucauuguuuuuacauuccccaaaucuagagaaaaguaagauuuuaaaauagugauuucugguuggcaugucuguuuagcaaauuagagccuggaauuauaauaauguuacauguuauacaaggaaggcaauuuaugguacaaaauaacauguuuauaauuguuugcuuauuuaugacaaaagccuuagaccaggagcuuauccuuauuaauuaguuaauuaguauuuauuuaaaguuaacuuguuucuuuccuccacuagauuguggacucuugaauguagagacuguguuucauaacucuuuguaucucagcuuccuaguauagucuaugucuggcauguagaggacauucaaaaguuugauuaauggaugauuucaauuagaaaacagugccuaagcuuaacaugggcuacauugauaauagugccagcuguauuucagaggugagaugggaagacccagugccagugcggaaucaggagagacgucaugucuucuuuuccucuccguucuuagaguuugugauguugaggaaugcugaaggagacuuaaucggacaaauucuaagcuuucuaaaauucuuuucaaguuuuggguuauuuacacugaaguuugauccuccaaauuuaugauaacuuucauacauuuguuucuuuucacugaaaccuucagaaauguuuagguguucuuuugguuaguggcucaagagguuuuagugccauggccaaggcagaagccagcaguuaacaauagguaauucugacugcaaaccaucuuguuuucacuaaguaaaugucucaacugggaaucaaaucaaggugguuuuuuaguuuuagcuuuguguuucacacauaaaccuauuuuuuuucaucauaucccugcacauagcaaguagaaaauguaaauuuagacaucauaaugaggcauaaagcuuuuuuuaaaaaaacucugcuuuguucuagaaaggacugagacugcuugaagcaacauauauaguauaagauuaaaaauaauuaaauaauuugcaggaagagagaauagggauaggagaaacaaaacccauggcauaaagcccucuauacuuuaaaagaagugggccacaggguugacauggagcuuccuaccagccugugcaaaaaaggaaucagauaccuauuccaugucaacugaccagcuacugagaaguacaacugcuuuuuagggggauggaggguauuguucaaagaggauacugugaaacauauaaauuauauccuauaauuaguagagcuguugaugcuuaacacguuucuuaaaaaguacuaaauccaacuugucaacaauccaguuuucuuuauuuuucuuucuuauuacaguuuuugacuauuuuuuaaaaauaacaucgcugaaauuugaaggggaauuuuaaaaaguaguuugcaaaugauaguugagacuuaggacuugagauaauacagcuuaaacauugcauuuuuuguuuucucuuggucuaggaccugcuucaugcauuaauugacaccuaguguuuuugaggcagagugcuaaacccugggaauacagaccuaaguaacauucucuguuuuagaacccuuagucuaauggaaaaagaaaucauuauaaugcaguacaguaaguauuauaggaaaggguagggccaagagcuauaacagacacaggggauaucaaaacguuucacaaaaaauaguugucacuaugacacuucugauucugaacagauuuggaaaguuuagccaauauagaaaacagaauauguuccacugggaaaugacccaguuaauucaucuauauaagcauguguuauaaacacaagauacucaaaucaaguuuuuaaaacaaguuagcuauucugaauagcuauucagaacuagguacuagacuaugaagagacuagagagguacuagaauaugaaggaguaacccuauuauuuuaaauaagauauaaaccguaucuucuacuaauuuagaguaaggauaacaaaugagguacccccaaaagaaaguacccaggggcagcugggaaauggcugguucuuggccucacauguagccaggucagauuucagaaaaggaaaaaaauaaugccagagguagggagaucugguagaaagcaguucugccaguccagggccugaccuggguuaguaguggaaagaaaggaaaaguaugaagacauugugaaagaacaacuuuuaaguggcugugugggguugggaaaugggaucaaaccuuagguaacuggaagaguucuuuuaacagaaucaagaaaucuggggagaaaucugauucagggaguauaaaaaucauuuuuggaauuuuuagaagccuauucaauguguggugcuaugucccauggaaauguugagcaggcgauucgacugagguccuggggagggaauacaacuguagaacuagaauggcaggcaucuucacagagauacuaauugaagaugugggcaugaguaagagcuagggagugaaggauauggcaagaaaaucaaaggaccggggcuggaacauugggacauauccauauuuuugaauuggaauaaaggaggggaaaggaaaaaaacauuagacaaauagagaaccauuuaugauguaugcguacaggcaaagaagugaaggaagggguuuuaaccagaugacauaguccauaagggcugugaguagacagaggucaagguuauuggacagaaaagacuuuguugaucggggugggggcugcccuuucaauagcaagaagccagauggaagaaggggaaagggaggaugauuaaugaagaaguagaaguaguagucauagcagucaaaaacucccuuggaguuuaaggaaggaaggaggaaaacuagaauauuuaguggguagauccaucaaguagaauuuuguuuauguuguuaggaaacagucuuguggcauaggaagguucaagauucuaggacaagagauuaguugagagauaauuaaagaguaugauuuguagggcucaggauuuuggggauagaaaauacucugacacuugaugucacuccuucaugcccaaagcaguuguccuuaauuggccauggcaaguagauauggccucccaauccucugcagaaucauuuggucugaguuaccauaccagguugggcuuuuucuagauauacaaccacagugauauacaguuugcugauuugcuuaacgaacaugaaguuugaaaguacaugaguucuaggaggaaauauauuguguaauguauugaggagccagagugaaagaaacuuaaguuauagauaaaguuuuucauaauagagaaaauuuuaggagucagaagcaaacauauuuugauuuagauuugacuuuuacuuaaagcccaaaauuugugugacuguccuaggguuauuuaacaauauauaugcaaaucuuagaacccaaaaauuuucaagaugcuuagagucccaaaaaaugagaccuagacuagcuuuugacucuucaauucuucuaauuucacucuguauuuuacucuccauaagcaacuaguuguuguagccuauaucuaauaugaguuuuuucugguaaaugaaacuauuuucuuacuauuuaaaaauauuaauuuuagguuuuggauacaaaggaccuuacaauagaaaaaguagugaucaauggacaagaagucaaauaugcucuuggagaaagacaaaguuacaagggaucgccaauggaaaucucucuuccuaucgcuuugagcaaguaugaauguuaugaucuuucucuuuuacagcuaaauaauggggaaacauauucuuaacuaauuuaaauauuuuuucuuuuuaaauuuuaguuuguaaauauguaaugauugguacacuacuuauccugaucuucuguucagauuaaaguugauacagcaguuaaaauuauauauacuuaagauacuaaaaauguuguuuguauauaauacaacaaggacuuugggaacuguuaguuucuaaacgauucauccuuuuacuaauaucuagagugauggugggggcaugccaucauaagaaggcauuucaagauaaccugggcagcuuuacaaguugcacccuccuugcccuugccccagaggccagcugcauuuauuaaugggacaaugauaaugccaaagauagaacuguuacagugcagcaaucuugggauaagugcuuuaaaugcauucuuguaucuaauccuuacaguaacccugcugguauaaucuacacuuaaagaugaggaaagggaaccuuagagaaauaacuuauucaagaaaguggcaaccagaauugucacacugggaguauaugccaccucuugaggggaaagagggugaaaacuauuggccuagaacaagggugaucuaccccaguuguucagaggccaguguuuucaugccuucucuuucccuuuaagagaagggaaacacuuaagucuagcuugugagguagaugguauucaccccauucuacaaggaaacuguggcauagggaggucaaauaauuuccccaaguuuacaguaccaguaagugauagagucaggauucgaacaccagcagggcugcuggucucuaaaccucugcuguuuccuuauuaucagugcuucucaaacucucugggguaaaggaccaauuucuauccucuucaaucugucauagacugauacuuuuguacaaugcaauaaaaaugaaauaugaggaagaagagaugaaauacaagcacacauuuuuuauuauuagauucaacagacaaaaaugacucuaaaaguuuugcaaugcugacucucaacuucuggucuugucuuguccugggccgguaacaguuugcagacuagcacugcucugugucaugcuguggcaccugcugcugugguaguugaagccccaaaaaugauuucuuuuacuuuuucacucuaauaaaauauuaaaugauaucacagaugcaaaguacgugacacacaacgggguagucaaccacuguuaguugccauuaagccuucgcuagcaguuagcaugggagagguaaaaggacccacaggcuggcaauuagguaggaaaacugagaggagacuuacccacugaggauguggcauaccuagagcuuacugccaaucagugaugagaaugcauacuauguuauuuauauuauucaguguauguauuaugaguuuaaauuuucacuagauggaaucauacucuacuaauauauuuauguguuucauacagaaaucaagaaauuguuauagaaauuucuuuugagaccucuccaaaaucuucugcucuccaguggcucacuccugaacagacuucugggaaggaacacccauaucucuuuagucagugccagguaaaaaggauuccagaaugauuucugaugcagaaaauuucagcaccuaugguugaaugaagcaaaaugaacagugguuuuauggauuauguagguuuuaccuaauaaaauguauuaauugaucuuauagaaacauauaagaugaauuauauauuuucauuuuaucuuucacuauuaauacacucaugccuuacuuuaaauaagaagcuucuuucaguuuggaaauauguccaccuagauuggacucucuaggccugacuuagaacuuagcagagaguagguacucaguaaauagucauaaaaugaaaggaaaaauuaauaaauaauauguacugguuaugaaaaaugcuaauaguaaagaaauggaaagugaaagauuuaauuuccaaaccuuuuccagacaccauugcccagagguaaccaccauugaguuuggaauguagcuuuuccauauuuuucuuacacauuuacaaaaguauguauuauaucaauauauuaacuguaccuuuaaaauugcaugacuuaaacuacuuuuguuuucuguuuuaaaacuaaggguaaagagccauacaauuagagauaaccugucacaaggauaauacauuucaaacugucuucugaaagaaaaaauaccuacuuuucauaguaaucaaauaauuuacaauuaagggaacugacuucauuaaacguuugcucuauuuccaggcauugugcuagauucuuuacauguuucaucccucccaauauuccuguguguuagguucaaauuucaauacaaguccauuuaaaaaaggaauuagcauaugaaucagaccuguuuacuuucuauggccacuugaaacaucuuuuuaaucuaagaaacccucaguuuaauaaucuagaagagaugaaauguucuacgcaagaguguacaaauugcacaaucuguaucucauaaauaucugauuuucaggcaguaugucuuaauagaaugucuauuaaccaaaguuggcaagaaaugcaagauuuaugagucaugaaaauguuaauuuugaauauauuauuccauuucuuauuggcagcaauggugggaauaugggaaacagauuucagcuaaauuaauaaaugauugaggugauaggaaucauguagacaugauuuuguuugaugaauuugcuuacgguuguucuguaugcauauuugccuggguuuggccuuauccaaugaaauacauuuaaaaaccccuuugguguugccaugucaccuaacuagaaaccauuaaggaacuauagaggcauggucuuggaaaucuauuuugggagagagaaccagguggcucugcuaguccuacuuaauccaucuagaggucauuugggagccuauaucuuuggagaauuuucuagaacugaaaugaaaagaccuggaguuuggggguuuuaagaaagcuugugguggaaugaaguauguuuaggauuuguaauagcuucagagaaggguguuaauaucagaauuccuuugaguuuaguagacugucucaaugaggcuggguuuucauuucauuguucaccagcaguagacagacuuauuuguaaacagaccggguauaagauuguaggugcucuuuuuuuuuuuuuuuuggagacagggucuugcuguguugcccaggcuguagugcaauggugcgaacuugggucacugcagccuagaacuccugggcucaagcgauccuuuuaccucagccuccugaguagcugggacuacaggugugcaccaccaugcccagcuaauuuuuuuuguguagagguaaggucucacuauguugcccaggcuggucucaaauucuagagcucaagcaauccucucaucugagccucccaaagugcugggauugcaggagugagccacggcaccuggccuguggucauacuggauggaaccaauguuaauaacgauugguguggcaguacagaaacacuuugcauaugauaugaaugaauaugucuagaugguauugaaagagacuguucuuucucccuucuuugcuucuuuguuuuacuuacaagguuugcugcaagauugaagugucaggauuacagcaacauuucucaggcuguguucauuagaauacugacaucccauuagguguuaaaccagagagaaauggguuuuguguuaacauaaauguaagaaaucaaacagguuucuuuauuguaggucuguucagagccuucaggcggcuaauauucuaguggcucugcaagacaguggugcaguaugccauacuucucaggucuguuuugcuacagagcccuuuuuucucagguuucuaaaagcuucucacugggcacuacugucacccagaccauagaguaggaaacacugcuuaagaguuucuccaugcuucaacugaaaugugaggguuaaccauagauuaaaauggaaaaucugauuuuuaaaaguccaagaaucuauuuuuggacuuuaaaagaucccaaaaggccaggcgugguggcucacgccuguaaucccugcacuuugggaggccgaggugggcagaucaccugaaguugggaguucgagaccagccugaucaacauggagaaaccccaucucuacucaaaauacaaaauuagcugggcguggugguacaugccuguaaucccagcuacucgggagguugaggcaggagaauugcuugaacccgggagguggagguugcagugagccaagaucaugccauugaacuccagccugggcaacaagagugaaacuccgucucaaaaaaaaaaaaaaaaucccaagaaaugaggacuguuuuuauuuuaaugucuaagaacaaugcugcaauuuuuaaugauuucuuaaugacuuaugcgaaagauaaauagcuauuucuucuuguuucucccuuuuucaggccauccacugcagagcaauccuuccuugucaggacacuccuucugugaaauuaaccuauacugcagagguaaauauuacgaauuauuaacucaauuaaaugaugcauaucaguaaauaugguauaaaugauaagcagagaugauaauugaauuccuagagcuagaauuauuuuucuuaaugaaauucuaccugaaauauguaaacaaagaggcuguggcacucauucugaaucucuacuuuaaaggcaguuuuaaacauuuuaacugugaaaaaaaggaaauggaaaccaaucugacuuuuaaaaaggaauucagggcuaggugugguggcucacaccuguaaucccagcacuuugggaggccgagauggguggaucacgaggucaggagaucgagaccauccuggcuaacauggugaaaccccaucuguacuaaaaaaaacacaaaaaauuagccgggcaugguggcgggcaccuguagucccagcuacucggcaggcugaggcaggagaauggcaugaacccaggaggcagagcuuggagugagcugagauggcaccacugcacuccagccugggcgacagagccagacuccgucucaaaaaaaaaacccaaaaaacaaaaaaacaaacaaacaaaaagaagaaauucagaauccuggaucuagaaauaagaacuuaggaacaauuuuuacuuaacuuuuaaaaauugacauuugcaugauuuaaguuucuauaaaugcauucuguagccauauaagccuagugggcauauauuccagacuugucuguaugcaauuccaacuuauucccuugguagguacugcuaauccuuuuuggaaaaggcggacuguaauuacuaaauaaucacuaucccggaggcuagaccuacuuagaccaagcaaauagaaugaggaccaacccauauuuauggggccuucuugcuucccaaaucaucccacaaccaaauuacaucuaggauagugcagugauauauuauacuuggaggcaaagaaucccagggcucuggcucuucuccaccacuuaauaacugcgugaagucccaacuacuugggaggcugaggugggaagaucacuugaacucagaaguucaaggccagccugggcgacauagcgagaccccauuucuaaaaaaauaaauaaauaaugaugugacacuugaacaaguuuuaugaccucgcaaccucagcuggcacauauauauaacguaucaccaccuaaaugaagggagguggcugaaccgaauuauuuccugaauaguuuugugcuuuagaaucuacaauuguuguagcacugguucaggaacuucuaauucugugccugccucagucacagcuuuggguccugagccaugcaagaagaacaugaaagucuagccccuacuggaauauauucuuguuugaucauuaauacuugggggaguccuuuauucuggcauucaucagaaaucaaacuuucagaaucauggagcuaggauacacaguuaaaugacuauaugguuugccgcauaagggucuuuuccguauggauuuccagagaaaauuauuugacaguuuuuagcaauaaauuuuaguuuuucacaguuacuacuuuuaaaauguuccucuauuuguaacuccaaguguguguuuucaaaacaaaauuguucaaaaccauucuguccuacagugaguauauaacguccuuuugaaucuguuuugugaguguagcgggagcagggaugguggcugccauugccagggauggugcugggcucuucacuuauauuauuuauuccuugcagcaagccuuugaaguuuuacacuuacuugauggggaaacugaggcucggggguuauauuuauuugcccaaguuugugcaguuaguuauuagguggcagagcugggauuuuaauccaguuucuaccaaaacucugcucuuaaugugcaugggugaauggauagaaauuucacauucacuuuuaaagaagccaguuucccauauugcuaauuuuauuuacaaaacugauauguauauguguauauauauacuuuuuguauauguguuuuauauauauacacauauauaugugugcauauauauacacaucuauacacguuguguucauauauauguguguguauauauauacuuuuuguauauguauauacuuuuuguguucauagucuguuuauuagauagucaagaaugggaagaaaagguuauuuuacauauaugguuuaagacacauagaagcuuuuauuuaugacuagaaaugauuuuucuccuugauuaggugucugucccuaaagaacugguggcacuuaugagugcuauucgugauggagaaacaccugacccagaagacccaagcaggaaaauauacaaauucauccaaaaaguaagauccuagggucuagauuuuuguuuucauuggcgguaaacuacaguuagcuuguacacauccagagggcaaaauuacuuuugaaauauuucagaauuuugagaacagcuuuugguuuuuguuuucuucauuuuuuuuucuuuugugcuuuuaaaggguuuuguucuacuuacagaguguuguauugaagagaggguuugcuguagagacagaauagggagcauaccuguuuucauuuucccucacuccaguucaggggcuggcuuccuguucuuuugaguucuuacgcauucaccugcccugguacuacagugugggcaaguggcuguugagaguguuuacaaauggaggagucaagaccaaaaaagcacucaguuacaguccuggucauuagacauguaucuuugaccuucagugaacagaauguguaugcaugcgugaguguguguguguguguguguguguguguguguguguuuucuuaauugaccucacaauggauaauuugacuuccacugcagcuucugugguuccaagcucccauaacuuuggcaucuacuuauugccggguaacucugugugccucuacaacaugccaauagugcuuugaaacauaaaggaauaaaaaaagaaaaccaaaaccuuuuaaaagucaggaggaaaaaggcaaacauaugggaaaugcgcuuccuguagguuacuuuuugagaaaugcucaaaaugcaccuuuuaauaguaugugugaucuuguuuuucaugugugagaagcuuuuguuccuagcagaauaaaaggcaaauagauguuuugaacaauguuuuauaucacaauuuuaagcuauauguuaaagaugagaacuauuugagaaguauaaaagcaaaguuaucccuacuaauauuaggagauuugaaagggaauuuacuuacuuuuaaauaugaauugucuuacuguguaacauuugugaacacuaaugcaagcacguggugugcguuuguuugcccucuuuagguuccaauacccugcuaccugauugcuuuaguuguuggagcuuuagaaagcaggugagcuuuuggaaaaauuuucagguuuguggaaagaucaaaacuuaggcaucuugaacuucucucaagguuaauuggucaaucauuugcauauuucucaagauaucaagcugacagcucuagaaaaauucaaaucuaaaauguaggcaacaaauuaauuuuacauuuaaaaaucuugaccaguuaccccuuauuuuuucaaguauuguaaaaugagcaugcucuuaccuuuagagaucuggauucucauguaagcuugaacaagucacucucaaucucuguuuccuuauccuugaaauuauaaugucugacuuucuaccucauagggugguuaugugaaacaaaugagauaaaauauauuaaagaacuuggaagccuacaaauauuacagaaauguaagauauuuuaucaauauuuuacaaauaaagugcccuuccuucuuaauuuuuuguucauucuuaguuuuaagcacacuuaacuguuuuuaagugugcgguucaguaguguuaaguauauccacauuguugugaaacagaucuucagaaauuuuucauuuugcagaacugaaacucugcaccaauuaaacaauagcuccucuuucccccaccgcccaguccuugguaacacccauucuauuuucuguuccuaugaauuugauuacuuuagauaccucacauaaguagaaucauacaguaugauuuuaucucuuugugucuggcuuauuucauucaaggugucauaaugcccuuaagguuuauccacguuauagcaucugacaggauuuccuucauuuucuauuuguuucuucuuauauaagaguauucaaccuuuaagugcaugacaaaguuuauacccauuccuguucuagaauagucuuacaggcugggcucuguggcucaugccuguaaucccgucacuuugggaggccaaagugggaggaucgcuugagcccaggaguucaagaccaggccgggcaacauaagugagaucaugucucuacaaaaaaauaaaaaauuaaucgggcaugguaguguaugccuguagucccagcuacucagaaggcugaggugggaguauugcuugagcccaggagguggaggcugcagugagcugugauggccccucuguacucagccugggcaacagaaugagacccuguauauuuaaaaaaaaaaaaaaaaaaaacgcugggcgugguggcucacgccuguaaucccagcaauuuggguggccgaggcaggcggaucaugaggucagggaauugagaccauccuggcuaacacagugaaacccugucucuacuaaaaauacaaaaaaaagaaaaaauuagcugggcgugguggcgggcaccuguagucccagcuacuagggaggcugaggcaggagaauggugugaaccugggagguggagcuugcagugagccaagaucgugccacugcacuccagccugggugacagagcgagacuccgucucaaaaaaaaaaaaaaaaaaaaaaaauaguuucuuaugaguugugacuggguuucuauaguugugaaauugagggaugaaaugagacccucaagaggucuuacaagaggcaauaaacuaauuggggacaccuuaugucuugguuuuuuuccuuuggcccagccuguaccuccuuagagagcugcauaucuauugcugcauauacaacagcagguuugcagcucacgccauguaaccucaucccuuucccauaggcacaugguaaaugcacucucacuguaaagguuugucuacaagacauuaacuacuuuuuagaaccagaugaaucauuugccaugaauuucuuuuuuauuaagcuuuuuaaucuugcaggcaaauuggcccaagaacuuugguguggucugagaaagagcagguggaaaagucugcuuaugaguuuucugagguuggucauuuaguuauccuuuguaaucauugugauagacaguagauugaagauuuugagugugaaaugugaugguuuuaagugauacggggaaagaaccagauugucuuuuauguagauguguaguugcuacauucuuuuuaucauuuucauuuaacauaaaaaucauuaacuuguaaccuucauagaaagcaauauacaauuuuaagaaauguacaauggugauaauuaaggcauacagacauauauauguugauuuuucagacugaaucuaugcuuaaaauagcagaagaucugggaggaccguauguauggggacaguaugaccuauugguccugccaccauccuucccuuaugguggcauggagaauccuugccuuacuuuuguaacuccuacucuacugguaaguguaaauguuucuucauuugaaauugacguuucaaaaauaaacuuaagaaccuuaggaguccuaauaauauguauauauauguaaagaaccuuagaguccuaauaauguauauauguauaaaaaucuuuucucuuguucguguaaccuuuguuucuaauuuuauuguuuauugugguuaucacaaucucauuuuuuuuuuguuguuuuuugagacacaggcuugcucuguugcccagguuggagugcaguggcacaaucucagcucacugcaaccucugcccccggguucaagcgauucuccugccucagccucuugaguagcugggacuauaggugcacaccaccaugcccagcuaauuuuuguaauuuuaguagagaugggguuucacuauauuggccaggguagucucgauccucugaccucgugauccaccugccuuggccucccaaagugcugggauuacaggcaugaaccaccccaccaggccuccaucuuguuuuugaaaggaaaauaaucaggccauuuggagaaggagaauauuauguucacgguauuuggggaguugggcaugggggugcuguguaacaacaauucauugauaaauuauguauccagacaaucagacuauaccaauuacacuugguguguagguacaauuaaaaaaaaaaucaguacaccauguacaggaaaggauuagggccauagaacgcugcuauguuuaauaugccugugagcuacuuuaaauucuucuuagaaccaaaaugagugauggauuagcaauaaaauaaauaaaauacagcacaggacacauaggacacucuaaaguuuuauuaaauauauuuuggguaauaggagagaaagaaagugauggguaaauaagagcagauauaaaaauggaaguagaagaaauguuucauggaaguuagacacaaauagacuggcuuucauuguauugcaaaaauucccuagaauuagggcaagaaagaaugaugcuaauuuuuaguucuguauuuuuuuuguuuuuucaauuaaggucucuuuuaccuucuuugaagugcuguaguagaaauacaguggaucaccagugccaguaugcuaaguauuuagguaggcagucuuuuagauagucuguaauucgauuacuaaaauacuaagguaauuuucuuuuuuuguaggcaggcgacaagucacucuccaauguaaguuaaacuuuuucauuauggccuuaccuucaagaaguauuacgucaacugauuuuaaaauaucccuuguauuuuuauguuaaagauaugguuauaauggacaauuuggggacucuucucacauuauuaacaauuagauguaauagauuuaaggaaauuuuaugguuugaucucuucauauauuuaugaaauauuuuuaaugcagugauauaucuauuuaauauuuucuaaguaauuuuuguuuucuaauuacuuuaugccauauuuguguguguguguaugucuuugguuaaauuaaagauuuugcugaacugaguaacucccugaauaucucagcuaauauuuuuuaaaaauugaauaacauggaguguuuacaguagaauggguuauuuuagguuaagauaaucagucuuacuauuaaucacacuguuuucuuuaggucauugcacaugaaauaucucauagcuggacagggaaucuagugaccaacaaaacuugggaucacuuuugguaagauuuuuguuauuauuucuuuauugguucauguugcugauuuuuuuuucccugccuccuaccacucugaauuguuuuguguguaucucuuguuuuucuuuguuaucaucucuuagguaggcaaggauuuuuuuuuuuuuugacauggagucucacucugucacucaggcuagagugcaguggugcgaucuagcucacugcaagcucugccucccagguucaagugauucuucugucucagccucccgaguagcugggauuacaggcaugcgccaccacgcccagcuaauuuuuuguauuuuaguagagaugggguuucaccguguugcccaggcuggucucgaacuccugagcucaggcaauccacccaccuuggccucccaaagugcuaggauuacaggugugagccaccaugcccagcuauuuuuuuuuuuuaauuggagacaaggucucacucuguggcccaggcuguagugcaguggugcaaucucugcuaacugcaacuccaggguugcaauccucccuccucagccuccaaaguggcugagacuaaaggcgcaugccacuaugccuggcuaauuuuuguauuuuuuauagagaugggauuucaccaugucgcccagacuggucucaaacuccugagcucaagugauccgcccaccucggccucccaaagugcugagauuauaggcauaagccgccacgcccagccaacaaggauuuuuuuuuuuuuuuuuuuuuugagauggagucucacucugucgcccaggcuggugugcaguagugugaucucucugccucucaguucaagcaauucuugugccuuagccucccgaguaucugggacuacaggugcacgccaccaugcucagcucauuuuuguauuuuuaguagagacgggguuucaccauguuggccaggcuggucuugaacuccugaccucagauaauucucccgccucggccucccaaagugcuaggauuacaggcgugggccaccaugcccggccaacaaggauaguucuuaaaaauucuguaacacuuauuacagcguuaggaguguuagguucagucuagguguuaaguuuaauuccugauauacucccacuuuuaacauagggacaugcaagagcagaagcagggcuuaacuuucccugcugccaucugcugggcugggcuucccauugcucuggauugacugccugggagccagagucggcuuagacuguaguggucaugccuuacaacugcuuuccucuguagaaaagccaaaaagaaaauaucuugauugaaaugucuuuucuucucagcuguguccguguuuuuauuaaaauauuuuuuuuucagguuaaaugagggacauacuguguacuuggaacgccacauuugcggacgauuguuuggugaaaaguucagacauuuuaaugcucugggaggauggggagaacuacagaauucgguaaaggagucaaaguuuuaaaaaccuucauccaaaguuguauagguguuaaaaacugaguuuuuauaaaagcgucuuuacuguguagcaaccaaaaagucauuuuuacaaguguggaaagugaagucaaugcugguauaacacuguguugauccacacuguucacuguucuauguaagguaguuuugaugaccuggucuaaauagggagcugugggaccucacugggucuuugcuauuaauauagcuguuuacuauguuugcaucuuauuugguaugucauuuuuaaguguugucuccugaaagccaaauuugcugaccaggcauuaaaucauuuuucuagucuuuuuauaagaauaaagccuguauuauugagcaagaaacaacagagaauauuacuuaaguaagcauucuauuaauagacuuccagaaguuuaugccaacauauccuaguguuccagucuccaaguuuuagauuccccuaaaguuacaccacugagugaaguaauaccuccuuauuagcuuauuugcguggugauagcagucuuucuauauguuucuccauguuauuucaugucuugcagguaaagacauuuggggagacacauccuuucaccaaacuugugguugaucugacagauauagacccugauguagcuuauucuucaguucccuaugagaagggcuuugcuuuacuuuuuuaccuugaacaacugcuuggaggaccagguaaguaguugguauuuuaugauuuuuuuuuucuuuuugaggguaaugugagaauuaggaagaauuguaaacuauuguuuuguuccauuuaauacuuccaauucauucuggauguagcugcugaagaaaucuguauuguuuucugaguuaccucucaacuuaaaaccauuaauaaccccuaagguuuaaauuaugcugcuucauuuuuuaaaaaaucucaucaguuuuugaaauuaggauaauaguguguauucccugaaaacauuucuaugguacagaaguuuauaagaguaacaagugagaguccaucaaccccuuuccacuccccagggguaaccacuguuagcaguuugguguaaauggcuccagaucauuuucuagguguaaauuaacaagcagacaaauaaauacauguaauuauuuuaauuacaaaaaaugggucaugcuauauauuggcucugcauuuguguuuuguuuugcucgauauuucacauacacccuucugugucaguacauauaaaucuguuucauacuuuuuaaugccaucauacuaguucaugauaaagcuaugcugaguuauguacccaucccccacugauggacauugagguguucuccuugguugauugacuuggaaggcugucugucaccuggauccauucugccuguccagucuuauuuuucuccuuucuagucaugugaagguuauugcuuuuagaacuuggguuaugcauuccuuuucugugucuucauguguuauccccuuaccuauaauuagaauuucucuucucccuuccacugaauuacauauauucuucaaggcccaacuuaagucccaccuccuuuuuugaacauucuuucacucugaaaguccucguagauuucccuauucucugaauguucucuguucucugugguuaauaguacaaugccaaacacgcacacaaaaugucaaauaauuaccuuucuaugaauugauuucuuuucuuuuuuacucuuagagauuuuccuaggauucuuaaaagcuuauguugagaaguuuuccuauaagagcauaacuacugaugacuggaaggauuuccuguauuccuauuuuaaagauaagguuggauuuaaaaaccuuuucuauuuuucaugcucgauauaucucuauuuauugacugauuagguuaacuuguauuaucuaauaguaguauugguucagaacuuuaggacucaaccucucauugcauauuuuuucuauuuuaaaugugaucuuaaccacaugaacuaccuguagaauuuuccuauuucagagaagucaucaauaguauggugaugaauauaaauuuuagaagauagaguuagaugagguaauggauauauuagcuugacuuaguccacauugaguacauauaucaaaacaucgcauugugucacauaaguauacacaauuaugaucuaucaauuuaaaauauuaauuuuuaaaaaagauuuagaaauuaucuugauauagcagauuagacaaaauuauauaucuaaggacuuacaaguuuaaauuuuuuuuugacaggaaagggcauucuauuguaaacugugaauucuuacuauucauagguugauguucucaaucaaguugauuggaaugccuggcucuacucuccuggacugccucccauaaagcccaaguaaguacuugccugcuaaugcuuuccuucucauucuccuaacuccuagagagccucaaaauaucugaaagaauaguaugccuuccugaaacuguuacuaguaaaugaugaaagcagaguucuuagguguuuuggccuuaacccugaggccaaaagaauaauuucugcaguuuacaaauaugguuuuucacuucaaguaauugagugccuccuuucugcacaaggauggugagggauuuagacaauaagcuauuguaucuuccuucaaacuucugcaauaaaaauauuuuauaaguauuauguuaauuacaacacuguuauaaguuauuauccccauuucccaaggagguaaguuagguuuagcuagguaaagugucuugcccuagguugcacagcuagugaguaguaaaaguugagauucaaacccuggcagucuuauugccuccaauauacugcuuucuuccuucuuuuuuuuuagaaacagggucucacucuguggcucagccuggcgugcagugaugugaucuuagcucacugcacccucugccuuccaggcucaagugauccuccuaccucagccuuacaaguagcugggaccacagaugcgcacuaccacacccggcuguuuuuguacuuuugcuagaggcaggguuucaccauauugcccaggcuggucucgaacuccugagcucaaacaauccaccugccuuugucucccagaguguugggauuacaggcgugagccaccgugcccggccucaauauacugcuuuuuauacugaacccccuccuucaaucggaccugaacccuggucuuucacgaguugugugaggacacugaccauggcauguuccauggcauguucucuuguugccuuucuuuuggaucaccaaaauugccuaccagcuucucuuacacuaaacaggccaguuuaauugauguucagggagcagcaggagagaagcuaagaaacaagaugaggccuggucauguuuguuuguaaagcacuuuaaacagccaggccgagaaguguuugguugagaaguuacugggaguucugaguauggaacaaauguggucagagcgccccacuaacugggcaguccugguuaucauaggcuguggugggaaacaggagcucagguagggaggggugauuacgauagaauguuucgaauuuuguguuggaaacagguggcacaaaucaucaguaaacccuuuuaacgucuaaaaaagguaucagcaaaaauaauacuuuagauuuuuuuccuagcacuucauuaagaagugccauacauuaucucguuaauuuuuacaacagccuugcuagagauuaugaggaccugaagucauacaaaggcaguggaaaagaaaggaguaacugagagaagagacguuugggggcuagaaucuauuggcaacugauuggcuguggugagaaaagaagaaauuaaaaaugacugagcagagauguaauaaagauucagcucaauccagcacacauuuauugucaggcacuaauaugaugaauaaggaacucacagagcaaauauguauguaucaaguaauuauaauacaaugaaaaguauuuuuuuuaaaauauuaaguguugugggugaggaaacuauuaauuuuaauggugauggauuuggacaucgucuuggagaugacuuacaaaggagaauacaagaaguaaacuguagaaccuuagaggaucuucauuuuagagcuaggacagaggaaagguagcaaaauaaauggaaaacuaaaaagauuucaaagguucauuguuaagaaagcugugggaagaaauaauuuaaaagugguacggagaguggucagcagucuggugugcuguagaauuaugaggagccugagaauaaaagcauagaauuuggaguuuggagucuuucaaagacucuaacuucaggggccugauauagccaaaagacaguuccaggaaguuuaggaguggagaaggcuuugcccauugcuuuuaaaauuggggaaaucuggguggaaaauuaguucuucaaaaguguuucuuugauaucaccgcugcuaagggauccuuuuugggcguugguucauucuagaucccuuaagauugcuuucaaguaauaccaaagugcuggaggaacccuggaaucauucgugugcccgggaauucuguaaagagagaguaucuuagaaaaucucaaaccacagaaaauacuuugauccauugcagcacagaaucuuggcuuccacgauccucuuuuuauaaugcucucaucauuuguauauguauuuaaauaucugagucuauccacaucucuccauuucuacuaccacuguccaaguucaguaucacaucuucacauccuggaagacuguucuggcacccaaacugugcacuuguaucuguucugacuucucccagccacucuccacacuaaagcuagaguaaaccuuuaaaagcacaaaugugucauguuguccuccugcuuagcagucuccacugguaucucuuugcucuugggcuaagacaaaauccuuuaguggggauuauaagcuccuaacacucuagcucccuuugcuucagucacacuggcaguuuuggaguuucucgaacuccccauauguccuccaacauaguaccugagcaugcuguuuucucuacccggagcccuuugcccaguuaauuccaaucucagcucaagaaccacuuccucuuggaagcauuucuugacaucccuggccaggucaaaucucccauucuagggcuuuuuagugcuauauccucucuucguagcaguugcacaguucuaacuuuacauuuauuuauucguaugauuaaaguauuuccucuucgcuauacugucagcaccaugagaacaaggcacauaucugguuuugcucuuuacuuuucugaagacuuugccauaaguaggguccuuucccaggcuaauucuuaacuuaguacuuuuaauuacacuaauaaggaaguuucaggacacgaagaaacagaccagcuaaagguuuucuacuuugcuauuauuuuuuaagaaaucaaugcuaauaauguuuugguugaaagcaguguauucugaucagucaaggaccucugaucccaccuguucuugaagacaaaauggcaugccugcaguccacagccugacacuucauguaauaaacuggcagcugcuucgaggugggagcuguguugaccuuuuuauugucuccccuagggaacaaacggagucccagucacaacucucuuuaagggagauucagugguaacuucuaaucaaaacuuacuucauuuaggcucuaaggggcaggugccucucuguucccuaauacaagcauuucaguacaagcaagcaugauuuacggagaaagagggauguuuugcaagaauuuugcacacacuacauguucuuucccauuguugcaaaauaugauuucuaaguugagaacacacaaauauugguauaauuugcuuaacaauuaccauguguuaauuucauuuucuucuaaaaaggaaugaaaucaucaggcaaugguaucgggcucucucaagggucuagcaucuagaacggugccaauuauguagcaggugcuugcagguuuguuagaugauuagauguuuggaacaaccaaguaaaauccaugacagcaaggacuugauguuguucaucuuguugucuugagugccuagaacuguuccugccauguacuaaauaugcucaacugauuccaacuacuuuagcauauacuacucgagcacaugacagucuuuugcugaggugcuuuggcauucuuucuaaaagauagauggguguuucauuaaugugguauccauuuggguuugugaguucuuggaugaugccaguaguauguaaguuagguaaaauauuuccuauuuuccucacuuuggaguuuguuuuccuuauuuaaaagggacuuugaaauuuaaguauguacuguagcuuuaaaacugcauuucugcaaaagcacgugcauuuuuaaacaauguaaucuuuaucuuugcaguuaugauaugacucugacaaaugcuuguauugccuuaagucaaagauggauuacuguaaguaauaaugugugauuuuugauuccuuuuugaauugugcaaauaugucuuuacucaugaagcagggaggguacuuuaaaucacaaacaguuauauuuggaaaggcuauuugaaagucagguuuaucuaaggugauauuauaucuacucucaauauagaaaauuaaggguuugagacagggucuugcucuguugcccaggcuggacuacaguggcgugaucauggcucauugcagccucaaccuccugggcucagucaguugucccaccucagccucccgaguaacugggacuacaggcaugugccuccaugccuggcuaauuuaaaacuuuuuauacaaacagggucuguguuguacaggcuggucucaaacuccuggucuccagugauccucccaccuuagccucccaaagugcuggaauuacaggcaucaggcaugagccacugugcccagccuagaaaauuaaguuuuauggggggaaaaauugauguugaaggcauuaauccugauuuuucuugcuucuuaacucuuaaaaaaaaaaaguaugcaaaaauauuugcaucuuaccuuucuucuuuuccuuuuaaaucauuuauaagauacugcuuccaauauggcaauuucacauaccagguaaaucuaaaaugaucuugggugaccagcugcugacuauuaguggugcaaagaaucgaagcacuuuugcucuuuguucacuuucuaugaagcuucuuaaagaggagcuucuucauauauguacuaaaauagaacccuuuacugaagccaaaguaaggaugagcccuugauaauucuuuaaugaaaaauaacagaagauuuaggaauacuuuuauuccuauuaauuugcaacagauuuaucauuuuuuuacguaauuucaacuuuuaaguucaggggacacaugugcagguuuguuacacgugcauauugugugaugcuaagguuugggguaugauugaucccaucacccagguacugagcacaguacccaguaguuuuucaacccuugccccacuccuaguagugcccaguaucuauuguugccacuuuuauguccaugaauauacagucguuuagcucucacuugugagaacaugcuguauuugguuuucuguuccuguguuaauucacuuaggauaauggccuccagcugugcaaucaguucagcuauugccuuuuaaaaccuguuuuguguaguugacaaacuugucaugaagaaaaguauaagagauuucuaugggaaacaggauuuuuuaacagugugaguguauuaaaauucucuguuuuaguuugaaaaauguauuccagcuuauuuggugcuaguuaaaacugcuacuaauuucugcucaaauauuccuuugggcccagcaguuaagguggauaaugaucaacucuucaauauuaguagaaacaggcauuguuaggaacagauucaggacacuguauucacuaaugcacucuuuuccuuauguauuuuauuucucaaugauuugucuuaaauaguaaauaaaugcaaaagaauauuuauaacauauucauaugguguauaaaacaauugugugacccaccacuagcauaagaaguaaaaucuuagcgguaccucuguagcaucccuccccaucuuaugccccucuccacccuccuugcugacccauccagguuaccauuguccugaauuuugguuuaucauucucuugcuuuuuauguuuuuaccacauaaauauauccuuaauuaauauauaguuuagauuugcagguuuuugcacagaaaaugagcuggagcuguaaguucucauauuaaggauaaguuguaaagggaaaagaaguauugcuauuaaagagaguucugaagagggggaagaugcaaaauauuuauuuaaaaggguauauaccuaugcauuaaauuuaguggaaggauauacagaaacuacuaauauuaguuacugaggaguaguacuuggagacagggagcagauccaaaagaauuuuuccuucuguccuauuugauuuuuuaguauuugcauauauuucuuuuaaaguaacaaaagcccuaguuuaaaagauuauaaaaguaguucuaaaagauuuaaaaauccuuauuuuuauaagcuuuauuuaauauugcuuaaucaucuucucaaagauuuuugagaguaaauccaaauuugaaaagugcagacucauuuuuauuuuucuuagaugguuucuaagauuaaguggggaaaacagaauauguggggauggaggaaaacauuaguuuauggccuuaccaauuuauuaauguaauauuuaaaaauauacgauuucauucuuuaccuuuuugaauuggucuauagauuaguugacaugcauacauuuugaaauguuucuuugcuuuggaaauuucuauaccucgaaugguacaaugaaugucaacaguuucuuccacucuuccuacccauaaucuacuuuuucuuaaguaauauagauucuaggagucauaucagcuauuuaaauuacaguaacucaaucucaggauuauuuaaguaacucaggcuuaaauuuauuuugaauaaucuuguucauucauaugguucuuuuucucaauuuuuacuuuuaugucagauaaaccaauaaguauuauuaaauuguacuugaacaaaaauaacuagguaacauuuauuucaggccaaagaagaugauuuaaauucauucaaugccacagaccugaaggaucucucuucucaucaauugaaugaguuuuuagcacagacgcuccagaggguaaguacuagcucaaaaucuuagaaauuaaaauggacagaaaggcacagcauuuauguucuacccaacuuggcaaaagauuauuaauguggaaacuaauggggaaaaaaucauuuauaaaauuuauucauuucuuuaaaaaagcauugaaugcuuacuguguuuuauauugugcuaaauaugaaaauauguaagaaaggauauaccuuaucuucaaauagcguauaaucuaguaggaaggggaacacaugcaaaauuuagcaauaagccaggcacgguggcucacaucuguaaucccagcacuuugggaggccgaggcaagcagaucacuugaagucaggaguucgagaccagccuggccaacaugaugaaaucucgucucuacuaaaaauauaaaaauuagccgggcaugguggcaggugccuguaaucccagcuacucaggaggcugaggcaggagaaucacuuggacugggaggcggagguugcagugagccgagaucacaccccuguacuccagccugagcaacagagugaaacuccaucucauaaaaaaauuuuuuuaaaaacauuagcaauaaaaggaggcauacuuuagguaucauuuggaaaaacuuaauuagugaaagacucuuccaacugggggcaucagagagggaauuuuggaggagacuugcuuugcacccccagggcuagcagggagguagaaauugaagguggagggagcagcaagggcuggaauucgucugcagcauugcuggaguaaacaguagcacuggguaaggaagucagugaagguaacacuagaaaagcugguaggaccagaugugaugacucucaaugcuaagcuaagaaauuuuagaucuuacacugaucaguaggaaaagauuuuaaaaauccagcagaagagucgggaugaaaugcuggguuguagaaaacuaaucuggggccaugaagguugcaugguggugaaguuacuaguugggagacuggcaggaguaccggacuugagggaguaaguugcggggagaggagagaacaggacgugagaaagaguuuacacagggugaaagcacagagcucugugacugacuggcuauagggguugacaguaaagaauccaagcagauuuuaagguuucgaaucuaggcaauugaaagaauagaugaaaccgaaaggaguugcugcauuuugagauaaaccaaugacuggauuuuaaagacuuccaugaaagggaagucuucagucuaaggaccuugagaagaaagaagauuuggagcggaauuuucuguggaauugaugcaaaaauuaggaauaggauuuugacgcaacaaaggacccaucaaagagagaaucuauuuuuagugcaucgggucaucaugguuucauaaauugcucuaccacugguggguggucuagggccacagagagagagaacaugguagggugauucuggaauggguauagcaaaacuuagggcaagucagggagccuuggagaugaccuuaaccaguuggucuaccaggguagacuuggaguugcauguguccauaaggggcuaauggacuaaauuauuagcgacaggauuaguaguucaugaaagcagagauugguuagugaguguggaguccuguaagguaaggaggucgugguuggaggggagaguuaucaucuaccuagaggcaccucugccucucacaggcacuacaaacucucugcuuguccaaacugaacucaucuuuuuucuuuccuucacccaaacuuguccucccuuuuagggugaguuaagguagggauaggaugcuuauaaacccccugaaauuguauacagaaguuuguauucauguaguaaguguauuuucccccuagggaaagaguccacauuauucaucagauucccaaagagaucuauaauacaaacauuuaagaacugcuauuauguagguaugcagauaauuuaacagggauuucagaggaaauauacaaagauaaagcuagggggaaucaggcaaaaauuaaggaacuaugauuucaucuggagaauggaauugcauuuaagauauauaaguuauagagaauaacuagaaaaacucuaggaaaagucugaaagauaauauuuauacaugcuaaaaagucuaagaagagcaauucucauuuaaugcugaauacuucacaaaguaaauuaucccugugcucccaguagaauauccucaucuggaauaaguuugcacagaauuuacuuagugugcaauuuguuucuuuuauuuuuaucugacuuauuucuauauuauaaaauauuuaggauuuuaaucuggcuaugcauuucucuccagcuccuuucuuccaaggaauccuguugaaaugauacgguauacuucuuuauuuugcucuuaggcaccucuuccauuggggcacauaaagcgaaugcaagagguguacaacuucaaugccauuaacaauucugaaauacgauucagguacaucauuuuaacuugucucuguggaagaaagcagaaaacuaaacuccuuugaaagauggagaaagggaaugcagaguaugagacauacuugagucuugagaauuccuugucaaacugacugcuucuauauaaauacuuauagugguauuuaaggaauaguugcaauauguaaucugguaguauuaaucuuuuuguuagacuuugcucuaaaccucucuugccuuaaaagaaaaaaaaaaaauuagaaugaaggauuccgugguaaauaggcuuucuccacaaccaacuaaaucuacuuugaaaugggaauaguuagaaauauuuuauucuauuauauguuaaucuuucuuaauucaaauuuguaaugugaggcuuaaaccaaaguuuaauuccuucagaaauugcauguauaagguaugugagcaccuaccugaucuuucuuaauucaaauuuguaaugugaggcuuaaaccaaaguuuaauuccuucagaaauuggauuuauaagguaugugagcaccuaccugauccagaccuuuaaaaauauaugaucuuuuucaagaaccagcuccucuucuuucucuucaccaauuauuaaauuguauauauaaggauuugagagucucagaaucaagacauaccauaaagugguguacaguauaacuauagugggguuauucauaucacuacagaaguaauauuaagauauaccugucauauccugccccuuccucauuuucuacuccaugcuccccccaaauccuccuuuuagauggcugcggcucugcauucaauccaagugggaggacgcaauuccuuuggcgcuaaagauggcaacugaacaaggaagaaugaaguuuacccggcccuuauucaaguaagaacccacucagaccguacuuugaauucaucuaagaaacaggaagaaaacugucaaauauuuaaacguaaucuauaugacaauauuuuuuaauuuguuaaaguuuaucaguauaauuuuggaauagggauucacacuuauaaauauuuaaaaugugaaauaauuucauuccucuuuuuagaagcauuauauauggauuacuauuuuggaucaaauagaguuagauacugauaaaauagaaauaaaucaaagauagccuuauauacacaaagauuuuuaaagguaacuagaagauaauugguggguagguauagacaagaaagagagucugaaguuaaauguaaggagaaauaagcagauaaagcuaacucuuuuguguucaaauguugcauagaggucaaggguagguugcuugacauaauaaaggaaugcuuagugagagggggauaaguuguaucuugacagcaagauacaagaauaucucagucaaggucuuuaugaauuuuguccaaauucuggaaaaaaaaaucaugccauaaauauccaugauuacuuuuguuugcuuuucauuuacuucacaaguauuuaggugggugcaaaaguaauugcaguuuuggccaucaaaagugauggccauauaauaucauaaaacuuggcaaaauaagucauuaucucuuuuuugaugugaccacaaaauuaaguuuuaaguauauuuuauaugcuuucccuaauuaaaacccaucuagcuuugaauugaguaaaguauacuuuaaauagguuuuuaaauaagaguauacuugggccgggcgcgguggcucacgccuguaaucccagcacuuugggaggccaaggcaggcagaucacgaggucaggaguuugagaccagccuggcuaacauagugaaacccugucuguacuaaaaauacaaaaaauuagccagguguggugguaggcaccuguaauccuagcuacuugggaggcugaggcaggagaaucgcuugaacccgggaggcagagguugcagugagcugagauugcgccauugcucuccagcuccuccagcccgggugacagugcgagacucugucucaaaaaaaaaaaaugaauaaaauaaauaagaguauaccuuuugugggaaaaauaaguauuucuguuuuaugauguuuauaguaguuacauuaaaaaugacuaauccuaccuuuuguaugguagguccuuuuuauuuaguguauuuauuauuuauuucguguauuauuuauuauguauuuauuauuucacuguggucaggacuuuuauucucaauuauuugaaguuuucagaaauucuauauaaauuuuaguguuuucauacucuuaaaaucuugauuaaaaaauuuuuuuuaaaagcaguuuuuaaaaagaaaggcuuugaggcucacucucacauacagggcugauauuuagccaggagaugagaggacucuguucaaauaauaaaauccuuccaugcugcuugguaaauagccacgggucccagccacucuagcccuucccuguaacuugcugcaaaaugucugaucugccaguauaaaggccagucucugguacagaaggaggucucugggacccuguggcaggaccauacccaucugauuggcugggacuggugccuuauuugggugaugcuggcugucaccccugcugacauccuuuaauuuaaucuuggguauugacuuguguucuuauucucuuucuccuuccuuuuuccuuuccucugaaccccuucccuccuuucuuucuucucucccucccuuucuccuccucugucuccuucucgccuuucuuucuuuucaauuuuuucuuuuuuggcagggaucuugcugccuuugacaaaucccaugaucaagcuguccgaaccuaccaagagcacaaagcaagcaugcaucccgugacugcaaugcugguggggaaagacuuaaaaguggauuaaagaccugcguauugaugauuuuagagauuucucuuuuuuaaauggaauucguaaagaaauauaaaacuucagcucacaauuaaaacugucuuuuuaguuuuggcuuuuuauuguuuuguuggugauuuuacugaaauaaaguugagcuacuucuucuuauaguggcauauucuuuguaaauuuuaacaagguuuaaucuuuugauuuacaaauuaaaaaauuuugaauuagcuuuauauuaauuuucucu

SEQ ID NO: 16367 - RNA, 657 nt, Homo sapiens
cacuguuuuguuuuguuuuguuuuccugccucagguuuauuuguacaaauagcacaggaggaccagccccaugcagaugguagcccaggggcggggguagggggucacaccaguccuucuguccucauguuggcagagauaucuacucugaagccuuuguaggggccugggcaccuuugggagccugagcuggaacugaagguggagcugcagccugggccuugguuugauccuuggccuuggccuuuggccggcacagccugagccccuuggcaauacgggcacgagcacgcuucccaagcuugggaugggcaauguaggcaagucgaucgagcuugcggcugacacccuuugggaucuugggcuuaaccuccuugggcuuuacgagggccuugauagccucggcacgugcacucauggccuuggcauuguuggccugcaucuucuuuaggcccuucuuguugugcuucuuggcaaagugcauguuccucaggaacuugggguccacccccuuaagagauucguaucuuugugaucgggguuucuugauaccauuucugugccauuuucgggacugguuguguguggugugguucuuggacuucgccaugucuacaccuuaagccgcggcucccgaagcaccuagaaccggaagag

SEQ ID NO: 16368 - RNA, 1244 nt, Homo sapiens
uuagaugaguagauaggccaggagauacagcaaugacaaaaacuucaguuuagaagcaggaacccgcauccaggaauagagcccuuugcuccucccucagaaugaauggagaucaaaaaucagaugcuuaugcccaagaaaaacaggauuucauucagcacuucucccggauuguuagggugcugacugaggaugagauggggcacccagagacaggagaugcuaucgcccagcucaaggagguccuggaguacaaugccaucggaggcaaguuaucaccgggguuugacggugcuuagcauuccgggagcugguggagccaaggaaacaggaugcugauaguuuccagcgggcccugaugguggguugguguguggaacugcugcaagcuuucuuccucgugguagaugacaucacggauucaucccucacccacuggggacagaucugcugguaucagaagcugggcguggguuuggaugcugucaaugaugcuaugcuucuggaagcauguaucuacugccugcugaagcucuguuguugggagcagcccuauuaccugaaccugauugagcucuuccugcagaguuccuaucagacugagauugggcagacccuggaccccaucacagcacccccagggcaauguggaucuucgcagauucaaggaaaagaauuacaaauugucaaguacaagacaguuuucuacucuuucuaccuuccuauagcugcagccaugcauauggcaggcauugauggugagaaggcacacaccaaugccaagaagauccugcuggagaugggagaguucuuuaagauucaggaugaucacuuugaccucuuuggggacuccacugugacugacaaaguuggcacugccaucuaggacaacaaaugcagcuggcuggugguucagugucugcaaugggccacuccaaaacaguaccagauccugaaggagaauuaggggcagaaggaggccaagaaggugguccaggagaaggcacuauaugaggagcuagaucugcuggccguguucuugcaguaugaggaugacaguuacagccacagccacauuaugggucucauugaacaguaugcaaugccccugcucccagccaucuuucuggggcuggcgugcaaaaucuacaagcggaaaaagugaccuagagacugcaagggcagggagaggaggcucucaauaaauuacuguguaaccuugaaaacaaaacaaaaaacuucag

SEQ ID NO: 16369 - RNA, 1244 nt, Homo sapiens
cugaaguuuuuuguuuuguuuucaagguuacacaguaauuuauugagagccuccucucccugcccuugcagucucuaggucacuuuuuccgcuuguagauuuugcacgccagccccagaaagauggcugggagcaggggcauugcauacuguucaaugagacccauaauguggcuguggcuguaacugucauccucauacugcaagaacacggccagcagaucuagcuccucauauagugccuucuccuggaccaccuucuuggccuccuucugccccuaauucuccuucaggaucugguacuguuuuggaguggcccauugcagacacugaaccaccagccagcugcauuuguuguccuagauggcagugccaacuuugucagucacaguggaguccccaaagaggucaaagugaucauccugaaucuuaaagaacucucccaucuccagcaggaucuucuuggcauuggugugugccuucucaccaucaaugccugccauaugcauggcugcagcuauaggaagguagaaagaguagaaaacugucuuguacuugacaauuuguaauucuuuuccuugaaucugcgaagauccacauugcccugggggugcugugaugggguccagggucugcccaaucucagucugauaggaacucugcaggaagagcucaaucagguucagguaauagggcugcucccaacaacagagcuucagcaggcaguagauacaugcuuccagaagcauagcaucauugacagcauccaaacccacgcccagcuucugauaccagcagaucuguccccagugggugagggaugaauccgugaugucaucuaccacgaggaagaaagcuugcagcaguuccacacaccaacccaccaucagggcccgcuggaaacuaucagcauccuguuuccuuggcuccaccagcucccggaaugcuaagcaccgucaaaccccggugauaacuugccuccgauggcauuguacuccaggaccuccuugagcugggcgauagcaucuccugucucugggugccccaucucauccucagucagcacccuaacaauccgggagaagugcugaaugaaauccuguuuuucuugggcauaagcaucugauuuuugaucuccauucauucugagggaggagcaaagggcucuauuccuggaugcggguuccugcuucuaaacugaaguuuuugucauugcuguaucuccuggccuaucuacucaucuaa

SEQ ID NO: 16370 - RNA, 1849 nt, Homo sapiens
acguguucaauuuuuacaucaguaauuuauucuagaguuuaccuguaguauacagauuacaauaaugagggaggaaguuuagucaguugauuuaaguggaugauccuagguagagagggucccaauuauccuggucagcaugucugagaccguccaaaacaagggugccccacuccggggccauggacuggcacccgugcauggccuguuaggaacugggcugcauagcaggaggugaguggcaggugaccgaacaagcgagcgagcaaguggagcuucaucuguauuuacagcugcuccccaucacucacauuaccaccugagcuccgccucccaucagaccagaggcagcauuagauucucauaggagcaugaaaccuauaugaacugugcaugcgagggaucuagguugggcgcuccuuacaagaauguaaugccugaggaucugucacugucucccgugccccccgagaugggacugucuaguugcagggaaacaaacucagggcucccacugaaucuacauuauguugaguuguauaauuauuucauuauauauuacaauguaauaauaauaauagaaauaaaaugcacaauaaauguaaugcacuuuaaucauccccaaacuaucccuuccccucaacccgcccacugucugaaaaauuaucuuccauaaaaccagucccuggugccaaaaaggugggggacugcugaucuaaagugcaaaaaugucaaagaaaaauccauaugaccuuucaagucaaguuauucaccuccaagaugaaccucuaagaugugacagucuauaauaugccacagagucaacaaucuaaagaaagauacaggcaccuguaucucaaaucuaagagggccuauguuacucugcacauuaagacuucucaucuccaugagaagucucaaaaauuguuaaaaagucuauuaaaaaucauaauaaggccuauaaaaccuuuagacuuuaccuaguugaggccuuacaugucccugagaaggauguauuaccguguucauuuuauaaauaagugaacugagguuuuuuaagagauauagcuacugagauaaugaaucagucucaaaggcuauguagaagaaccaauuucaauucguuguccuccaacuaauccauugccggacuuuuuccaaaugcacacuuacaaaaaguaauuuguaaccgucuaccuggaagaucuagccaucuguuagacaccuggagccaagaaugucugaaucugcacgaaugccaagaagugugcaaaacugaacuugcgaucugccccaccauuuccugggcaugcccaggguggcagcggugcugguaccuuccaccugccccucaagauccaccccaucuucucugggaguccaguguacauggcugcauccauggacaaggcuuccugcugggcucgccccugaggagcagcagcagggggaaggagggagaagagggaggcugggguguucauuuccccuguugccuucucuauggcucacugugggcuggcuccauccucuaacugaagggcacagcuugggucaggaagcccccuccacagagccucuucacccccagguuuggguaaguacucccuucccuccucaggucuagggcugguguuagcccuucugugacuaaccugaaggagcucugcaaugaucugcauuuucucucuaccuuuguaagaaguuacuucauuaaugcucuucagguuaucugauuuggguguaucaucuguuuccuguuuggacucuaggugauacuguagucuugucaaagcccagaacugaagccuucauaauaaaugaaaagaagggcuccauuggaaauauc

SEQ ID NO: 16371 - RNA, 6091 nt, Homo sapiens
uuuacccacaguaagcauggcgggaagagcuucgauccgacccuugaacgcucaauaaaaauggcgacagcacuuccuguacuugcccucaacaaagauggugucaacacuuccuguuuaggguuuucgccauuaacaaagauggugcuuauggggcagguucccuaacagucaggauuccgguugcaguuuuucucccccgccccaaagauacgugguugcagacguaaguaacaggaauccaucuuucuuugaaaguccugcauuguagcgucugcgaccugggcccugcgggggcuuccccgccccgcuaacuugcuccgcauuuccgauccgggccaaggcuggguggcugcggcagugccggaggcccgcucuccccuugguccgcucuuuaguucauucccagcacucccucuuuagcgggucaaguugccgcagaaaccgcccguagucuuccuguuugauacaaggguuucagcggccgaagcagagccuuuuuaaauaguucccaaugggcgcucacggccaaacgugaacaccuccccuccucaccugucaccuccugaacuuuacaggguugcgagggggagugugggaucgggugucgccuagccguggucguacugcccgggugugucugaagccccaucugucaucccugccugccuucccggucacuuaaccuucacugccuuacacacaaccaagccacagcacacuggugcaggggugguggaacugcaccuucaaaucgugccuggcuacugaccagugcuggggugugugcuuuuuuugaaagaaaaaaaucccauaaaaugucccaugcaugugcggccacgacaguguugugcuggagauucggaauucuuagugggaaggaauggagucugugacuguauauuguguaaaguuuauuguagacugggcacaaacaacaauuuucuuaaaggugaucguguagaggacuuuuagcgaaaagagccuuaaauucugaaccugcugauuucuguccugcacuccuauuacugaucagguuuugcaaauacuugugaucaaaaaaaggggaccugcguccaccuuggcaguuucugccuugguggugguggugcaggucugaugagggcaaugugaaaauaaaaccaccauuucuucuccagcguguuaaaauuagugcugcucuguaaucuucagauaaaaauugcuuguucagaagggucucugacccacuuuuuuuuuuucuuuuuccaaauuucuuuauugaacgaggaauugagcugggaccccauugugugaaaagcagaaacagaaaagaugauucaucuucauuguuguucauuauguuaggaaacauucaaaauuaaccuggcuuggcuuaaucagugaauuaaauaccaugaccuggcagucugcuaugguuuaaagaugugcuugaccugaaggaacuuacauugcagugacacugucuuuagggccacaucaacaugucuguaauuugagcugugauuuuggcucuuuccagggagaaauggaggccagagacaaacaaguacuccgcucacuucgccuggagcugggugcagagguauugguggagggacugguucuucaguaccucuaccaggaaggaaucuugacggaaaaccauauucaagaaaucaaugcucaaaccacaggccuccggaaaacaaugcuccugcuggauauccuaccuuccaggggcccuaaagcauuugauacauuccuagauucccuacaggaguuucccugggucagggagaagcugaagaaggcaagggaagaggccaugaccgaccugccugcagguaggccucagaaagaucacuuugaaccagcuccaaaauguuguaacuaugcucuuugcuuuuuuguuuauuuguuuguuuguuuuugagacagagucuugcucuguugcccaggcuggagugcaauggugugaucucggcucacugcaaccucugcuuccuggguucaagcaauucacuugcuucagccucccgaguugcugggaauacaggcauuugccaccaugcccugcuaaguuuuguauuuuuaguagagaugggguuucaucauguuggccaggcuggucucgaacuccguaccucaggugauccacccaccuccgccucccaaagugcugggauuacagacgugagccaccacaccuagccagaacuaugcccuuuggauuugaaguugggauguaaggcaggacaagggucaaugguugaugaaaguggguaaggauuugggacugaagggacaugacguuggaggaauaggaucaggagguggcauuaggaagugcagggaaggaagaaugaaccgugacugggaggugagggagggagcucagagaaugcauuuagaaaugcuuccaggaaaccuggcaugucacuugggaagcauguucucaucagagagccaggucauaucucagccguuggcaucaggagccauuuggaaagugcagaugggaaagcaggcauucggccuacugacaacugauuugugaggugccagagcuaccagcuggaaaaggucagauucauggaggaggagacagccucuaggaaggcaugcccugcaccuguccccugggcuguccuguguggccaaaggggauuauuuugaaggcugacuuaguuuguuuuuaaagguuauucguuuaaaguguccuuuuuaguuuagcuuuguucagacacuggaguauuuaauuuugcaaagagcaauaguuuggggagggucucaguuuaauuugaaggagaauuggaagcuggagaagagagaaacaguucugguucuguuagccuggcuuguagcaggaagaagaugugauauggaaacacuugcuuuuucuuaaccucccuugacucuguuucacaaagauagaggggcagagaacugaacuggcaaaaauuaaaaauugaaaaaaaaaaguaauugaaaguuggcuugcaaauuuuuaacaaaguuagagaaucaagguucucugggguuucugauaagagugauagaacuauuccgguucagugggccccagacuucgugguugcuauuuuuuaaauacugguuaaaaaaaaugaauacugauaauaagaccacuuuuacuauuuuugcuccauggaccucauauuuugacauaugucugaauaccugaucagcaugacauagccagcuaacuuuaggaagaccugguaagaucccaguggaaaaagcaaaaguauuuucauuccuagucugggcucguuacaguuaaauguaucuuuaggcuuuuugaaauauuagacauagcuggcuuuugaggaccacuggaauucacugcuuggauuguccuuacaaaauuaaauacuccacaugucugaacaaaauguaucuagauguuuuuaugacuuuauugaaagcagaauagauaacauagaguuggagaaauguuaaaaaauuauugguguuuuccugauauuugacuuagagguuucugcuggcaucauauaguuggaaacaacaaaacaggugaacugaaagccuuucacuaucaaaauacugaauuuaauuuuauggucauuuugggugauacagaucaugcuguuguaugucauucguagagguauaauaccauuuuuuuuuuuuugagacggaguuucacucuuguugcccaggcuggagugcaauggcgcgaucucggcucucugcaaccucugccucccggguuuaagcaauucuucugccucagccucccgaguagcugggauuacaggcaugugccaccaugcucggcuaauuuuguauuuuuaguagagaugggguuucuccauguuggucaggcuggucuuaaacucccgaccucaggugauccgcccaccucggccucccaaagugcugggauuacaggcgugagccaccaugcucggccauaaccccauuauuucuucagauucauucagagaguuagaaagaauuaaggcauuuuuuacaaaaugaugagaguuacagagaagcugaggaaaaauagcuuuuuaaaaaagcaaacagaaugaagcaguacauaaugggaaaaaaauugagcauaucuguguagaaguuuagaaaaauaagguuuuucucaagauuuguuaauucuguagaagguuggcucuggaacaaauucguacagucaucuuaauuguuuuacuuuuuacugaguaacacugcuauugaaaaaaacauucugaagugaggguuugauuuauauaugucuuugaauaccuuccacggugacaaucacauaaacucuuuuaaaaaagacuuguauuuauuaaauauugacuauuuuaaauaauauuacaaaauauaaguaagauauggagaauaaugguacagcgaacacccgucuccucaucacucaguuuaagaaaaauaauauuacgauugccuuuaaaaaccccgggcacuccuucccaaucuugucucauucccaacccccacgcagugaaaagcccugaauuggggguuuaucauucauucacuucuucacuuuauaguuuccuaucuccuaaaaaucacuuuuaaaaucuucauauguuuuugaaaauccuguauaccguaaguucuagagguguguguguguguauauguauauauguauauagagagagauauauauguuuuuugugugugugggaaggaaaggguggaaguaauggaagaaauuaugcauuuaaacuugauaguuaacaccuucucuuguuucagaacuuaaaauauuuuuuacauguuuaaaguaauuuaauugguggcaauauuuuaauucuaaaauuaaauugggauuuacugaauuggaaaccuagguuuuguuauuuuguaaauccugggaagaguaucagaguugaaaucccuucaauuuaacgucccuauaaaaaagaaauccagaaccuacugccuaagaccucggugcuucuccaguguuguaauugaguaauuuuaguaagauuuaaaauaguccacuuaaauuuuuguaaagauaucuuugaguuuugaggaucuagacuauaggagaauguguguacacauuaaccucuuaauguauguacacauuaaacucuuccuaccuuuuccucauuuugaucauacuuauuaauuaauuuguauggauucaguagucucuugggaggccuugagaacaaaugggaaggaauggccuucuuuuuuagccaagacguugauccuucucuaagaaugaacugauuuuaucuuauuaagguuuucuuguguuggucuucccagagaugcuugguuuccccuuuauugguuuguuguuuuaauuuucguuguuucacuuguaaauuuugagcugucucagaggcuuuauuuuggugauuguuccugguuaguugcuuuuuacuuaugugcuggauguaauuuguuuagagaauugagcuguaucuuguucuucucuacucuucugaacgccacccccaucaaaucucaaaacauacaaaaacacccuaaaccuuuugauucucucagaaucugccucugugacuagucucccaaucucuguuaggaaaaaaaaaaagguuuaaguuguuaaaguuguuaauggaucauugguuuuguguuuuucucacccuguaaggacucuuaccuuuuaaaagaggaauucuggugauaaaaugacuuaauccaccuuggcaccguggagagaacacuucaugguuugucucucuggccaaggucacauacuagacauuagaucagcuggaaauccucucugggcuccugucaggucauuuaggagauagggacagugccgugucugggugaaggcagccugugccugccugccuggcuucucacugcucauggggccugucggcacugacaggcucccuccagugccugagcuaaucuggaucuggaaaggagguugauggcagcccagccuccccaucuggugggacucagcguaaaucacggugggagugacuccugggccacaggacccccucccuguuccacuguguuggcccuggcugugggucugggugucugccaugauucucugccuuuugccccagucuuccuuuaa

SEQ ID NO: 16372 - RNA, 7643 nt, Homo sapiens
auuguuauuuuuguccauucaauggcuggaaucaauagaucacaauauaaucuguugucaaugaagauguggcagggggaacuuugugguuguggcaaaguagaaggcauuguagaucuugggcuaaaaauauaagaaagacaaggauuugccugauggcuuugucagucaaauuugccucuuuuaauuaguauggguuuuaaaaaugggagaaaaauuuagaaaagaguaauuggcucagagaaacuuguaauaaaaaaacacuccuucccugcaagcauuggaaaagccagagaaaagccagauaaauuggcaggacuuacuagcaugaugcuuucucucucucucuuuuuauuuauuauuauuuuuuggcauuguauaagaaacaagacuugacuuuaguauguauuuuagaauuguuggcacauacugaaauguaacauuuuuuucgauugggaguuuuugauaacaaaacagacaaaaaaaccaauuuuccucaauucuuuaucccgguccuauguuuaaauauuguaaaucacauuugagaauauuauaguuacauuuguuggaauaguacacagugauuugaaucaccuauuuuaaaagcaaguuacuugccaagcuacuuuuucacuuaaaauguuacuuucauuuauauuaaacccuauauauacuguuuuucuaaggacaauuuguuuacaaguacagaauaaacuacuuaauguacuuugguuuaauuuacuuacaugugagguaaguauuuuuuucuaccaucaucaaaggguugccacaagaauaaaaucaggcauaugcuauaauauguuggugaagagagauuaaaaccauaaguaaaggcaaagugauaaaggcaaacugauauuauuauaucacauuccuuuauggugggacaugauaauuaugauuguaaauuuaacgcgauaggauagcagaaaaggccuauaugugugaucagcuggccuuuccagguggaauguauauagaaguuguccugugguuugaggaagcagcuacuauuugcagagccucccucaugugguucugccacaagccuuggcuaaagguagccucacccgugauugccagccugcagguugguucacugggugcugcugcuucucagaauuccgugacuaagccaggagugguguuuguucuuuacugauagguauucuucugccugcucugcuuaccacaucaucacaccaggccuugaccuuugugaaccucucuggaaagucaaacauaccuagaggcugaccaggcuuaggucuaauaacaccaucaacugcucuuugcaaggucauggaaaagagguuggaagugauucaaaugagaaggaaacuuaauagcucauccaguccaaauuucucaugacauggaugggaaaacaaaaauucagagacguuagggggcuccauccggguccccucuacugugaugccuuucuggacaucccaaggugauuacaguggugcuucuggcuguuugcaaaaccauucugugcacucucccgugacuucucacccuuuguuagaauuaucuguugaugguuucucucucacuagaacuagaccucuuuaagaggaaggcugagucccccuaguggguucuacgaggccuggaacauuguaaguacucaugcauguuuguugacuugaugaaucucucucaugcuacuagguacuauuguuuuggggccaggcucauggagauuaagcaggaacuucaagaaagccaagcucuucuugguagcacaccagagucugaaggguaagccaaagaguaagcugggaagcacauccaaguaggggaagauaaaaaaaaguggauccagggcagaaagaagguggcaaaaauguuucgguucccucacuuacagacgcauuagauucauuuauuuauuuauucauucaauaacuuuauauugggccagaagcuguuguaggcacugaggauagaggggugaauauaacaaagucccugcuuauaucacagugggaagaaaggcaguaaacaaauaaaugaguaaccauuauauggucagagaagaguaaaguguuaggauaaaaaaauaaagcaggaggaagaaauggucacugguggggcuucuauuuuacauaaaguggggagggaaagccacucagagcaaagacaugaauggagugagggagcagcgacaugggacuacuggggaaagagcauuucaaagagaacaacagguacaaaggcccugaggcaggauuguuguguuugggaaauaaggaagccagaagguuagagcaccauggcucuaacgaguaaaauaguguccuucccagcaccaaagucuuauugauugaugauccucugacuauacaaaccaauuccaauaaagagagucccagccaggugcaguggcucacgcuuguaauccuaacacuuugggaagcugaggugggaggaucacuugagcgggggaguuugacaccaaccugagcaauaaaaggagauccugucucuacaaaaguacaaaaauuagccagguguuguggugcacaccuguggucccagcaacuagggaggcugaagugggaaaacugcuugagcccaggaguuugagguugcaaugagccgagauugugccacugcaccccagccugggugacagagacagugucucaaaauaaaaacaaacaaacaaacaaaaaagagucccauacaaugcucaaggcagacuuuuauuucucaggguuaucuuaauaaagaccuuccacucccuuagaacaaguguucucaccugaggucaacagacccaugcggauuuagagugaggugucagguugucaaucaagcccccaaaucugugcaucuagaacauuuuucugcagagaaagucuuagguguagccugccaauaaaugccugcagagcuaggugggaauauagaagaaugaaauacaucaggugugagaacccagucucuuaaacacagaggaauauuauuuucuuccacagagaaauaugccuucucccuuuuauucugacauauucagccuucugggucugucuuuuauuucgucacuucugguagagacuuggguccaaauaaauaucucuccaccauaagaaacaguaaugcaagggugaugacaaaaggcaagcaaugcucaguguuggggagaccuuggggcgggugaggauugggcaaacgggagggcacaugccuucuaaggcaggcacucacuccucugcuucaguugaucacugccuugaggaaaugggacccaguauugacagaccuuauggcugauuaagagaaagcagaaaucugguucucuuuggagaugaaaucucaauuuaguucacauuuucuuuagagaauccuggcauaccaaccagaacacucugagugagucaaauauggucccgauaggcaggugguuugugaccucuggucucuagauucuaccggaauuucugauugauucaugucuuaaauaagauugaugacugcuguccuagaacauguuuccccuccauucugugggcggaaagacagacggcauggacauuuaccauguucuugggucccagaaguccaggagaaagccaucugccucacugcucccugccccauccugggcccagagcacuaaugccaguggcaucagcucugcuccucucccucuuccuuugucuaccagugaguguccuccauuauggggauggagcaagcaguauauuguaaaagggacuuagugcugagaagcaccagaggaaaaguaggagaugcucauuaaaguggaaggcagcucucuucuuccccuucucaauucugcauucugcucucuccccuaaaugccccccacccaacccccaaacucuugagaaugcccaaauccaaccaggucaggaaaaaauaaacucacuggcuccuguauugagaaguccaaguguggugcggcuuccggcaugugggauucaagcacucaggaauuucucccucucacccaaccucagcucugcucucuucucuguugccuuuguucuuugacaggcucccuccaagugguggaaaaguugaccuguauggucauuaucacucaucauuucagaaggggagagccugcuucucuuguagcauuuccaucaaauccugaaaauaaaaauaaucugguugguucuacuggacuugugauacuggacaaaccucuauguccaagagcucgagucauucccauuggcucaccugggccacacacucuucguugagugcaucccaggaucacagggagucuugagggugcugugugugguggugguggugguacggagauggcaaacucuaaaaggaagagaugguggauacuuaaagccuaccuucugcccacaggugugucagacacaaucuccaaaggccauccuauuguuacccuaucccccaaacaaacacugaaaaacucuccuggcaauuuggcaguagcucaguguggagcauuuguuaauuccaguacuagaacgucugcauugcaaaaccagaaauguccaguucugguuuggcacacagaagagauuuucaagccuuggcaacuccucagugcaggcaguggaggaaaugcuccagcuuugugaaaaucuucucccuucgcuccucauggagaauaaccguucaucacugcagccaugaaucugccacacugaauagauauggucugaaaaucuaggaacaaauggaaucacuuuggaaaccuguaaauuuuaaagccgaaagggcgcuccagggaaccaacuacaugaaguucucuggaagccacaggaugggagguuugguggggguggaggugaccauugaauuuuacauaggcaaauguaagacaaucuuauccauagacagaaaaauccaaacucaccgagaguaaaaggaugacaguugaaauaacagcuaauuguuauuaaguauuugcuaaguuccaaagcacuuuucauagauuagcucaauuaauucucacaacagcccuguaagguagggaccaugaucaucuccagaagaggcuaaauaaauugccaaagaucacauauguagcaagugguggcagagugaggauucauaccuggacagcuuaacuuuaaagccauggugcuaaugcauucauucauucauccauccauucauucauccauccauucauucaaugauuauauuggaugccuacuacaugcuaagaacuauguucaaggugcugaacuacagcugugaacaaugcaaguacaaauacaugaagcagaguuggggagaaaguaagcuggagaaauaagacauaaacuagguuagauggugaacaugauuaaggaaaaaacuagagcagggaggaaagagaaaugugcagggggaaggucaauucugagugagccaacaggcaaggucucacuaagaaagcggcauuaaauaaagauuugaggaagugagggaguaaaccuugcagcuaucuaaaaggagagcaugagagguagaggagacagcaaauacaaagacccugaagcaggggcaaggcuaaugaguucuagaauuagcaaggaguccaguguaacuugaacagagugaucaaagaacagagcaggaggaaaugaggucagagagguaaacaggcuggagugcaguggcaccgucucggcucacugcaaccuccaccucccggguucaagcgauucuccugccucagucucccuaguagcugggauuacaggcaugcaccaccacacccggcuaauuuuuguauuuuuaguaaagacgguguuucaccauguuggccaggcuggucuugaacuccugaccucaagugauccacccgccucaaccucccaaagugcugggauuacaggcgugagccaccgcgcccggccaggauucuuuuaaucaaguaugaugcagccaucaggguuggagcauucuaggaagagggaacagcaugcaccaaggcaacaggaaagcacauaaaaaaggaguugcuggaagauucauuucaacccacuaucaaguaaauauuaaacuuacuguauaaaaauguuagggccaggagggguggcucacgccuguaaacccggcacuuugagaggccgaggcaggaggaucgguugaacccaggaguucgagaccagccugaccaacagggcgaaaccccgucucuacuaaaaauacaaaaacuagccgggcgugguggugggcgccuguaaucccagcuucucgggaggcugaggcaggagaauugcuugaaccugggaggcggagguugcagugagcugagaucacgcccugcacuccagccugggcgacagagggagacuuggucaugcucccuccccgcccuccgucaguuuuaggaauaaauaccuuuuuauuuaagcuaaaguguggguacacccuuccucuaggauucuccaucaaggaauaagaagccauauuaggacaauuuagagggcaguuaacccuaguagacauagugguucuuaaaaggcuuggggccucagacuguacacaggcuucacauggaaucugauuuguuccuuuaucccagucccucacccagaacccgaaucuagcccuucauguuauaaaaagggccagagguccaaagaggguaagugccuugugcaaaauuauucaacuacuuuguagaggauuuuaacuaggguucaguuagcuccgcccacacuauaaaaggcucuuucuaaaaaacgaaacaugauuaagggcacacggcuccagcguuaacaaagcucuuuguuagcugggaaaugccccccuccccgacucaucugcuuaucaucugcauagaauuauguacucaaaagcaggaaaauuauugagaaaaccauugguccccggcugcagaccccaagguugggagcugguucccguuuccucccagagccggcagggggggcaccaggcaaaguuugcaagacgcgccucccucccaccccucccccuuccucgcccaacuucccauagccgcggccucaacuaaaaguggccauugaccuuucaagcuuucgagcagugaugcaauagaauaguauuucaaagaaaaaugcuuaucgaaauuuuggauccgguuuucccgugauuguuaaggguuucuuuuaaaaaguaggucacauuucaaguaggucauauuucgggggcgggugcgcagacaaggagaugaguuuccacuaaggccagggggccuccaacgggguuggaggugagaaucccagguaggguagaggugccgagauccuuccgaaucccagcccuggggcgucagcccugcagggaauggcagagacacucuccggacugagggaaccgaggccagucaccaagccccuuccgggcgcgcagguaagggcgcccccuuagcagccggcgcaggugacccgggcgggccgccgggucuaccggagacguuggagcagaggggaggaggaagggaggagccgggugggugcgggugacaaggagccggagcgccagggggaggggacuaaggacggccggcgccgcuuaaggaggcgcugcucucccgcucgcugccuuccaggaccugaucaaggggaccgccuccgguccccggccgugggcaccgggacgagcacggcguc

SEQ ID NO: 16373 - RNA, 3904 nt, Homo sapiens
aguuuggggcugguagaauucaagggagaaguacucuguuuuuuaucaccacuucccaaaauuauauaguugaaggcucuuauaaugauuacaaaaauaguaacccccacuugcuugugcuagacagaauauaaagcaguuucacaacauuucugcguugaauuagaguaauccuccugguaucugaagaccuccucugagcccaguguaugcuggcauugccaccagaaucuuaggagugaggccuuuggccaggcuuggggguucuaauaaauuuagcauaugggccaggcgcgguggcucacaccuguaaucccagcacuuuaggaggccaagguggacaggucacuugaggucaggaguucgagaccagccugggcagcaugguaaaaccccaucucuacuaaaaauacaaaaauuagccgggugugguggugugugccuguaaucccagcuacucaggaggcugaggcaggagaaucgcuugaacccaggaggcagagguugcagcgagcugagauugugcuacugcacuccagcccgggugacagagcgagacucugucucaaaaaaauaaaaauaauaaauaauaaauuuaaaaaagcauagcauauggaacacucuucuggaaucagugucuguaacagaaaaaaagaaaagaaaaauuugaaguugcaauuacucagauggguuuguggacacuggaaaggagaugaggaaccuacacaucaccuuauuuccaggagaagguggguggcggauucaugcuuguucucaaucguagcgguuguuuggacucaguaggaguauuugcugugaagucugucauaugaaggaaaaaaucaggggugcaacauugcggccagaaaaaauuggauggugucauuuccagucaccaaggugggccgucagcacagauaagacgugugugucuggaguuugcucuuuuacaugugcgcugugacaggcuucuugcuucugucacaugacucccagcuggagaggaugaugaggggagagcccaagcuacaccaauaacucucagugccaguuccugcuguuucgucauugucuccccaucacagcuguaccaaggccacuucugguugccuucuugcuucuccaacugcuuuucucugguuucuuccuuggcuucucuuucugaaauugucacuuaaauguugacauacccagacugugcccuuuggcacuuaucuauucucacuuuaccuacacucccuggacaaucaccuccauucccauggcuucaauuaccgucucuacuacuggcagcucucaaaugaaaucuacaucuccagcccagaacuuguucugugguucccuagaugucucagaaucaguguguuugaaccuagcucaugaugcucccacccccacaaacuaugccugcuccugagaucuugucuauguaauaguggccaagauuuacugugcuugugauauuccaggcuccguuccaagcauuugacauacuuuaccucauuuaaccuuuuccagagcccuguacagaagauacaauuauuaucccucucuuauacucugaggcacccagugaaucggugccuugccccagguucaacagcuagcuguggacagagccagacuuugaaugcaggcuguugaaacuguagcccaugcuucuaaucacucggcugggcugcuugcuguuguacauuuacccaagucaaaaacuggagcaucauuuuugaugucaucuucuccccuggcucccacauccaauccaaugccaauccaguuccuuuuaccuccugaauaacuugagccuuucuuucuuuuucuuuuuuuuuuuugcuccugggucacuacuauaguccaagcuauuaucucuugccugggcacucacgauggcuuccuaacagcucuuccugcuguucucucaucucuccuuuccaccccaucuauuuuccauacugcagccaaagaaaccucucuaaaacauaaauucaaaugugucacuucaguaaaaugcuccaaugguuccccauugucagggcaaagucuggacuccaauaugccuaaaaagguaugcucugggcucuguuuucuccagccucauccuucucccugacuccauccccuccccuugcucuguuagcaugccccgucuuccuguguuucuucccuuuccuggcucccggaaggcccccuucucucucuuaccucuuggccacuuaguugucugaucccuuugccuaugauacaguuuggauacuugucuccuucaaaucacauguugaaauuugauccccaguguugaagguggggucucgugggggguguuuugucaugagggcagauggcucaugaauggcacggugccauucuugugguaaucagugaguucuuacucuuaggucccacaagauuugguuguuaaaaagagucuggcuccuccuucucuucugcuugcucccuuccucucucaccaagugaucucugcacacaccagcuccccuucauguuccaccaugaguggaagcagccuaaagaccucaccagaaacagaugcuggcgccaugcuucuuguacagccugcagaaucaugagccaaagaaaucucuuuucuuuguaaaucacccagccucaggucuuucuugauagcaacacaaagggacuaagacagcucgaauguccuuccaucuucucugcaccugcuugagucuuauucauucucaaaggcuuuggggaucuccucucuggggucuagaaagggacuuuggugccuuggcuguguguuacaguauggcugucacucugugugccaugguuugucccaagcacguuaaauauauuaacucauuuaauuuugcaaaaaccauaugagguagacacaauuauuauuuccacuuagcagaugagacuguuggagcacggugcaucugccacucuaguaguucaccagaggaagucugacauggggcucugacuauaagucuguugcaagaacacaaaaaacaaauggaggaugcaagacaauccaaagaugagaaacaguaggaagcugcugcuccagguuggagggacagaaggaaguggggaugucaccagaggugaggcacugggacugcccagcgggaacuggagcucuagaggaggugcagccacugucagagcagccaccccaaacugagaggggcuuaaguacccugacauucccucauccuacugcuaagcuccaccacugcuuccugucggcugagcuaaccagacacucaugggcaggagccugggaaaauguagucugcagaggucgcgguaaagauggggaacaaacugagagaaauagguagaagauaggcccagagaaguucauuacuuuuuccaagcucugacaacuucuaaguugcaaagucuagguaguuuggucccagaguguguccccuuaaccacugauguacacugccacucugagaaccuggggccaggcacugaaucacaugucucagauguguaaaaugaaaauaauagugauauccucuguauggggcuaugauaaagggaaaaugaguugacacacuucaaauauuuugaauagugccuggaauaucacacgcacaguaaauuuuggucauucuuacagagauaaggaucccaggagaaggcaguggucugggcaugggaacuguguccagcacuguucuaggcucuuucucuagaagguaguugcuaucuccauuuuacagacgauaaaacugaagccccaagaguuugacuuacucacauagcaaaaguggaaguaggacucaagaguuugauuccagagucaauguguguaugccauauuaaaauuccugugugauggacucucuuacagcuaagcuacaguuucuauggggacacaccugugccuuuuuugccuuug

SEQ ID NO: 16374 - RNA, 3904 nt, Homo sapiens
caaaggcaaaaaaggcacagguguguccccauagaaacuguagcuuagcuguaagagaguccaucacacaggaauuuuaauauggcauacacacauugacucuggaaucaaacucuugaguccuacuuccacuuuugcuaugugaguaagucaaacucuuggggcuucaguuuuaucgucuguaaaauggagauagcaacuaccuucuagagaaagagccuagaacagugcuggacacaguucccaugcccagaccacugccuucuccugggauccuuaucucuguaagaaugaccaaaauuuacugugcgugugauauuccaggcacuauucaaaauauuugaagugugucaacucauuuucccuuuaucauagccccauacagaggauaucacuauuauuuucauuuuacacaucugagacaugugauucagugccuggccccagguucucagaguggcaguguacaucagugguuaaggggacacacucugggaccaaacuaccuagacuuugcaacuuagaaguugucagagcuuggaaaaaguaaugaacuucucugggccuaucuucuaccuauuucucucaguuuguuccccaucuuuaccgcgaccucugcagacuacauuuucccaggcuccugcccaugagugucugguuagcucagccgacaggaagcagugguggagcuuagcaguaggaugagggaaugucaggguacuuaagccccucucaguuugggguggcugcucugacaguggcugcaccuccucuagagcuccaguucccgcugggcagucccagugccucaccucuggugacauccccacuuccuucugucccuccaaccuggagcagcagcuuccuacuguuucucaucuuuggauugucuugcauccuccauuuguuuuuuguguucuugcaacagacuuauagucagagccccaugucagacuuccucuggugaacuacuagaguggcagaugcaccgugcuccaacagucucaucugcuaaguggaaauaauaauugugucuaccucauaugguuuuugcaaaauuaaaugaguuaauauauuuaacgugcuugggacaaaccauggcacacagagugacagccauacuguaacacacagccaaggcaccaaagucccuuucuagaccccagagaggagauccccaaagccuuugagaaugaauaagacucaagcaggugcagagaagauggaaggacauucgagcugucuuagucccuuuguguugcuaucaagaaagaccugaggcugggugauuuacaaagaaaagagauuucuuuggcucaugauucugcaggcuguacaagaagcauggcgccagcaucuguuucuggugaggucuuuaggcugcuuccacucaugguggaacaugaaggggagcuggugugugcagagaucacuuggugagagaggaagggagcaagcagaagagaaggaggagccagacucuuuuuaacaaccaaaucuugugggaccuaagaguaagaacucacugauuaccacaagaauggcaccgugccauucaugagccaucugcccucaugacaaaacaccccccacgagaccccaccuucaacacuggggaucaaauuucaacaugugauuugaaggagacaaguauccaaacuguaucauaggcaaagggaucagacaacuaaguggccaagagguaagagagagaagggggccuuccgggagccaggaaagggaagaaacacaggaagacggggcaugcuaacagagcaaggggaggggauggagucagggagaaggaugaggcuggagaaaacagagcccagagcauaccuuuuuaggcauauuggaguccagacuuugcccugacaauggggaaccauuggagcauuuuacugaagugacacauuugaauuuauguuuuagagagguuucuuuggcugcaguauggaaaauagaugggguggaaaggagagaugagagaacagcaggaagagcuguuaggaagccaucgugagugcccaggcaagagauaauagcuuggacuauaguagugacccaggagcaaaaaaaaaaaagaaaaagaaagaaaggcucaaguuauucaggagguaaaaggaacuggauuggcauuggauuggaugugggagccaggggagaagaugacaucaaaaaugaugcuccaguuuuugacuuggguaaauguacaacagcaagcagcccagccgagugauuagaagcaugggcuacaguuucaacagccugcauucaaagucuggcucuguccacagcuagcuguugaaccuggggcaaggcaccgauucacugggugccucagaguauaagagagggauaauaauuguaucuucuguacagggcucuggaaaagguuaaaugagguaaaguaugucaaaugcuuggaacggagccuggaauaucacaagcacaguaaaucuuggccacuauuacauagacaagaucucaggagcaggcauaguuugugggggugggagcaucaugagcuagguucaaacacacugauucugagacaucuagggaaccacagaacaaguucugggcuggagauguagauuucauuugagagcugccaguaguagagacgguaauugaagccaugggaauggaggugauuguccagggaguguagguaaagugagaauagauaagugccaaagggcacagucuggguaugucaacauuuaagugacaauuucagaaagagaagccaaggaagaaaccagagaaaagcaguuggagaagcaagaaggcaaccagaaguggccuugguacagcugugauggggagacaaugacgaaacagcaggaacuggcacugagaguuauugguguagcuugggcucuccccucaucauccucuccagcugggagucaugugacagaagcaagaagccugucacagcgcacauguaaaagagcaaacuccagacacacacgucuuaucugugcugacggcccaccuuggugacuggaaaugacaccauccaauuuuuucuggccgcaauguugcaccccugauuuuuuccuucauaugacagacuucacagcaaauacuccuacugaguccaaacaaccgcuacgauugagaacaagcaugaauccgccacccaccuucuccuggaaauaaggugauguguagguuccucaucuccuuuccaguguccacaaacccaucugaguaauugcaacuucaaauuuuucuuuucuuuuuuucuguuacagacacugauuccagaagaguguuccauaugcuaugcuuuuuuaaauuuauuauuuauuauuuuuauuuuuuugagacagagucucgcucugucacccgggcuggagugcaguagcacaaucucagcucgcugcaaccucugccuccuggguucaagcgauucuccugccucagccuccugaguagcugggauuacaggcacacaccaccacacccggcuaauuuuuguauuuuuaguagagaugggguuuuaccaugcugcccaggcuggucucgaacuccugaccucaagugaccuguccaccuuggccuccuaaagugcugggauuacaggugugagccaccgcgccuggcccauaugcuaaauuuauuagaacccccaagccuggccaaaggccucacuccuaagauucugguggcaaugccagcauacacugggcucagaggaggucuucagauaccaggaggauuacucuaauucaacgcagaaauguugugaaacugcuuuauauucugucuagcacaagcaaguggggguuacuauuuuuguaaucauuauaagagccuucaacuauauaauuuugggaaguggugauaaaaaacagaguacuucucccuugaauucuaccagccccaaacu

SEQ ID NO: 16375 - RNA, 2747 nt, Homo sapiens
ucaugacaagagauugauuaaaaugccaagauaagaaacgauuuauuauagagagaagaaaaauuucucauccaaaauauagaaaucuguacaacuuugccacaaucaauauacaugaacuguacaaauuuacaccaguucauaauuuaccaaauaaaagaugacuaacaaaguucacaaaauagauggugguuuguggaaaagacuuuuacccaauuaaguacaaggaaaguuacaaaccagaccuccacuuucuaaaaauaagaaguuuacucagucuuagaaaacuacaagcuagcaaauguacagagagcuggcuggugcuaacaccacaguugagacagugucuuuuuaagggucuuuuuuaaagccuguugccauggcagauucuggucacuugcuacuuucaaggccaaaaacacaauacaaggucugaccauuuccccaggucaugcuuacuaguuugucuuuauguacauuuauacauauuuaagugcuagguaaaagucuuguaaaauuuccaguacuaccauguuuaaaacguuuaacuuuccuauuaaaagcugccgaaaagguuaacaauaacaacuuucaaguguaauagugcaaauuccccugcgagauuuacugcagagaaagauucuuugaaauacagauuuucuuuaaaaggauugauguaaaaauuuagguaugucugggagaaacugaaaccacccuaggacuucccucccuagcaaauaaagugaucauuuacuuggacucacaggcuauuaaaauuaaucauugaaagguacuguccaaacuauggcacugucacuuaaaauuuuuuuuuuuuuuaccauucuaucuugugccagaucuucacagcugugacaugguuuaaauuccauaauccauccccaagaggagcccacccaaagcaaaaaucaaauuuauccaucaucaucagaugauccauccacagacuauaucuuaaccugauacagucaucauauuguaguuuuuggaagggcucguucugcccaagagaaguuccuccuuacagcugauucggcugucuaccauuugcacguuggugcuguuuugagugcuaccuccugcuggugaggcuucauacagcacacagauggagccauccucuccaauucuguaggacacuucauaggggucaacccagagugugaguucacuugggagaagccugaacagcuccugacugcucaguccaauccgcugugcugccuguccaaucagaggauccauuuuaugguugaugcgaauacaacgguaacccgaucccuugcauggcuuuucugggaaccagugauguuuauaauguucuauagaagaaaagaagaacagagaaacaacgcuuaggaucguuagcucccacugcggauuccuccuaccccaggcuccuuugaggagcgaaaaugaaaacuaucaacuuuuuaaaauguccaggauugcauccguuguugugcaugugcggggauggaaaaagcgggcaggguuuuagaaauaacacaguaguaccggacaaaacaaucuccaggaaccaaccgguugagccgccaaaacaggaaucaggcgcgcagccucggccagucgggaagccacuggcaccuauggccaggcgagaaacuguuuacuuucuccaccccaccccagaugcacacaauggaguugauggcuuuggagaugagaagcgccaccggacuguuaaccccgaagggaagaaaaacaagcaacccuaaaccacgcucugggcagggcuguuaauugugccggugacaaauccgaugauuaaugggcaggggcaggaggcgcggggagacggcacguccguucugagcuggcuccggggcagcggcgcagcuucccaccccggggcugggccgccgaccacgcaacgguuggagggggcugaggaaaggggacgucgaacccaccccagccccacggcuccuuuguccccaaauccgccgacgguccucggaccgcagcucccgccucggugggcuuaaguuucuuuguugugcguguugucuucuccucuccguuuugccagcuggggggaagggggcgcccuccguccagccccuaaagccucgcggggaaccgcuguuagcggccacccagcgcaaccacaccggucccgcggcggggcccaagcgcgaccggccccggggcgcugccgagguucccgcagccccgacggccggacucugacccagggauguggggcccgcgucccuccgacgcccucgcccugcucaccugccagcagcuccugcaggcucuggcugaaggucugcagcugucgcucgcucgugagccccuuggugcggagaaacuuggagaugaaggacacggcggcggcgaucucgccuaucaugguggcggcccggguguagaagggaugcaugggggcggcgugcgggggcggcccggggcggcuggggcucggcggcgcggccccgacggcggagcagccaccccgggcuuccucaccgggcggaaggcugagaggaagagagggcgugaggggcggacgacuacuuuugucuuucuuucuuuagacuaaaaaaguuauuuucgagacaggaggcggcaggagagaggaagagacgagcgauggcggccuggucacaucgcucggaccuccccagcugccuccgccuccagcuccgcagcauucgaagaucucaauagcugcauuuccagcuccgagaggcgaagagaug

SEQ ID NO: 16376 - RNA, 2641 nt, Homo sapiens
aacauggacacauucacaggcuaaugaucucaugaaauaaggauaagagaccacgguagcaucuaccaaaaaugugauacucaaaggauuacauuucauugcuucccuguugaagugaagauauaaauguuccauucugacccaccuuugaaaaacaauuacuuugccccauggauucuuuguucaauuagaaauuuccccggggcaggugacccauagucuuaaagaacaggcuaaacaccacagagagauugguugcuuuuugcuuuucaucaccugcaagauguacauaaaaaucacauaagcuggaauucaacaaaagguauguuuaugaacuuuuauucucaaaaguugaaaugcugacuuucucgauuccucauuuucagacuuuuauuucagauaaauacuaaaaaccuaagugaaccuugauaaugcuguaguguagauuacuucacuaccccauauaauagaaggacuugcuguuuaguuguagaggauaacagcguuuuucaguggaaauugaaaguggaaaaauugaauuuugcucuacacaguuaacauauaguggccuuuuuuugguauauauguaaacauguugacacuggaaauacgcagucugaaauaaaauuaguaauuacuugaaauuaguaaucucaaauaacuuuuaagaaguuauuucuacacccaggaauaaauuauucugauuuuguagacaacacaggaauaggccacugaauaugcagguauuuagaguacaaaugucuguggauauuauuggcacaccauucucgagaguuagaauucguagacccgcaacacauggacuacccuugccaauuguuaugguuuuauuuuuaaaccuauucugugaaaaagcuccucgguauuucaaacuugaauuacaauaaaaacaccagguaggguuguuuuuaaaugggucucaccccagugcugacuacuguuguuuaccaacuacauuucaucugguaacuccauugaaacuaaguaccucaaccauuuuuuuuuuuuaucauaaagccuuuuuucaaauggaaaguuguuuuugaagaucuugacaucagacuuuuucaaucuuugaaaaugauggaaacaguuaauaaaaauguuuauuuuagaauucaggugaugucuggcuugugaggagcuguuuauaaguuugucuuugaaaaaggcuugcacacaucacucugagaccagcuguuuccugugacuuuaaccuuaccuuccccagacaauugagcugaaccuguaucugcgguacaguagcuguuugugauguauuucuuguucacuguuucuggggaauguuuugaaauauuuuauuauaaauccuuuuaagauaggaugacuacuuucaaaauuauuguugccuuuggcaccaggaauucauaguugugauuggcaguaaguuugaggaguguuacuuucuaaguuuuaacagguaguuuugaaauuauuuccuuuuuuccaaauuuaaguagugccucccucuguaauguugaaacaaggcuucaaguggauuguauagcaagaguuacccugguucaugcaggauaaugcggcuguuaucuuugucaucuggaaugggaaucucaugucuuuauccuuaugugcaauauuucuauaauaauagacuggaaaggccaccagaaaguggcuuucagguacauugcacaaauaguuuccuuaagucauuauaacucacacauugcaaguaauuaauuuuguuuuguauagguguugcaguuuaugaaauuggccuucaaguuaaaaggaaggaagccguauucccgauggcuaguguuuaaugacuacagguuuccaggcucccuuuaaucuugggagcaaauaaaucuacuauuggacuucucccugcgugacuuuuaacauuucugauacucucucuucuuccucuuuacagaagagagguaugauaacugaaguuguacuuugcauauugaaguuuaaagauacuuccucuccccuuuucaccccuauuucaaaugaugugauaaaauccucuugauaggcuauauggagaacauuugucaauaguuuuaucuaugcauggaagucuucaaaaaguauaucuuggauugucuaaaacugaauagauuucuuauuuaucugaagguauacagacugccaacauuuuagacuuaucucucagucucugccacugaacuuuuauauauggcugcuaucaaaauauaaccgguuuauuuucauauuuggaacuaauauaacaguaucacaaaaucuuuuacaguaagauaguuuguaauaccagccgacccagcugcuuaacugaguccuuaaaucauuuaauauaugggacuguaaauagagaaaucuguacauuaugagaucugauuucugguuaugccuauagaucuuuauuuucuuuaucccuauagaucauuuucuucugauguuaaguguuauauuuuugaaaugcuccuaaacaaguaagccuuagauuguauuaauccugaggauugauaccauuuccucaacacuuuguggaguaugauugacaccaguuuuuuuuugacugcagguuuaacuuggcuuaucacuuuucguauugcucaguauguccaagauaggaauaaaaaaa

SEQ ID NO: 16377 - RNA, 8290 nt, Homo sapiens
acauugcacuuaauuguugccacagccacagauguaaagaggcuuguaagaaaaauguucucacagugagcuuccuuauuugaagcaggacucaauucuugguuaaaagcuaugguauuugagcuaguuaaacacauaucucucucccauuccauagggaaugagcugggcuguccuuucuccccacguucaccugcacuucguuagagagcaguguucacaugccacaccacaagauccccacaaugacauaacuccauucagagacuggcgugacugggcugggucuccccaccccccuucagcucuuguaucacucagaaucuggcagccaguuccguccugacagaguucacagcauauauugguggauucuuguccauagugcaucugcuuuaagaauuaacgaaagcagugucaagacaguaagguaagugcuguuuuaacuauugcacuggggauguuaacuguuugggacagcguuuuuuguaacaggaacaggaaaaauuccagagcaauuuugccaauugcuauucaacagcaaauccacaguucugagcauuuaguuucacauuuuguuaauauguuuuccaugauuuauagauuugagauuuuauacaguauaugcuguauugcuuggcaagagaaguuauaaaaaguuucaagguuagaaugagaaaauaguuaaaguagacacagugaaaaaauauagaaauuaauauguuuguuauguaugcuaguuaguuauauauguuaguauuggacccuaauacuggagcaaagaaaagucauuuuaaucagcauucaaaauaucuuuuaauaagcauauugugacaauuuguuauaauuuacaauaaacguucuauguuauaaaacaugagcuaaaagauuuaggaacucuuauggauuauuuauuucuguuuuguuaauuuaaaaaauuuguuucuuggauauaugccuuaaggaacgaguuuuuuaaaaaguucugggaaaugauuucguuuuugaaaacagcauuuucucuauagccacagguauuugaaaaaacugaggguaguacagugugauuuugccucauaguggagucauuauaugguugcaaacucucauucaauucagcauccuuguuuuuacuuugccaaaaaauauggaagcauuuuucauuacuauuuaauacucacauuauaguugccauauuuugguguauaguaaauuuaaaauagcuuauuaauaaagcaagacaaaucuuuacaguauuuacauucuauaacuuaaaauaacucugggaauaugucaucacguucuuuuuagugcuaugcaauuauuauuauggccaaguucugucagcaaaauuaaaugcccccauuaaaaucuuagagaguaauuuacugagaaucuggcuacauguuaccuuaugucagcaaucaaaguauuucuaaaagcuguuuuauaacguuccaucugaucugaaauaaagugccuuacaauuucaaauuaaaacaaauaaaagacguuuucaguuucuaaccccaaagauccugcuuaucccaaacuacuuugauccaaaagcuuguaaucauacuuucauagaaagauauaauauucucaguuaucuauuagaauguagaucuuucgucacauuaaugauuuaucucccagggcuaccaacuuugccucagccacaacuguucacucuauaaaagucuaacucuuauauuccaauuuucccauaucuaaauugcugcaccuaagacauugaaauguacuuuuuugagccucaccuuagaaacauguuccuaugagaagauaacuguuacacauuauuucaaauucauauucucaauugaauaauuuacuagauaguucuaacaccaguauuaaauccaaacuuuaaaaacaucacaccucucucccaccuccauucugugaggccacuaaaagccagauaugcaaaccauggcaucuucgauuuuggcaugaagaaaguagagaacuugugaguaauugagagagacuauaacucuaauugaaaacuuggaaaauacuaucuuucucuaccuguugaaucucuuuccagaaagagaaaccuucagaaugugugacauuuuccugauaaacauuagcaauuauuaaauauuacuaauauuuuguuuaguaaauagcuaauuuaugaaauauuaguuccagaacacaguuuugcaaugugcuuuaaaaaguguagaauguuaagcacaacaugaacuaguaugcaugcacaccagcaccaagaauucuguucuccuuccucagaaccaacaguaaccagacacuuuuaaaggaaugugccuuccauuucccucccacauacaagcaaaaccucagguugcccauauucccguaaggaucuucuucaugagucauuuuaaugaugucgaaugguaggguagaguauacaguuaaaaacugucuucucauucucuuuuuuugagagaugaucugaagcaguagucuaauucgguggucaaugaacaccacccagaaaccucuuacaggaaggcauuucauuaaggaagagccuggagauugacuggaacaauuaggcugggcucgcccagaagggggcgcacguguacgcaaucuaaccugaaagcugcucacuacauaguuguaaacauacaccuuuguccucauaccuaaauaaaaauuuaaaagacgcuguuagaugcacuaaaaauagcuauaaaauaacaaaaugcacauuuucuaaugaauuuaauguugcaaauugaaugucuuuuucuugaaaguauauauuuuuuuaauuaauaaauguuucaucuuuauuuaggauucaaaccauuugccaaaaaugagucuaagugcauuuacucucuuccuggcauugauuggugguaccaguggccaguacuaugauuaugauuuuccccuaucaauuuaugggcaaucaucaccaaacugugcaccagaauguaacugcccugaaagcuacccaagugccauguacugugaugagcugaaauugaaaaguguaccaauggugccuccuggaaucaaguaucuuuaccuuaggaauaaccagauugaccauauugaugaaaaggccuuugagaauguaacugaucugcaguggcucauucuagaucacaaccuucuagaaaacuccaagauaaaagggagaguuuucucuaaauugaaacaacugaagaagcugcauauaaaccacaacaaccugacagagucugugggcccacuucccaaaucucuggaggaucugcagcuuacucauaacaagaucacaaagcugggcucuuuugaaggauugguaaaccugaccuucauccaucuccagcacaaucggcugaaagaggaugcuguuucagcugcuuuuaaaggucuuaaaucacucgaauaccuugacuugagcuucaaucagauagccagacugccuucuggucucccugucucucuucuaacucucuacuuagacaacaauaagaucagcaacaucccugaugaguauuucaagcguuuuaaugcauugcaguaucugcguuuaucucacaacgaacuggcugauaguggaauaccuggaaauucuuucaaugugucaucccugguugagcuggaucuguccuauaacaagcuuaaaaacauaccaacugucaaugaaaaccuugaaaacuauuaccuggaggucaaucaacuugagaguaaguaaaaagcuguuccuguguuugaugugugcucaaguguuuaaauaccugggcugcacaacacagauauugcaucuggcuccauuaaaaaaacaaaaugucgcccgggcgcuguggcucauuccuguaaauccagcauuuugggaggccgaagugggcggaucaccaggucaggaguugagaccagccuggccaacaugaugaaaccccaucucuacuaaaaauacaaaaauuagccaggcguggugucgcacuucuguaaucccagcuacucaggaggcugagccaggagaauugcuugaaccugggagauagagguugcagugagccgagaucgugccacuguacucaagccugggcaagacagccagauucugucuuggaaaaaaaaaaaauguccacaaaauaucccucuacuucaaacaaagaauaauucuagcucaaucauauauccaauauccagccuuucuuugguguauccagauaaggaacaauuaaggucacagaauuuaauauguaagucuucaaacuaaaaauuccgggccaacucauccugcuguguuaccuccucauauauaucucuuauuauuuucuccuuuauggcuuagauuuguguccuacauuuauuuuuugacaagaucuagaugagggaggaagaaaugaguucaaaaguggcacaguuggcaaacuccauagccacaaagaagcccauauugucccucccucccucccucucucucucuuuuucuuucuuccuuccuuucuuucccuuucuuucuuucuuucuuucuuucuuucuuucuuucuuucuuucuuucuuucuuucucuuucuuucuuucuuucuuucuuucuuucuuucuuucuuucuuucuuuccuuucuuucuuucuucuuucucucuuucuuucuuucuuuuucuuuccuucuuucuuucuuucguuuucuuucuuucuuucuuucuuuuuuuuuuugacagggucucacucugucgcccagacuggagugagguggugcaaucucggcucauugcaaccuccaccccccaggcucaggcgauucucccaccucaggccaccaccaccaccaggcuaauuuuuauguuuuuaguagagaugggguuucaccauguuaaccaggcuguucuuaaaauccugaccucaacugauccaucugccuuggccucccaaaguacugggauuacaggcgugagccacugugccuggccccauauagucucauggucuucccugacaucaacuacuugggacucaccauguuacucugcugucaugaucaucaucugccucuguuaucucuguuaugguguguggccaucacagugcucuggaggacugugaagaagauuaaagagaaaaagaaauaugaugggagauucuaacaucuuuuuuuuuuuuuuuuuuuuuagaagaaaaauaguguuacagagcuuuuuuuuucuuggguacaauccugccccucauuugauauuuccacacuuucucuuucuccucucuuuauuuuucauuuaucuucuggaugaaguuugaucugaugcauuuggacugcuuaugcacuuauguggucuucagggacauucuucaacuuaagcaguauagauuccaaugggaaauugaaauccaccauuuccuaccaggauaacucugccauuaaucuuuggcagagcuugguagaagagaaaaaccaugauucacagauaaggcuuucuaaaugaaaaaaucaagcaggaaacauugauucacauauaaaguaauaaugucugcaaaauaaucuauugaauuugaacaucucuacaugaugaaaauugguuuucuggccaugcugaauaaagguauugcugucagaaaauauuacaauauauuuuaugcauaugauguuuguuaauucugccaguuucauauaaccucuaguaggguuaaacguuuucauaaagaagaccauacucgccaacucugaagcuccacauguucuuuguuguuucugaaaagcagccaagguaaggguuggugcuguuugacugucacacaauacacagucaggcuaacacagcuaaaccccucuuguuguuuccaguggaaaauucacuauguggccauaugugauuccucauuuuaaacauaugugguuaggaggaaggauacucucugacagaccaaaaugcuaaaggaauuuacgaugcuuaagggaugacggaguacauuagauuugguggguagagauuauucguaagagcagggcuacuucuuucucugaaacaaagaaggauacagaaguaggcacauuugaagguauacauugcaugaguaaaggauggaagagaggucuaugggagaaaggccaacggccugucagugccaagcugagauagaaaccacagugcccaguacauaguggucauuugaaaagguaacauaauaguuuccuuucuuucuuccuuaucuuuguacauuuagucagguauucuccuugucuuuuuauguaucaccucaguuuagguuauuuugccagauaauaaucaacuauaucaacauuucacauucacuuaauacagaaaguuccccucaauguuuuuuucuaauauuagggaauauauagccaaaacaaacuguuuucuauuucaaacuugcaacucuaagcauuagcccaaucagagaucuuccuaguguagaguaauuuagaaagacagcaaaaucaaaaggauauuagucauuauuuaggacauacuauguacuaguauugugugaagugcucuacacaacuuaauuuaaucuucaugcaacacgguaagauagauguguuauuucuaacaagaucagauaaguguuccaguguugcccaccuggguaaguggcagagguagaauuccaagaugggacuaugcccaucuucuuuccauuuuuccucacuuucucaaauguugguaccauagaaaaaucccuggaauuaacugaugaguuauuuuaaaaagcauguguguuugggguuccacugaagucuuuguuaacuagaguuugaaaaugaaaacaagauaaaggacuugaaaauguuaaucuaaaauagacauaggcaaacauaguuucuguguauacacaggucagucaauucaguaacacucuugguuucuauuacaaaguaagucaguguuucauuuguggcagcuuuuugaccauggacaaaaauaaacaaauaaacaaaaacaugaguucagaugguggacaugccaugauuagguuuuugccuuagaauuuugaucauugcuauggugugugauugcuggaaugauuugguuuuugucuuggaauuuuuaucauggucaugguaugugguugcuagaaaauucuuuauagaucaucuaguuaacccuucuuauuuuuagauguaaaaccaaagaguacuuauacugagauuguucauacaacaaugggauccauuuauauuucuucagguuauacuauuucaaaaaaguuguuagauaauaugacacacuuauugaaugccuuuuuaaaaacaacuucuaguaauaaaauaaguucuguuauuuaaaauauuccacugaauaucuugaucuaccaugauuacucuuuacuaaauguuacugugccauuuugguagccugaaauaugccuuuaaugguugcaaauucaaacauauacuauauuaugacuuuucuaaaugggaagagguccuauuuuauaauauauuaaacauaaauuuuuuguauuguuuugagccaguguacugaaaaaugauuaauguuuucuauucuuuaauuuuuagaguuugacauaaagagcuucugcaagauccuggggccauuauccuacuccaagaucaagcauuugcguuuggauggcaaucgcaucucagaaaccagucuuccaccggauauguaugaaugucuacguguugcuaacgaagucacucuuaauuaauaucuguauccuggaacaauauuuuaugguuauguuuuucugugugucaguuuucauaguauccauauuuuauuacuguuuauuacuuccaugaauuuuaaaaucugagggaaauguuuuguaaacauuuauuuuuuuuaaagaaaagaugaaaggcaggccuauuucaucacaagaacacacacauauacacgaauagacaucaaacucaaugcuuuauuuguaaauuuaguguuuuuuuauuucuacugucaaaugaugugcaaaaccuuuuacugguugcauggaaaucagccaaguuuuauaauccuuaaaucuuaauguuccucaaagcuuggauuaaauacauauggauguuacucucuugcaccaaauuaucuugauacauucaaauuugucugguuaaaaaauaggugguagauauugaggccaagaauauugcaaaauacaugaagcuucaugcacuuaaagaaguauuuuuagaauaagaauuugcauacuuaccuagugaaacuuuucuagaauuauuuuucacucuaagucauguauguuucucuuugauuauuugcauguuauguuuaauaagcuacuagcaaaauaaaacauagcaaauggcaucacuguguu

SEQ ID NO: 16378 - RNA, 7475 nt, Homo sapiens
cauuaccauguacaagcagugaccaauagaaaaggaagaagaagauccaagaaggcugagguaagcagucuucugaagcccugucaaaguggaaacaauagaucaaagguguucauggugacugggacgaguagguuucacuguuucucauagacgacuugacagcuuaaaguaaaaacaaauuauuuucgucaaaguuuuuuuuuuucucuuaacugauuuuuagcaaaccucagacugagacacaggacucaacgguguauuccuggaaggcaagguaaacuauuuugcacuuuuaaaaacucuuaaaguuaagcaugcaaaguacuuauucaacagacgcaggguuacaacuucaauaacuaaaccaaaacccuauucugaaaaagaaaaaaaaaaaugauguuucuuuguuggaacauggccagagcagcguucugcaauccuagaaaauuugacagcuugcagaagcaguucugcacuuguuuucugcaauuuaauggcaaaauugaaugaucagcauuucauaaaugaaguugacuuuaucuuuuccuaaggaaucaguaaaauuuauuucauccuauuaucaaucaguucaauaaauguacauuggucagaauguuacugauauauauauauauauauaaauauauauguaacauauguaugcuauaaauuauuaaaauauauauguauauuuccuguuaaaauaauuauuuguaccaauaaucuuugaugaucaguggggaggguuuauguguuuuaaauguaucaaauauuaguaaacgcuaaccuacuuuccauuauccacacugauaauaugaauauaaagaaauucuccacccguauccuaaauauguuuuugguuguuuuuguuucuuaucaaccauaauaauggcauaguugaauacaauacucauguacuugugcuauacaucacaauguauucaacucuauauaauaaacucuaucucuauauauacauauauauacauauauagagacagaauauacauauucucugagagagagagagagagagaaagggagagagagagagaauugauaauucaauagcuuggcugaacaacuuaauugugugcuuaaaauuauagacaucuucccccacccucaaaaaacuuacuugagagguugagcuagagaauaacagauuaauuacauuuuuauucagauccuagaaccuuccuucaccauaaagugcuaaaauguucuuugaucccuucauuccuuugguucaagggccaaaaggccuaggaaaucucauccagauguucugcucauuuaagaguaaaaguaaaagcauaugcuuuccucucaggaacaacacagauucccaguuugaguuuuuaaaagaucacuuuuuuguacucucauauucaacuacugguuucaguucaguucuuuaaauuaaauagcuugaaauggaaaaacacuuagagcugcuaaaauuuucuuuccauuucucggcuuuuauuguguuuggguuacaaccagaaagcuacaagucggugaauuauucucaauguuugcaaaaugcuuugcauauggugccuacuaacuaauguauauuaauuaagaucuguguaugaaauguugacauauuuucaccucuucccugaagaagcaauguuuacugaucauuuugauguauaaaauuaucuaaaggucaagaucuucaaauaucuaacaguuguguuccuuuuucuguaggugcuauaauggcaggcacaaucuguuucaucauguggguguuauucauaacagacacuguguggucuagaagugugaggcaggucuaugaaguacaugauucagaugauuggacuauucaugacuucgagugucccauggaauguuucugcccacccaguuuuccuacugcuuuauauugugaaaauagaggucucaaagaaauuccugcuauuccuucaagaauuugguaucuuuaucuucaaaacaaccugauagaaaccauuccugaaaagccauuugagaaugccacccagcuaagauggauaaaucuaaacaagaacaaaauaaccaacuacggaauugaaaaaggagcccuaagccagcugaagaaguugcucuucuuauuucuggaagauaaugagcuagaggagguaccuucuccauugccaagaaguuuagaacaauuacaauuagcuagaaauaagguguccagaauuccucaagggaccuuuagcaaucuggagaaccugacccuucuugaccuacagaacaacaaauuaguggacaaugccuuucaaagagacacuuuuaaaggacucaagaaucucaugcagcuaaacauggccaagaaugcccugaggaauaugccuccaagauuaccagccaauacaaugcaguuguuuuuagacaacaauuccauugaaggaauaccagaaaauuauuuuaaugugauuccuaaaguggccuuuuugagacuaaaucacaacaaacugucagaugagggucucccaucaagaggauuugauguaucaucaauucuagaucuucaacugucgcacaaucaacucacaaagguuccccgaaucagugcucaucugcagcaccuucaccuugaucauaacaaaauuaaaaguaaguaaccugcagaguaugucuuugacuaaagggcucauggucauuaaauguaucuuuauuuucauuaagaagagcaaauguguugcccccucccccgcuaauguuccuuuagauuuuuaguguguuuucaauuuucaguauuaaauuuugucuauacgcagacagucuuaaugaaccaagaaguccaaaucuucaaacugaagacuaaaaaguggacuugagucaucuacagaggacuauuauccauuagagaaacugaaugccucuaucuucuuuuacuccaggagauuccaauauuucugccccauuggguaggcuuauuuaagaaaccauaccaggcacaaacaaccucaugacuaguaauaaagaaaauaugauuuaagaggcauuaggaaggcaucuuuguccuaaacacuauaugacagcugaugccugaaacccuccuaauuggagucucuaauuaaacuccgcuaauuacagugggagucucaaacaaguguguaaaggcuggugacuccacccccagaauuucugauucaguagauguggagugagacuugagaauuuucaucucuaacagccguccaguugauguucugggaacuacacauugagaaccacuacuauaguuuaaggcuuuauuaauuaaaauggaaagaaauuucccugguagcuggcaacuccuugggacuuacaggcaaucgucagguagaauacucucuccuuuccugaaaagagcuuuucauaagggagugagagaugaauucaaaguuuuuggaggcagaggcaucaucaagagaagaagugauuauagaaagcagauguuggacacauuagagacaaacuuggcuucuucacaauuaugcaugagacuaggcuggacuugguguaaaaauagguccagccacagggguacgauaccuagccuggcauuuaucuaugcaucuucaaacucagaguagacccuuuaaaaauaacucuggggagauuucuccaggacaaccuaagaaaaugcauuccaaaaguaauauucagucaggauaguuuguaagagaauaacaaagauaauuugucaaaagguugugcugccuggguauuacucacuaaagcuuuuuaagcaaauaaucacauaaacauaucauuuauaggaacagacuauuuuuccacugggaacugcucaguuauuuaagaauuuuuguuuuuuugguggggggaguuaaauaacaguguacuugagucuacaauccaggaauuaaauggcagccugccaucauagcgguuauuuuuccauggugaugaaauguauuguuuaauccuguagucaaaaacaaaagaugcaacagaaaaaaaauguuaagagaugaaucuguuuagcugaaucaaauagaacaacaacaauauugaccuaaauacauaauuuuuccugacgaguguucugugcuucuacagguauauuacagguacauuccuuaaaagccccacggacaauugaugugggaaguaaacuucaagugacuccacauagagcccuugcuuacaaauuaugcauuucauccugagcauuugugaauuaggguguuuaggagugaggcagcaguauuuaaaacacaguugagaaguauaagacuuuagcuuauggaguauuauguguguaguauagacccacauuuuagaguuuuaucaaaguguuuucucauagguuucuaauuuucuaucguucucaaaucugagugugcaucagaaucaccuggagaucuuauaaacccagguugcuguuuccuacccccagaauuucugacuugcugggucagagguugggccucacaguuuacuccccagguauuaauaguauugauguugcuggcucacgauuugagaacuacuauuuaauccuugcgagaaacuugugugauauuauuaggaauuucugaaagagagaaacugaagaucagcuaggggaggauauuugcccaaggacaaaggguaaaugcaauagccagaaccugagucugaaguguuuuuuucacucauacaguauaauaacaauacuuuccuucauugucaugaauacaaauuuuuaaaaaauucuaucaguagaaaagcaacaaagagaaaucuaguuauuuacuuuuuaauguagauaucaaauuuugucauuucaauauuuaagaaaauaaauauaagaguuucccuggagagaauauugauauaauaauaucacacugugucaaaacuguuuaaguacuugcuucuucuagccacaucaucuacucuaguuguaacaaaguggucucuaagaaacauaucuccucuaugaaaagacaucaaaauuuaugagacagugaacuugucuuaagcaauaugauggaaauauuuauuuuucugaaaacuuucagggauuuaagauuagguaaaaauguuauuuacucaacuacauuacuuucugguguucccugagaaacacuguaauuuaugaaaauguaauuaaauuuagaauacuucuuuuuuauauucauuuauucagacauacauugauuaugggacaugagcuugaugaggauaaggggauugcacaucgaaagggacauauucuuuugggcaagagacacauuguagaauuagaaagaaucggccaggucucagcucugccacuuacuuucugaaauaaguugugugcauuuccuuauuucucugaaccagaauucccacaaaaugcccagguauguagaauaauaauauuggcugauaaagccugugagaugaucaggugauacuuggauguauguaaaaaaagagaaccugauuuuauaacaacuaaacugcuauucaaaugagucauuauuuuuauuaaauucaguuuacaaaauggcauaaauucaaagcaaagcaaccuugcuggaaacauaaaauuauucacuacaauaugaaucuauauaaaacaauaggccacagaggaggggcauugcccaaguucagugggucuaaucagggaagaucucuuguuuggaaugguuuugaaaaggaauuuaaagguaauauauggauucaugguugaaaucagcuguuacagaguacccugaauuuugcuaguuuaacuggccuucucuccuguauguuccuaaaucucagcauagucauuggugccaagggcuuugauccaaggcaggugcacaauuacucccauccuaaccauaugaaaaggcugcugggauauuuucuggcuugaguucuuugucauucaauucuuagcaaaauuuuaguuuccaauuaaauaaauuugaagaugaagauucaagauuguuuucuguauugcuuauguaaaguuauguuaauuguacuuuuaaaaucauguuaugcacacuauuuugcaucuuuuaagguaauuuucaagcauuuucuuuuauauuagauugauuuucuacuuacccauccaggauccauccauccauccauccaucuacucuuguacuuacccauucuuucagucccaaaucugaacuguugucuccaccucugaugcccuaaauccuaccuacagcaaucuaaaugugcuuuaucuuaccugcaaauuuagaaaacaagugacgucuuauacacauuuguuucuaucacagaucuuaacaguauuuccuuacuagugcucuauacuaaguagcagaacauggacugagaugacuguuaaguuugcugaacuuuuguuugggggaaacagauaggcacaauuucucacugacacaaauguuuuguauaaccacuauuuucauauauuaggccacuaagcccuccauaggaccauggcauuaguuuuuuggucuucccacuguuaguuucucuuguguuccaauucauucaucuauucucuuugucacuguaggugugaaugucucuguaauaugucccagcccauccaugcugccugcagaacgagauuccuucaguuauggaccucaucuucgcuaccuccgucuggauggaaaugaaaucaaaccaccaauuccaauggcuuuaaugaccugcuucagacuucugcaggcugucauuauuuaaacacauucucaccaaaucuaaaauuaguuuaaugagcuguuucugacaugaaaugugguuaccauuaauagguuuaggacacaagucauauuccccauugcucucggccaccauuuucauuugugcaguguauuuuuucuauucaaagaugcuuuugccaguuacaugcaucacagccugcauuaauuugcuuuucuuuuaauuaauaaaacagacacagaguuaagauaguuuaucaacucaaagauaguuuuauuuuggucucuuccauagcuuauuaacacuaaagaaaacaauuacauucuuauacaauaaaaaggacacauuuguguauguuuaaaauuacuuaugcagauaccguaauuuacaguauaaauguaauaaucaaacaggaggauaacgaccugaagaaaaugagaaaauaaaauauuucuuaauuguaaucauaauaaaacaauugcagauugcuaaguagcuguuggugguacaaguuugauauuuagcuugagaauggguauggaaugaaucaaauacuucaucacuaaagaauucuuguuauuuaauaucaaauaaugaaacagcagucacuucuaguucauuaccauuucuuguagcuguuguuuuuagauauaguccacugcauucuuauaaguucuaaauuuuauguuuauuauaaugcauuucuuguggaaucuuaguguuuuaacauuugaaauccacuuaaacugcaaauuguucuuuauauuugauuguguuuuuuggauuuucuaaauaaaaauauugaaugcuuucuaacaaaa

SEQ ID NO: 16379 - RNA, 121546 nt, Homo sapiens
ugcggaggcgcaaguccccaccuccgccccucacuccggccacccuuucccgaccgcgcggcaaguucuaaucgccaggcgcgcgcucgccagccgagggcgcgcucgccggguccuccccuuaaacgcccucccagugccgcucagcucccagucccgguccgagccgcgguuccuccgcgcgcgcgcgcgcgcacucgcccgcccccaggcuccccgcggaucgcgucacgugaccgcgcucagccaaggcggcagcggcggcggcgcgagcuucggcggcgguggcggcuguggcagcgggagcagcugcgccgccagcguggagcgggaggcguguggguguggagaaaagggagcgccagaccggaacgggugagcguucuccucccccugccuaccccggcaaucuugcaggccacccggugcagacggggucccugcccggagcugcgcgcagcccccucgugcucggccguccgcucuccggugcccgcgggccccgccccgaguggggcgggcugcggcgcucacggagguggcugcaccccgcccgcggcugcuguugcggacggcggcgugaggccggcugagcugcccgugccgagcgagcgcggcgcgcccugugugccgcucugcggagccgaggaggcggguccugcggggacgcgggcggccacucgguggcugccgggcucugggcggggacggccgggcgccgccuccuccuccuucgcugccgccgccgccuccucgcagugcagcgugaguagggagccccggcugguggacgccgagccucucggcuccuuggccgccccauccccgaggugcagcugcaccuccgcguggcgccccgagcccugcgagccggcugcggacgcgcugaggacggagcccccauccucugcguuucccgcugccccuuaacgccccgcgacccucccgcagccugccuuuccuucccccucggaaaaugguucccacugccgggcgaggugaguggcggccgccgcccgcccgcggccgggggcggcggggcaggucaccugcgggggaggccaggcggagcacggaggucgggcgucgcggcggggauccugauagcugggugcgcagcggguugcgccggauucgggagaagcugacgggggcggucggggccccucgcagguugccucuugccgggagauugugaaggugagcgggcuucucgccgugcaccucagcgccgggucagucugggagucgcugcuccgggcccgagggauggggcuuguuggggcuucuggucuacacccgcaggucuucggcuucacgaagccgccucggccgcgccacagcccaucccgccaccggucgcccccgccacggcgcguggugaccuugagggcaccgugcccggcacucccucuccccgcgccccgggagggucaccccucuaauccuuggccucggccccccagacgcacugcgggaggggagcgggggccccuggucggccccuggcccuggugguugauuguuggcgugucaggacggugauuccucgggaguuggagagccgccuggucuuucuccucacgccuuccgucuggccccccaggauguucacaguuguuuccgauucguguuuauucacuuaguuuaagagaaaaaagccugcgcccccaccucccuuuuugaggaaggagucuguaggaggaccgcguuccaguggcagggguguggggugggggcugugcucucuuuaucccauccugcgggagaauccuguggcuaagcugguuagcgaccccugguucugcgccgcggucaccagccagguuggucucugugcgcauuucauucaccaguuuucugcgggacucgcagcgcugggagugcucgcacccugugcgcugcuuggcucggaggggagggcagggcguccggguggguuaaaggggucugcagguacuuggagggcucgacccuccucgacaggcugauauuuaccuuuucuuuggguuagagcgcugcagacagccaccuuucgcuucugugcccgcuacuuuucuugguuuauuaauaaucuaauggcuucuguugguaucgauugcuguucgugauaaauuagcuacauagauuuuuuucauacguguguagguauaugcauauaucugaacuugucugccugucaacauggaagccuuuguuguguuuaaccucccccaccugaggacagucuuauuuuaaaauaaggcuuuuguucagcguggguguauuuuauaauaagaaguacuuguaagggccugguuuguaugaggcucucaucuggcagaggguguguaacccuuuggaugguggcccacgugagugaauggagggccuucaccacuugccccgaugccagccuucccgagacucccuguccuuguguguggcagggguggauugggggaauuaagagggauuggaggagaaucugcuuuuuguacuugugcguuucauuuggguccuccuccuccccucucuuuuucuuuauccuccuggugaguucaaauuugaaguaaauagaaacauuuuuuuuuuaauugggaaccuuugauagcuaguauaugaaaugggcuuauuuagcuaugauuucaggaggacguuuuaguuuuuaccuugcuuuagauaagacagcuaaauugcuguaauuaaggguggaucucuguccugauuuuggcuuggguguaacugcaaagaucuuugaaaaguaacuguuaauuuccuaccauauagucugcaaaagugagucacauucgggugaguugaggacagagcgccaccuuuaauuuaaaauuucgugauuuucuuuuauuaaaauggugaaaauucgggguacgccuucuugauuuuuaucgcagcugucauuauuggcauccccauuuugacguguaagggggaauugucuucauuuuucuguauucucucauuucucuuuugagagaaauuucugcaauuguaugggaaaucuuuuuuuuauugaagcuugggauuuuagcauucugagaugagaugagaaacuaguuuugauuuguguuuauaauaauauugauggucuggauauucuugguaaaagaaggaaaguaauagcugcuuuuaauaggugguuugaacuagccauugccaccaaauaaagguaccuaccaguaugacaguggcuuuacaauuuuuuuuuuuuuuuuagcuguaggccuauuaacagauucuaaaauaaacacgcaggaucagauauaguaauucuuuuuuguugucuuccaacaacuuaccuuuugugauuuuacuguuuuacaguugcuuguucuuaaauaauauagaugaacacuucgagcagguguacuuauauucaaaguuuaauaaagaccauguuagaaaaagugguuuguauacauggcuccucucaggugcaucucauguaaaaauaaauggagauuuuaauacuuagaaaagaguuacuguagugacaguugagauuucuuucccuucccuuccuucccaaaucauaaguauaaggaacacugucucuuuaggcacagccuccuuuuuugauguaacaugagaaaagggauuuagcucccaaguaaugaauuaagauguggauauuauuacauauagucuuacuuacaaaccgcaaaauauuacugcccuucuaucugcauuuaagguuucauucaacacuugcaauuucucuauagacaauguaaagcauuggcuauugagcuguagauaagucuuuauuaaacuaaaauuagccaaaaacucugagaugaaagguguuuuauccccuuacugcuauguguucucugucgaacuauggaauauggccccgggauaaaggacauuauuugagcuauuagauuguugcauguagaguaauuauauguuguuauauauacuuucauagauuccuugauuucagaguaagauuuacuaauuuccuuugacugacagacauguuaacuucauuucagaugcaacagucucuuaccaugggaaaugaguuuuaaaaggaacggccacuuauaacuauuggucuucuguaauauugaacaaaauaauauuugguuuuuuucccuuacauuuuacacaugaauacaguaaaauugauguuuucacuuuuuuauucuggaauuuuguaauggaugagcaaaaaacaauaaaaggacugaggaucagaaagcagaaacaaacauuuagguuuuugcaucucgggcaagaguauugaccagauggaagggaauaauuauuuucuaguagcugucaugauauguaauaaagguacuaauaguagcuuauuugggacuagguggaaucugaggugacauugccaggaaaauaacauacaaugguuaugggaauaauuuucauaaagauaaauaacuuuaaaaaauucacuuuuuagcuuuuagaaauguuaucuauacauaccacauauauuguugucuuguuaaaauuuuuuauuauagaaauuaucaaacauaggaaaguagagagaaugauauacuuacuggccaguuuugacaauuaccaacucucgugguccaucacauuucauuuauaucuuaacacaagaaaugguucuguuauaaauggggacauaggacagguaaucgaaucgaauuuuuguauuuguauuuuucagaauacgguauacucaauaguguccaauaucuaauuaaaucugaauggucaguuuuuauguucuucguugauucuuuaguggcauauacauuuuaauuuuucuggugguaguuuguguauuuuacagcaggugcccaaagauagugucucucaaauuuugcugucuucagaaaucacagguauuauuauuaacuacuuuacaguuuucagaauguauuuacauaugaccucauuugauucucacaauaauccuguguggugaguaaggcagacaauuguacuuuuuuuuguuuuuuguuuuuuguuuuuuuucugguaggcaaagugauuugucuaggcccuaaggucauauagcuagcagcuuuuuuagcccaaacuggacuuuagguggcuucuagauuuugcucauugcucuucucauuauacacguuuauguaaguuuaugaaaguuauguauggaaaaucaguuuugaucagaguaaauuuaauagagaaauaugaauggguuuguuuggguugagcuuuauaaauuuaaucauuacuuauauuugguguaauacaaacaguuuguguuuugauuuacuuaacagcugagugaaugugaacguaucugaaauacuauauuuuuaauauuguggauuuuuuuaaguuaggaauuuugauuucaaagaacuguuggccuaggggugucuuaaaucuugaauaaaaauaaaaugugcuguacuaaaaguuucuucuuuaaauuucugcuguaacuuuuuaugcacuuguuuuuauacuauaacauguuuauuaccuaaaucucuuugaaauauucauuuguucuguaaugaaauuuaguuuaaaagguuccaaaugaggagguuuuaguuccugaaauccaaaaccugguuauaaaucucacaagaaaggugugguucuccagcauuaaugugcaugaagaaucaccugggggaguuacugaaagugcagauuccuuggcauugccccuggaauuuugauucagcagauuugagguggggccaaaugcuacaguagucugcauuuugagaaacauugacauugcauuuauaacuaaguuaaaguuacaugguagagauaccuaaaucaguagcaaaguuugauuuguugaugucgaugguuuuugugacaauccuagaacugauaaauugaaaauauuucuguuaucuauguaugcccagucuuucagaagauccaucugugguuacuuaaguuacuuauuaagcacuguaaacuauuagagaauguucuuuuauuuucaugucuuaaugucugccauuuucaaaugacuuagacaccagaguuuauauucauaaaaauaaugcaugcuguauccuuacaguaguguguguuuauccuuuagucuagcucuuuguuagaagaaaagaucggauauuccuucagacuaaaaggacauaaguuaguggauagauagcucucuuuaauuuuaguuaacaagcaguugcucuuucaaaaacagcaaguagaucuuccaagaauauuagugauagcauacuaauugauaauuuacuauuuuaugcauuaaaacagaaguuacugcugucucacuuaaauguuaaauaaccguuuguguaguucaccaaucuacucugacuuuuggaacuauuuuaucuaauaccauauccacgugaauuaccugccuuuaauaauuuuccucuuuaagaccaguuuugaaaugcaguuguuuuuugcuucauuuauaacaguauagcaaauagccuguaucugcauuuaaaauauauuuuauaauaaaauuaauuucaaagcagguucaucucaagacuguugggaaccuguuuuuguuuguuccaaaacuuagucuuguuggcuacaccuuaagguuuauuuaggaaucauagcuuguaauuuacuaaagcuuaugguaaucuaaauuaauaaauauuuuuggcagagagguccaaauaaacugugggcacauuuuuuuuugccauauuuuuaaaagcuauuuucuauuaaauuuuuccuaggacagugucagcuauuccaaaucguaugugguguuuuuaguuauaagaauauuugguauuucuaaguacagugacuuccaacaauaugguuucuuaaaauaugggauaccugcuuuuguaguaauacuacugucaccugggccucugagggaacaaauaaagguaguguugaauggaccaaugcuugcuuacacugugaaaucugagauuacacugccuaacuguaaacuggcaugacuacuguacagaccugauaaauuuaggagucaaauuuauguuuucugaaaaaaauaggucuuaaagaagauuugacuguuuaacuugaaagaugcuuuuuaaauacuuuuuuauuaacaauguggaucuauuauucauuguauuaacccugugagugaguucucucucaggaggauuuuaaauaauaaucuuguacucucaaaacucucagaucugcugcuuuaaucuaccuuucauauuugugccagaauuuucuuuuguuuuucaauaaccuauuuuaaaccacaguuucuucacuaaaacuuucaucuuuuuuuuauuuuucucuuuaucaaaauacaacuugacucugaaggccuuuuauaaaguagcucaguguuuucuaaauuguguuuuagaaugcugguuccaaaaaauauuaauagggauuuccugggggaaagaggcacaaccaaacuccaggauaugcugguuuaugcaguuuggaacuucucugguacuucaaggugcuaauaagggcugaaucuaaauguggcuaguguuuuguccucucauuucacaaaacucccuuuaguggaacaucucaccuuguuaacuuuguguaccaggaucacugcuuugcacaacuccaggggaugcuguucacauacaacacaaaaugaauuguguuuccuggaguugagagcuguguugcauacuguaguauugcugacuguccacugugugacggucuuagagucugguggucccucauccuuuuguugugaauguguauguguuuuuccucucaccugauaggacccuuaggggccagaugcugugcuugaugccuauaaguccuagcacuuugggaggcugaggcaggagguucgcuugaggccaggaguucgaggcugccugggugacacagcaaagaaccuguuuaccaaacaaaaaaaccaaauuaacugccacauugaaauucagaaguggaaaaguccugccuguagagaagcuaaauucuacuguccuaguaacauucugugaaauguauguagcuaucuuccagaaauaaaacauugccuuaugaacccaucugaguaagguuaaaauuccaaagguaaaaagguuuuaaaaaucucccagaaaaauuuccuuaaccuucucugcuuuacuuuaacagaagcuacacaaugucuaaauccuaaaccaauaugccaaaaaaaauaguaccugaacauuugcuggauaaaguucuauauaucgugauauagaacccuauaucuuaucucaguucuuuuauguuaucuccaaaugaauuacuaagacaaagggauaauaaaugggaaguguacaacccggaggacuucagaccagaaaaucaaagagagaugaugggaaaggguggaguaaugcugaguuuugaagaaugggcacauuuagacagaccaaagacugagcaucauaucauugcugccguuccaugaacugagagcaaacuguuagaucaugaccugcuacagaaucacuaggcaucaggaagaagaguagguauauggucuguauuagaguauagcaauggauuauucuuccagcugccaagaagucaagaaggaaagccuguauuugacuuuaucauuucuauugaaugucugagugauacauagaguaguaauuuuagacauuuaaguaacuaaagauuuauauagcuuuaguauguaagcuguuauauuuaaaaaugcuugaaaaaauaagaguuguucuccagaaauuauucauuuuccuaugauuagcacagcugagaccuuacaggugcacugcuauugaguauucucccaaccuuuuaaauuuuauaggucuaauuguugguaagguauuguggaaggaguucuaagacuugcuccugcuuuaauugacguugcaauaauaaucauaauaaaauuguuggucaaagaguagcacaggagugguuuugguagugaagaaaauaaaaagaaaucugaagguagagaugaauggaaucagcaaaagugaaauugguuagauuaguaaguuguuuuucuacugggacacucauggaugauacugacauauacuccauucucccuugcuaauaucuagauuuuuuuaguaccucuaauacuaagagauuuuuaauuucuuugcuauacuucuguccuuuucuucucuauucaugcucaaaagaaaguaagugcuauaacuacucuuuuuuguuugcuuaaaaaaugacucaugaacuuaagguacuuaaguguggacacuccugacaacuaauaccauagcggagaacuacugaguuaaaggguaccagugcaaauagagggcugaaaacaaggaaggucagucagugaaugggaaagaaauaugacaaagccuaggaaagggagcuccucuagcaucaaacugucugcaugucgagucucagaaaaacaaggauucgucagucaaccccuuucugcaugcacaguggauuuaggguaaaguuuauguuacccugucuuuggccgagcgcaguggcuccugccuguaaucccagcccuuugggagacugaagcaggaggauugcuugaccacaggagucugagaccagccugggcaacaugacaaaaccucaucucuacuaaaaaaaaaaaaaaaaaaaaauuuagccaggcauggugucguguaccuguaguccuagcuacuugggaggcugagguaggaggaucgcuugauucuaggagguagagguugcagugaacugagauugugccacagcacuacagccugggcgacagagggagaccgucucugucucaaaaaauagaugacccugccuuugagcuuaagcacuacuguuuuuauguacauaauuuaaugcuggaacuugaucaccuccggcccuccugcugacagcauuucuuuugcuagaaauacccaccuuucucagagccugugucuccuuugguuuugguuuuuacuccaugauauguuaaggacucaccagauuuaaaugugaaauuuaucuucaccacuaaaaagcccacuugucuuggauaaaucacuugguuucuuuaacuccucaaaaaguacaaagucaggggguuuugauuuuucucucuugaaaauuuggcuuuuaacaaaauuuguauagcaaaaacagguuacccgcuccccccaaacuuucaaccauuuauuucuuuauucuguuagguuugccuuccaauuuugucuuuuaacuacuuugucaucauuuugacguuucgucugugauacaccguguuugauuuaugaagauaaauacauuuauugaaaagcuaaauuaucuaagauuucaguuaaacaaguggcauauuacuagcauuuaacucugccucuugccaaacauauacuaaaaugagaauaagggaauucuuuuuuaaaaaagccauaaauccacaagggagaagagaaacccacaccaaaauuuuagaaggcguugacuuaguagacuuaaaaagcugaucucuaaguaauagaaaagcccagaaacaagucaguuuauagaauucccugagagcucaaagcugggaaaacaugggacccauggugaagaggggacaggggggcaaaacgggagaacugguugaaauuuuaggaauuugauacccagauaucuuucccucugucuguacucugugaucucuuuuccuucauccuugcagaaggcuggaagcuugcuuucuggagaaggcuaugcacacugggaauacaguugaaaaccaggguaccacacucaaaaccgaguguuuaccuauuuauguuaagaucaccagucuucuucccucacccagcuuucagaauucuggccagaauagaagugucuuaucuaaccugaccagcucaagguaaaagaccucaagaaucggacauuggcugugucugugucuccaaagaaaaugucccagucagcucacccuacugugaaacccauauugaauccagaacuucuauuuaguuuguguccuuuuuuucucauaaacaaauuuguuauagucuuacuaagauauaauuggcauagaauaaacuuuacacuuaaagugaaaaacuugaguucugaggcauguauauauuuccacagucgccaccacagucagguaaucauuccccuaaauuuuuugugccuccuuaucuuccuucccuuccccuaccccagcuccuccuuuccucaggcagccccgaucugcuuucugucgcuauagaauaauuugacuuuucuggaauuuuauguacauggaaucauacaguauguguucuuuuuuggucugacauucacucaccauaauugaguuucauccauguuguguauauuaguaguucuuguuauugcugaugaggauucacuguauagauacaccacaauuuguccguucgccuguugauggacauuuugguuccaguaacauacagucucuuccuauuaucgaguuguaauuucuuuauauguucuugauaaaaguacuuuaggaagcauuuguguuugugcuggggaugggaagaagaauggugauaaaagauaugaguggaucacuugaggucaggaguucgagaccagccuggccaaaauggugaaaccccgucuuuacuaaaaauacaaaaauuagccgggcguaguggcaugggccuguaauccccacuacuagaggcugaggcaggagaauuguuugagcccaggaggcggagguagugagcugagaucgugccacugcacuccagccuggacaacagagcgagacuccaucucggcaggugggggaaagauauauaugaagccuguaacugaaaaagcaagcgguagcuuuguaagcauuauuuguggagaugaaggauuugaggguacuuuuccuaguugcuucagaguagaaaaugggaugggggacuaagaggacugcugauauuugaaaaaacgguggggguggggaggaacuaagaggacugcuaauauuuaaaaaaaaaaaaaaaaaaaagccuuuuggauuuguuuuccuaaacagacuuuaugcauguauaaguuugucaaaacugaaaaugaauacauguaugaaauaaguuuaaauguguggauaacccagauaugucaucugucauucaucuccugugucuuuguacagucuugugcaauuuagauacacaacucaauuuuacuuuggguaaaauaauccauuuuuacaaaagcagaagugagcaauguggacaugaaggaacauuucuuuagugaagacagucuauggauaacucaagaguccccuuccuuaauuucucccuccagucauccucuacuuugcaaauccagauuccucauuucuuuauuauauagaacaauugauugccuuauuugguuucuugagucuuccccugagauucugacccgccauaccccaagcucauaaagacauauaaagacauuuuuuccaaauaauuacauauagcccacugccugauaagagucugguguaugauuucuguuucuucaucuggauaaggccaaauuccauuccacucauuaaauuucugucuuccuauuaaggaacuugauauuugaauuacuucuugcuuuuuuuuuuuuuuuuuuugaaggaaguagaaucucgggaaaacagcagucauuucuuaagagauguuagaauuuagagggugaaaaaaaaaacaaaacuaauguucuuuuguuaacaugccaugaaaaacagacuagcuccaaaacacacuaguuacuuugacuaaagggaauguaugauuauugaauaaaaugaacaccuguguagcugccuucuaccugcugguacuguucaaagcaauuuacacauauuaacccauuuaaaugaguggguucuguguaauauauggaugagauauucucuauagaaagagaugaaaagggcuaugaauaguuuuaaagggcuaugaauacccuaaaauacagugacuuacauaaccuuuuuaccaguuagaaauguaacacuauauaauguuuggaaaauaggacaauguaaagugaaacaaaucacucauaauccuccgucugagaaauagcuaguuuuaacacuuuaaugguuuuuaucuuuugaaaaacuuaccuauuaacauccuucagauaauguagguauaauuaugugcuuuuuagaaacuuuguauuauuuucucaugucauuaaauuuuuucauuaacaacauuuuaauaauguuguauccuauggcuagucccuuguuauuggauguuuugauuuuaauucuuuucuguuaaauaaucuuccagugagcaucuuuauuugcauauguuugucuucauuuaugauuguuucucuguauuuacuguauuuaaaggauuuugguaguuuguggucuuaugacuaaaauuuucuuccagucuccuuucucugaggcuggucagauuuuggggagucugucuuuucuugcugugucuauaguaugucccacucauuuccaggucucugcuuuacuuuuccaaauuuccauagcacuuuuaagaauucauauuuuguuguucacauguuugacacuuccgugacauguucaguuugggagcaggaacugugcaucuuucugucacucacccuuggcacaaugcccuguuuauaccugugagguuguuaaugauucuugaaugagccucuugugucuggucuugagcuugaauccacugacacuggacuucugcaucuuauagaaacuguagugugcuuggggugagaauuuaucacagauacuguuucuuuuaaauuugagcugaaugauaugucagguaaaugacacaaagauuggaaauauuuucuuauaacuauguuauauaaauuuaauuuuuugugaaacaagaauuuuacuaucccugcuucuaaagagcaggauagacuuuacuaaauagaauagaauacuaagaagcagccaauggaaauggguauuacuauuuaaaaaugccagugaguagauguuuuuguaaaauguugcuuaauagauuaauguaucuaucuuuuuuuuuaauagaggagaaaacuucagaaguuugacaucuaaacuuaaauacaacuacagcuaaagaguuaguccaaaaaaguuaaguuucaguauuguaaacgagguaaaacuagggaaauuuaaaggugucuuggcaggcucuuucugugacaucauauaugaauuuuuuucuuuuuuuuaauucucauuucaaguagaaaauuucagauuugagauaaauauuuucuuuuaaaaaauauuuauaugauugcuaggguagaccguaacaacugugaccugcugagaggagagacuguuauguagagcuuuaagucagccuugcucagugugucugguguuccuucuugguuuccuuuuuugugcagugauucaucaggugcuguaugcuuccagaaccaguguaagugugugcacaugucccauuccuggucugugaucucuucuauaaugaauagggguauauuguuuccagcuauucuuauacaaguaaagaagaaaagcguucuagaaucugcugucaaaccuucagacuucaguaguuuugcuaccauuguauccuauucuuauaauucuuuucuuuuuuuuuuuuugaaacagcaucuugcucuugucgcccaggcuggagugcaauggcacgaucauggcucacugcagacucgaucucucugggcuuaggugauccucccaccuuagccucccggguagcugggacuauaggcaugugccaccaugcucggcuaauuuuuguacuuuuuguagagauaggguuucgccauguugcccaggcuggucucaaacuccugggcucaagcaauuccccuuccucggccucacaaagugcugggauuacaggcgugagccacugcgccuggccaguucuuagaauucuugauggugaucucuggccuucugucacaauuacauuuggaggguuuucuaaguugugcugagcucuguuuguacuucugcacacagccuagguagcaagccaggcuaucaguuuuucauaauguuggacuugcuccuccugucucccuuccugaaguauaccuguggcccuagauuuaaauuaaauguuuccacaagugggaacuguauugguugaaggccuuauuuccgaguggagggaaagcucuuuugagcagauucuuuggccaugccccuucaauguauuugauaccagguaacccccccauaagcagauacccuaaggaguugaaaggaggaaacuuugagugguuugggggauguugagagauuauaguuuaaucuagaucugcacaugcacagaaggaguuugagguugucauuaaaagucauagauuauaguggcauuggggauuuuuuaaaauuaaggugacagcuguaagugggauaugagagggagagagaauaggacagauuauguaguugaauauaacuuuuuuauaucuaguuaguagauacacaucuuucucuauauauauguauuugaacauucagugcaaguguuucuuuuggcuacucaaguaauaauuacuuagaauaguuauggguauaaaaggacgaaauguaucaaauuaauuguaccaugacauuccucuaauuuugaggucaguggaaaccagucuucuuguccuggaauguaacuuaguggacuaaucgcuaucuggaaugcuacuggaauggggaggaaucaaagagaaagcagaaauagaagaagaauggagagagguguaggauaauuuuucucccagccuaaggcuauuauuuauccaguuuccugaaccauguaaaacaaaguagagaaccaggaaauuggcagaaaagcccucuaagccgccagaaguucaugaaucaagacucucagcaccuuacuccacuuuagguguuuacuugcuguauuuauucauauuuuaaauacauuuugauaacugguuugccagcacacugcagaugaaagagagcaaauuucagaaacuagaaagacuguuuagaaucaagcacaaguaucauaggaacuaauugaaaauuuacauuuuagugauggaaaaggaagguuuuuaaaguaaaaaauaagaauucacaaaacuuaauaggcauggacaauuugguuaaaaagcaacggcugugugcugcucuuccuaucuggaauguccucauccaaacuagucauuuuuuuaggacucauuaugaagcuccuucaugaaguucuucuguccuguccagaaaguuaggugcuuaucauuuagauuauucauuaaguuaguacuuaauaaaugaauguguccaguuaaacucugagccuucuauacugcuccauuccuccugucacaaugguuacuucguaucauagcaggaguucuuccuguguuaaagacaugcccaaccuuuucauuguuuaugccuuuguaaaucauacuccccuugccuaaauauuacaaaauaggacucuucauucaagacucacuuuaaaagucaguucuuugauaaggcauugcugcagcuucccuaggcacagucauuuccuugucuguguugccaucacuucauauucaguauuuacuuaauucugaaauaacaguuagaaaauaaauuauuggcuuaauacuaguuguagggaguaaaaugaaaaauuaaguauacauucagaaauacuuuacugacagaagcauacaguacauccucaguguggccaauagguucuuggacacugcaacauuaagugaaaugauguguaacgaaaccaauuuuaccauagacuagucgauauaaacaagaguuaaguucuuauggcauauuucuggucacaaaaacauuaccaaauaucugauauuaaacauugaaauaaguaauuccauacauacauuuaagaaagauuaauaagacaacccaauuuuuggugaaucagugagugacaguggucaugguagguaguagguuaaaucaaagaauaaauguuugcuaagugaaaauuguaaggagcaccuccuaccacacgaaguucaaaaacaaucauaaaaacagcaagcuugcagauugcucucauaccacaucauuucuuauagagcauuuguaugauuauuguauacuuuaguaauuuuuauuugacaauaauuuguaauuauuaauucauuucucugaucugcugauuccaguucagggucaugaguggccagagccucucccugaagcacaucuuuaguaugugggagaaaaccagaauaccuggagaaaacccaugcagauauagggagaaagugaagauuccacacagucgucccagccuggaauugauuuuguuuuuucucaucaaugucguaaugaaaccauguuaaaugaaauauuauucaaggaucugcugucgucuaggcauaguucacuuucuucaauauagaaaaauuugagucuuagccugaguuuuaagucaacuaaaucauuuuggccauugauuaagaauaacaucaugguagcauguugcuuuuuuuuuuaaccuauguucuaugaucuuaaccucuuuagcagcuuugucauugaccuguaacuuugaaacuuaaaguguauagguuucauuagaauuuccuacugguuaaucccagcuuuuuaauugucuuuguguuuuuaauuuuuauuuuuguccuuaauguaauagugacccugaguacuaaugcaugaaaaggaaacaccauccuuucuuaguuugaaaauucugugauuuucugaguuggcaaauucuuuaauugcuuugccugacuugugacaggcaaucugugucuaagcuagcuuuugguuucaguguuacuucuuaauuauaggcuucugaaagauauuuuaaacaaaaauuagggauucaaauucccauagacucaacauggaaaaagggguggacuuuccuguuuugugggcuaagaaugcugggaaguggaaagaaugauuauuugagucggaaauauggcucuuaaguuuaucuguuugcaaaucugucucccuagauagacucaguucuuuguugggaccuagcauaguaugugacauguauuauaagucuuaacaaacugaguaauaauccugagugaucacuuucugguuaauuauguuugacuuuuacaaauuaucuaggauaaauuaugugguacauugacagaagauuuuuguguaaaguauuuaauaaagguuugucuuuauaaugacaaguuuuagcuuauggcaaauaucuuauaacccaauucuggugaauaaauaaguguuuuugacauggagaagaguuugaguaucauacuaauaacagucacagacuucaaaccauugcuuuccuuaaagaaaauggaguuggcuuauagacuuuaauauuugaggucauaaggauaaagaaucugauuuucuuuuuuaguuagaagaggacugauuguaucagaagcauguugcauguaacaguugguaucauuuaauccauauaauagcccucuaaauaggaugaugauuuuuuuuucccuguagacagagaaaugaaucaguuuacaugcccaaaugcugaauggcagaaaggcaugugggcccagcugucuaacucuaguccacugcucuuucugcuguacacaguugagccucucacauguuacuagaaguuugaaauaaugucaaaaacuagaucguuuuuccuuuuuggaauuaaaauguucuuggaugauucuuaaagugcuugccuaauuuacccaaagauugauggaaaauguacaagaggcuagggauuugguuuauucuuauugauucuaaauauugacugcaaaaaagccagauuuaaauccaguucuccuuagguugugggaauauugugccacucacuuaaagugacaagcagugaagauuugauauuauccugauuuuaaagggagaauuuauacuaccagaaguuuuaggagaaaauaguaauucuugauuaaaugugguauuuccagugauagcaggggaaaauaguuaaggucuguaguagaaaagcacaauaaucaagaucuuagaaagcauucaugucaaaauuaguaagugguaaguaauaaaugguaaaauacguguuuauuaguuuuuuuuuuuuaaaaaaagcaaaacuguuuaauucaacucacaagaaugagcaaguucuuuggacuuaaguuguugacauucugaguugauucaggggauccuguauuacaagacacuuuauugccuugccucugauaaacaacaguauuugugauauaauuuuuaccgaugucccuauacuuaaaaugugugagcuacccacuuuauuaauaagacuuuuauacagaauuacucuuaaugauaaaucuuccaaaaaaaaaaaagauuugccaucauugaggauauuuucuuuaaaaaguaucccagaguauaaaggaaauuucaaaaaaggagagcaaauguuuuaagcaauggcagcauuauuagaaugauuuaaguuaauucuugguagaaaaauaaacauuuauuaggcuauauauguucugguauuuauuuugaaauaucuguuauugcuuuauagucauaccacauaguaagcagcauauaggacagaguuuagaguaucuuagcuauucaguaaaagcuuaccacaaagaauccuagcauacagaaaguucauaacugggguuucugcacauuuuaugccuaaacuauagaaaaguaaagcaauugauaggaauuuauucaaaaguugaauucuagguuuguguuaggauuaguaggaauucaauucagaccauuacaauuucuguauuuacaguauccuacaaugacauuuaauauuuagaaaacauuugcuaaacuuuugauauucagaaaauauuugcuaaacuucuguauacaugacuuuguguguacuauguguaugaggaaggauaggagaugaaggugaggauacaaaagguaucucccuuacuaguuucuaauauguauguuuaaaauagacaaauggaagucuacaaauauauagcaaguuaacaaauagauaaggaguaagaagccguauuaaauaugggccagauguggaauaaggcagccccagagcugcaaauugggaauuuaguguuuuuaaauucccucucagaggcaugaugguuguuagugcauuugucuggggccagaaaggcaggccagauggaaacgccauuuuacaguucauuuccaauguuuugugagugugguagguugggagacagagugaguuuauacucagcugcuggaagacccaauuuccuucugaaucaaagaaaguuuaaauuuuauuucguguuuaccugcauuguaaaauuacauuucuuuggaaacuguuaauuuaugacacuaggaaaucaggaccagauugccagugaauaauuuuuuuuaguaugaguguccuaaguauuguauaggacauacaugggauuaaaaaauuauuuguugauuaucugaaauuuaaauuuaacuggguagcuuguauuuuauuuuguagcccuguuaggaccugacaagagaagcugaaauacagacuguauguaaguuguaaaaagagugcuagcauugaaaacaacgucuaaagagcaucuguuuauugccaaucagaauaggugguuuuuagauucacugaagucagugaauguggugaacuaagguucugaacuaucaaagagaauuugauaaugaaucuaaauaacaacuaagguugaggcuucuuccuguguauuuuuugguaaaggaaccuauaagcaaaagauacgauuagcccuaagcuuacggauggcaaaaccaauauuuuauacuuggacugggagacauaaggaagauuugggggauagacaaagaauuuuagagcuagaaaagugcuuugaaaaccugguccagcccuuucuuuaacagaugagaagacugagucccagguacacagcaaccuaccccaagacccugcaguaaggaucaaagcccagaucugacucccaccuuagugccuguuccacuguucaauguuuagcuuuccuaaaccgugacaaaaggaguauucauucaacaaagaauuugagugccagcuguauguagugccaccuauaguuucagauacuaggcuagauuuuggggauaauauuggccaaagcagguagucucuguccuauauaaaaugaaauuuauugucuguccauuuaucauagugcuaaaugagcaagacuuaggauaaaauaguuucauuaaaauguacaguccagagcuagaagucugacuccugaucccuggagcucacuccccuauucagcaguuuauaauaguugugaaaaaauuuaugugagucuccagauauuuuauaaccuaaaacauuugugcaguuaauaguuugaacugcugcuuuauuuauaguucacucaguuauccucaguaaugaagaguaacauugaugagaccucaacaguuacaugaaaugaagugcuguaaauucaucaccuggcacagugaacaaaaaucugaccuuggcugaaggcuguaucuucuccuuggguuagauuccugccugcugagagccuugguguggaaugaugucuaauuuauaagaaagugagugccuuugggugcuuacauaggagcucuggauuugucagcacuguggucuugauuuucuucuccucaccuggaggagaguguucuuacauguucuugguuuuaguuuacuuuuguuuuuguuuuuaaauaacuaucugauuuagcauucuacauauaacuaaauugauggaaaaggugauauugcacauacuguaugaguuuugccuccuaauucacaguccagugaauucuuggauauguuuuaaugguuccugaauaaauauaugaaauauauuuuguuugauuuaaacguuuaaaaaguaaauauuauuguaaguuguaaaauacuaacauugcuguuuaagcagcauuuauuuuaaucccauguugaauuuaaucccaaaauauuaguaucuuucucucuuaguaaauagaguguauggaauaaaacuuaauguuucuuguagugagaaagacacuaggugauuugaccacuuucuuggccuuacugccuaauaauuugaaaguacaguugucccucaguuuccaugggggauuaauuccaggaccaccccaccuccacccaccuagauagcaaaacccacagauguucaaguaccucauguaaaauauguuugcauguaaccuacacacauccucccauauacagaaaugcguugcaauuucguuauugugcaaauucacacaguguacuacacaaaccuagaugguauagccuacugcagccccuaagcuauguggcauagccuauugcuucuaggcugcaaacccauauagcauguuacuguacuaaauauuguaggcaguguaacacgacaguaaauguuuguguaucuaaacauaaaagcguuacaguaaaaauugguauuauaaucuuaugggaccauuaucaaaucugugguuuguccuuguugaccgaaacguuaugcagugcauggcuguacuuuaaucaucucuagauugcuuauaauaccuaacauaauuaaaugcuauguaaauaguuguuaugcuguauuguucagggaauaacgacaagaaaaacaugucuguaaaugcucagacacauccuuuuuuuuccccccgaauauuuucuauucgugguugguuggauacagaacccacagauagagagggucaacuguauuaguaaccccaggaggaguauuauauuaaaggaauuauagauauaugguagagacaggaucuauauauuuuuaucuggacuaauacucaguuuucucuuaauguguauguggccacuguaauaacacuuauugucacuuuaauauaaauuuaugugcaucugugcauguuuauacaccauauacaugaaucauguaauuucagguugagaaugaacauaaauaugccaugcaccgauguaggcauagugaaacauggaaauggccuuuguccagagagugcucuuagaccaguuagguuguuuaucaguaugauuaguuggccauaacauucauuuauuacaguaguauuucuuaagaguauacucacuguaaaacaaauuuugcuaaaauuuccuugggaaauuuuuuggaagguuuaaugauaauguugcguaacauuggauaaaaggcaaaauacaguuaugguuuuaaaaauucuaacuacaaaguaaaauaaaagugaguguacgcaaaagcauaucaguaucuggcauucuuguaguaggggagaagagaggaaaggaauuugagaagggggucuggucuuugcuuaggguaaagaguaaaucaaauuacaauggauuguagauauuggaacugcauuauuuaguacuuggaaauacauuucuaacagcuuaagcuggauauacuuuugguuuaucuucucaagggauuaggguauaaaauaauccaucaucuaaaaauggugaaagauugccuugaagaacacaugcugaaggaaauuuuagaaaauuuucuuucuuuaaaaaugguaguguuuucauuccauaccuggagauaaaaaguauauuaaaauuaaauaauguccgaagcaaaaguggaucuguuagucugcuagggcuccauaacagaaugcuacagacaagguggcuuaaacaacagaaauuuauuuucucauaguucuggaguuuggaauuccaagaucaaggugucagcaagguaaguuuucuccugaggccucucuccuuggcuugcugauggccuucuucuugcuguguccucauauggccuuuuugcugguaucucuucuuaaggacaccaguucuauuggauuagggucccacccauaagaccuguuuuaaugcuuaauuaccucuuaagaccuuauugccaaauauggucacauuggaauuuaaggcuuuaacauaggaauuuuagggggacacaauccaguccauaauagagaaagcaaagaaauucacacuaaaauguaauuuuagucaacuaaaacaugguucucaaacuuuagcaugcaccagaaucacuuggaaggcuuggugaggccacacccccagaguuucugacuuaagaggucuggagugggucugagaauuugcauuucugccaagcuccauggugaugcugauacugcuagucuggggaccauacuuugagagucacugauuucauauuuacuguuuggauugaaagaaguuguugaagaaagccccugaaauaagggaaacuguccugaggaugggggagggaggauagugaccagagggauugcagugggaaauagaagacacaguggacauguuggugaaacauugauuucguuuacccauaguuacguuucccaauucagugaguugaagagauccuuugauuggagguuaaaagcaagcacuucuguugucuguuacaagaggaaaaaugacucuaggcuuuauuauaaggaacuuaagucccagacuacuuaucaccucauuuagauuuuuggucaaaugucccacucuugguaaggcacucccuugaucauccugcuaaauugcaucuaugaaugacugucacaauaaaauacggcaauggcggaggcuacauugagaaauacaaauuagguagacuggugccugaagcuuggaauuuagaguuuacuuaauuucaacaaacuuuuugaguuuaaaguauaggcaauuacuaaaauuggauugugcuccaaaaguucucuuucauugguuuagaaauugaaaugaauuuuucuguagaaauacaacuguaaacaauggucaaggaaauucuaaaaggaaaugaaaucgcucauauuaguaaaaugagacauggggguccuguuuagauuaauauggguuaauaggcaagagggagagaagccaaguuucucuccgcuguccaaucucaaaugguccaaaaggaaaagauuaaguuuuagacaguaaacauaaagcucugcauuaccugcucuaaaauaacucacuuuuuuucauuuaaaaauuacucuuuucuugguguggcugauuuuagcugagugcugaaacaguccuaauuuguuauguagucugaaugaccacuauuucccuaauccuucagagguucuuguguuuuaagaaguggauaggcauguguauguugucuguauauguguguauagcuguguauaaauauauaugaaacaugaguucauacugauagcuccacuuccaguccaguuuacaggguucuuccuugccuuccccucaucccauuuuugucuuuauucuuccauagcgagaaugguagcucccagcguuagcacauuuaauucuuggcccucugccccaacccaguuuguuucaauuuuacauuuugaauauguagaacauuaaugugcuuauaaaaguucagaacugccaacacaaaaaauguacagucaguccuuuccuuuucuacuuucccgucccugcucuuuuuguaaguaaccaauuuucauguuuuuugauuuauuauuucuguguuucuuuuccaaaaauagacauguauguuuucuuauuucuucuuucuuacacagaaaguagcauguguuuuguacuuugcuuuuuuuccccccuaauggauauaucuuggaaauuccaccauauugacuuguagacauuguccucauucuuuuuuacagcuguaugguauuuggccauucugcauauuccaaacguuaggauauucaaguaguuuccagcauuuugaauuuauuaauaaugcugcaaugaaaaacuugguucauuuguauuuucauagugcuaagguuuaucuucgaaguggauuccuggaauugagauugcuggaaugaaggguaaauuaauauauaguuuuauuaguuauugucagauucccuucucuagcaauccguuacugcauaacagaccaccccaaacuuaauuguguaaaacaguuguuuuauuaugcuccuggauccucagucagaaauuuggguuggggacaucggggugacuuguucucuccucuacacugucuggaacuuucaugggaaaaucucaaaugaccgggggcuggauagaauaguuacgggcuagaauuacauguugauuucuucauucauaucuggugccuaggcugggaugacugcugauauugggcucaguuuagacugucaaccagacauguacacauggccucucuuuguagcuuacgcuucuuuacggaauugggagccugauuucugauagggcauauccgaagagugggcauuccaagacagucagacagaagcugaccuggcuucaagucccauaauguugcuucugugauauucuuuuggccaaagcaguacuaagucugcccagauucaaguguagggacauagacuacaaccucuccacauggcuguguaaaagaaaaauugugacuaaguuuuaaaauugccauaugacauuuuacauacauugcuggugaauugauuguuucccccaaaccuugccaaacaguauuuucuggcuuuugaacuuucauuaaugugaaugaugagagaugauauuuucagcauaguuuuaauuugcauuucucuuuugagugaaguugaacaucuuauuuuuuaagggcuauuuuuauauuuuggugaauugucuauggcuuucaaucauucuucuuuaggagauuugauucuuuuuucccucaacuuaaaacauuuauuuuauguauuagggaaaguagcccuuuuucugugauauugguaauauuuucuccaaauuuguuacuucugucucaucuuugcuuauguuguguuuugccaugcagaaguuuaauuuuguggucaaauuuaucacgcuuauguaauaccucugauuuuuaagucacaguuaaaccuuacccuguacuccgauuacagagugguucaccuauguuuucuucuaauucuuguguaguuucauugcuuuguuccauuuggaauuuauucugaugugguauaagaaauugaucuaauuucaucuuugaaugacuguucaguagucccaacacaguuuauggaaaaguccauuuuugcuuccucucccucacaaaugauuuaagcuacuaccauugucauauauuuauuucuguauguaguuagaucuguuucuggacuuucuauuucaguccauuggucuuuuuaucuaucauugccauacuguuuuauucauagggacuuuacaguguauuuuaguaucugguagagcuaauauuuccaucaucuuuauucuucgcugugguuucuuggcuauuuuugcauguuucguuuccccuaaacgaaaacuaaacuaaacaccagcuuguuuaguuucaggaaaaaagcuuguuguuuuuauuaggcuugcauuaaauuuacaaauugacuuagagaaguccuaaucaugacaaagaaugucucucuuuguuuaagucuaccauguuauauuucagguguuuuuacaguuuucuuuauauagauuuugaacauuucuuguuauauuuauucauaagugucuuuaaucuuuuuugguugcuaucgugguggaguuuucuguuauauuuuguaauugguuauuaguuguguauauaaaggcuauuuuauguauguuuugauuuuuauauuuaguuguuucauugaauuaauuuucauuggcucucaguccgugauauucaaggucuacuauuaugucaucuguagagaucauuuuuccuuccuaauucuuauguuucuaguuguuuucuuuugucuaauucuucacugguaucuuuagaaugauguuaaauaguaguggaacuagcaggcauccuuugccuuguauauuaaaugccucuaguuuuccccauuaauuaagauaauugacuuuagaacugagguggauauaauuuauaauguaaaguacucauuuauuucuguuuaccagauuuucuaauauuggacuauauauuccugguauaaauuccacuugaucaugguauauuuuuucuucaugccauuuggagacuauuugcagaaauccuaacuaaaauauuagcaucaauuuuuguaaguaauguuggucuaaauuuucucuuuauuagguuuagaugucaguguuuauuugcuucauaagaaacuugcauuagcugggcguggugguacacgucuguaaucccagccacucaggaggcugaggcacgagaaucacuugagucugggaggcggagguugcagugagccaagaucacgccacugcacuccagccugggugacagagugagacugugucucaaaaaaaaaaaaaaaauuuauagggauuuuucuuugcaacauuuucuguuucaucugucucuguuauggucaguuuugguaagcuguauuuucuuaagaaauuauuucauuuagguuuuaagauuuauuuucauagaagucuuuaaucucuuauuuugggggauuuccucuucugucauuuuuauucaguauaucugugcauuuuuccuacguuaucagcauguguauaacauaugcauucuuuucuuuuuaccguguuccacuuuaguuuuaguccuacgauuaacuauauuaaaugcuugccauuagucauuuugcuaaagcuucccagauuagcucuuaguuggaugaauuucacucucuaauaaauuccuuaggaaugcuccaauguauugcugaguucuuguacauucgaaacuguuucucuuuuuguauacuuaaugcuugaaggaaagcucagcucccacauucugaaguuucuugaaaaugcuguuccgugguuaucuuucuuuguauguuuuugaagucuaguuuucuuacuuuuuaaaguaauguuuguuuuuuuguucggaugcucuggggauuuuuuuuuaaucuuuaaacuaguuuaguacaugucuugaaguagauuguucuagguccaguuuuccggauauacaguggacccuuucauuaugcugguuuagauugccucuucuauguggaaagauuucuugaauuauaguuuuuaaauacuaguucuguuccguuguuucugaaaagacuccaguuauacaguguuggaucucuugcacauuuucuguuucagcuacuaccucuugacccuuacuccuuuuuuaaaaaaucuaauuuucauucucuuauuuuucuuaauuucuucagugacccuugcuagauuuucuacucgaaauccguucuccaaugagcauuuuguaauucuuaauuuccaaaauaauuuugucuuuuuucuuucaauuuccucccugagaaugaucaggugucauuguauuucuuccuggauuuguguucaucucucuuuuuaguuuuugaauuuuugguuccaggugauuuuuguuucuguuguuaauaucugcaaauacuugcuugaguauuuaauuuaauuugaaguauugcuuuacaguuuucuuccauuuuguggaguguguuuggggcagggggugauuguuuuguggagagaauguucaucagcugaaaugugauuugcauuuucuguuuucuuccuccaguuccuuuucuauggaguuggcuugauuuuuauuuucuuuuauuccuugguaguuugugaacuagguucuuaguuuaagaaugcuuauugucaaaauagugaaguacaucuuuuuaauggauaaugaugguagugaagaggaggcaggaguuuaugugucuuucucuuugguuucuauaagauccuuaauuuucucuucuuuuccuuuacugccauaucuccaagggacaccucccuucucuguuuaucuucucccccagaagcccuaauugugccugccauuuccgcugcuauucccuuucaaucucuuguauagcugauauugugaaauaucaaauucuaguauuuaguauuuugucaguguguguuggacuuucuuuucuaugggugauuuugucuguacuuccucuauguccuuugguccccuuuucucuuuugucauagagucuuaagccuccccucuccuacgauguacccucagauuugcauuggccaagggaguuuuguuggauuuuggcauuuauuucucuacuuacagguaauuugaaguuugugguacuccacuugcuguuaauacuggaggcuaccuaugguuuuauuuguacuucuuaugauauugugcuuuuugggggaaaagagagauugggaucaggcuacugccauuauccuucuggcucagaaguuccacaggagcuuuuuaaaaucaagauuaagucuugguccuggagacugauuccaacgguaugaagugaauuuuuuaaaagacuaguuccauuauguggauauagagcuaauuuuagcaacugguugccuuagaccagggagaggccaauauuuuuguaaagggucagauauuaaauauuuuaggcuuugaggacuaucuuuguuguguauucuucauuuuuaagccuuuaagaugugaaauaauaaaauaaaaauucuuagucuuuggcugugcaaacucaggcugugggugauuuuggccaaccucugccuuagaccaccuucaaaaguccuuuuuuuuccaaaagcuuggcuuaaaaguuauuguaauguuuaccuuuuucugagagccuaaaauagugauuuuuuuuuuaaugccuuaaguagcuuuggaucuacucuggagcauaaaccaagagguacaaacuagaaaacauagaaguaacaauaugaaaugggaaauguaaauguaguuguuaccauuuagaugcuucagcaacagaggaacuuuauauuauuccuguaaaacaccuaacuuuacgaacacuguggaugccuagcauauugaccaccacaaugaguagcagcuaguaugcauguaaaugugcgaaugagaaguucuuggagaauaaguugcaaauggcccuccagaguuguuuaaauuuuaaaaauuuaugucaaaacgauuuugacuuuugcauggcugaaauugagccuuucuggcaguauacagguucaauugcuucuuaaggcaagucuugauuuuuguuaguaagacacaugcaaaauagcuuccuauuugccauggccagagggcauauccuuagucuugaagcuguaucccauugucuaaauauauuggagaaagugugugaaaucuuacucugugugugaccaucuuuacuacuucugauuuuccccagcagcaguaguaaauagucauaaaacucaaggagccaaagagaucauuucagaagaguaaauaagaugaauaacagcauaguguugagaacagauaaagcuuaguuugcaggcucauuagucauugagcaccucugaaugucacucacugacagguucucucuacacccacaagaagaaaacaugaaacggaggccaaauggccacuucaaaaaauaucauuuaauccuucuguauuccacgaggggauugauuucuauuauggaaucacuaugguuugaaguauggguuauuggggguuuuuuagggaaaagaaaggcaguauguuacgcaucuuuaguuuuuuggucaccagucauuuuaucuucauuauucauggauguguagucaguguguaaaaaucuuuuguuaaguaggggccaguuagguuaguuuguagugaacugaaacccuuggauuuuuuuuuuaaaugauuucuccauucuguauauguguguguguguguguguguguguguguguguguguguguguguguauauauauauauauauaauuccugcaugcccccaacccccugaaauccaaaggcaggauuuaguauuuguaaaaugucauuuguuccuuucuuugucccauucugugaacaucuaguuacgguauuugaaacuugucuuuuaugcuuuccuuuagguuuuugauuaaagagugaaaaggaugaacauauaauuuaauugguauucuacuacugguggaauucugaauagucacacccgauuuuaugauacugucuaagaagaagaaaagaacauugguaugaaguuugguaucaggagaaauaagcaaaugaaaagaguugaaggaaccaguuuauguauuuuuauggaaguaaguaguaguauaauguuacuuccaguacaguuuuccuuugaagguaguagaggaggaugcagagaaggguacauuuguucuguggcauuuucaguuguaaaaugaguaaaucauaaguuucauuauaagcuuggucuuguguucuuccauuuaaaguguggugaaucagauauugccauuagugaauuaagaggagaauauuugaaggacaaauuaaucucaguuggagacuauuccuuaaaauguucauuagugugcuagaaagauuugggagaagguauaaucacuaccucccgcuucccagcauacaauugaaauuaaacuccuguggauaagucacucaaaacagcugggcucugccuaggaguaucucaaaagcugggcccuagauccauguaaaauacaagguguuuaauauccuacagggucuguauucaguaucauuuggcagugacaaaggaagcuucugucugcugauccuuguguaucccugcacauauacagaguaguuguuaaucuuuaaaauugcgaaaugcuuuucaggauagcacugugauuguuuuuguuuguuucuuuguuuggugguggugguggugguggugguguuuauuuuugagagagagugacuucugaauuuuuugguccauaaugcauacaaguuccuacagaguuuucuucugaggaaagaauuugauuugccaccguguagaaaaggcucacuuuuuuuguguucuauaauaauaacuaaaaagucugcuuuauaaauuugggaauuauucuuuuaacaaugagaauuuagaaggauaaguaucuuguaagacuguggagccagaacguuuuguuuuguauguuuggcacagcuauaaaaugaauaagcuguaucuauuugcaauuuuuauacucaguuaaguaaaagugucuucccuuagggaagacugcauuccccaaacuuugcauacuacuuuauuauccuguuaaagcagauauuaccuacauaaacaucaauaguagaaauauuucuucucauuuaaaaauuguaauauagcugggugugguagcuuaugccuguauuccaagcuucuugggaaucccagcuaccaggagguggagaucagccugggcaacguagugagacccugucucuaccuaauauacauauuauauauauguguagcgagagagggagaaaauauuuauuuuucuagacaauuaugacuuuaagaugaguguucuaaggcauaugcaguuguaucugaugcugcacaaagucugacaaaauacaucaccaguaauucuagcaaccaucaauuguguaaaccuugucuguaauuucuuuugcaauaccuuacaugauuuuguacauccaagguaaauucagaaacuauuuauuguugaggguaaauugaacaccuucgguuuuaaccuuguaaucuguacuucccagagccucucaggagcaccuacaaugggagagaggagauugggagguucucuaagauugguagguucuccaucacugcacuucuuucccuaaccuccaccucauccaaacuccuagcuuggauuuuguguuuuacauaucagacauaauuaacccccucccccaaugaggaaacauuugaugacaaauuucugaaguuguuuaaaaaagaaauucuuccagucuaaauugauuuguuaaauauucuucaaguaauguuauuuuaugggaauguuuuauuauuuguuuuugaaauaauaauacuaaaaauaacuccuggcucgucaggaaacuuuacaguaaaaguaguaucuuuccccagaaaguuaacagaacaccuaucacuggaauuauaaaugugucuggggcaauccagaaaagacuccucucuuaccuguuuuaucagucaugugaaauauuuuggugguccugaacuugaguugugguggucacuuuuuuuuggaauguaguaaaagcacuucauugcuucaauuguaaguuauaugacagcaauauauauggagagggugcagauuuuauauuucuguguuuuucuagcagugccauuuauucauuuaacaaauauauaagugccuaacuuguguucgaccgcauacuuaggcucauugcuaauauagcaguaagacauauucucaaaauucaaaauaauaauuuuuaaagauugaggaacuacaguaauucugcuuucagaauacaggucgucauccaucagaauggauuaauuaacuugucuugaauauuuugauucugaaagacguaaguugacauuuauauaacaugauucucucuauacuguuaaauuuacgcauuauguaugaaaaguauaagcuuauugcuagaacaaauggagguuuucuaguucauuuuuaaugagcaauucuuggauuguaagcuagacgggaucuuuucccuuuuucagucuuuguguuuccuuaguguaauaugaugccuuucacauaaugggcuuuauuaaauauugaugauaaugaaaauuguugaucccuaaaacacaggacacuucuggauuaaaauucccaagaauuuuggugacagcuucuuaauacauaauaucucgaguuucugaaauaccuguaagagcuuuucagauuuuggcuaaucuuagcaugugacaauuuuaaguguucaaauaucugauucaagcaaguauacuuuauguaacggcuaguguuuucaguaaugugaacaauauuuuacauuuacuugguagucuauuuuuuguuuuuaauucuaugcauugcuuuuccaaauagaugauugucucagagaggugugguuccaugccuccauaacauacaugcaaaggcagagugcugaggagcaaaccacacugacugggugugaaucccagcucugccccuuaauaguugugugaacuuggacaaauuucuuaaccugccucacuucaguuuccucuauuguaaaauggaaagcugauuaauaccagucucauaggagcacaguaaaccaaaaacgcuguugaaauguuagcuauuguuaccaucaucauuaauaaucauccacuuuauguaaaacuggcagcauagugcucucuauauaguaagcauucaaaauugggugguuuuucauuuagauuuggcagcaagccagagguaguacuuugagauguguuugcuaguauagguacaaguucaaagaauuuguuucuaauacugccuugugaccagacauuucccauuuacccauccuuaucuuuccuuuccuuuuuuuuuuuuuuugccaauucuaaaaggcucuaaucagacacugcuuugaacccugugugaacuucaugccuacuuuuuuccuuuuuuacugaacuaugaauaauaaaagguuaaaaaaagaaucaaccaguauauacuuaccacaauuguaauuaaauuguguaauuaguaguuugauugauugauugauugauaccuccuucaaaggaauauaaguuccauggagacaggaauuauugugucuugcucaccacuguguccccaacaccuaccaugcagauaagccuugaaugaggaaauacuauaugaauaccuggucuuuucuugcccaugucaguaagagguuaaacgacaugaaagucagucuucaccucuucagaaacauauaaauuaauugagguaugcaguauacagguauaaagagcuagaaaaacccaacuugaaaugcucgaauaagaaacuagcuguaaacuguuacuuguuguuuaucuccugauuauauuuuggagggaaugaugacccagugcuagcugugacacccccuguaccacugguuuuacucaugucauauucauaacauuuccuaauuaccucaucagcccucaaucauagcugauauguauaagaccacugcugcccuuaucuuggagaugaaaauccauacacuucaaauuaaaauuuggcauaguaaagaacauuuugcaacuaucagguagaaauguuggguccuuaugaaagagauaguaugcaagaugucguauuuguugucuuuuaguccucauggcacccucacaguguugauagcaauguaucuaauguuuuauggacaggauuuguaacuguuauauacgaccagaucugaaauuuugugguuuagagggaauagaaagaaaagaugaaugugauaaguugggaagaaaaaggaacuuagcuacuuauuggauauugggaaacagaaaucagaagugcuuuuauauuuaagugguggauacuuugaaauaggaaagacgagagcgcauauauuauucugugaaacaguaguuugaagugauauuaauagguucucuguaggaaaaaguagguaaaaacaaguucaggaaauguugcauauaauauuucccucuuguagguucacaaauaugcaaggcuaugaaaaguaucuggcugaagaaaaccuauuuaacuguacugaacacaaaacaccuuuuuucacagcacaacuauuaacauacuaugagauagcuucuccagcucaccaguuuggaagucuagucuagaggaauuuggaaguucuuaauaggaauagaguuuuuguguuugaguuugaggauaggaauaagauuacugucaagauuuuggagaugaaagauaaaugaagcuuagaauuauaguuuuguaaauucagcuaaguggaaacaagaggcuaaacuuggaaaggaaaauacaaauauccaguuguaauccugaauugcaugugggucuuucagacaagguacaguauuucaguaccucaaguguauacagauaaccgcacuagacuuaauaugauucacaguaguuggguaaugaaggguacagguaguguuuauaaauauaaaucuauagucauaaguuugagugccagugagaugaaaauagaagacuccagacucuacugugguggguguggagauagugguugggugggagagaggcagaaaguacauaggggagccagucagagacacagagaaggaagggucagauaaauagauauaaaauuagaauuguacacggaaggcaagagacguguacaaggcaagaggauuucgcgcgauaggcagccauaugugcuagauaagaaaggaauagaaaggaauauacauacaucagagggcccaguuucuuuuucuuccuuuuuaaaauuguuuuuauuuuuugagagggagucucguucugucacccaugcuggagugcaguagcgugauaucagcucacugcagccucucccucccagauucaagcaauccuucuaccucagccucuuguauagcugggauuacaggcacccgccacuaugcccagcuaauuuggguauuuuaauagagacgggguuucaccauguugaccaggcugcccuugaacuccuggccucaggugaucugccugccucagccucccaaagugcugggauuacaggcgugagccacugcaccagccaguuucucuauuuuacacauaagaaaaaugaaaccaagggagauagagcaauuugcuuaggauuaagugcuagcacagcagagucagaauuagaauuuugucauuucguuguugcuucuuucuacucuagagauuucaaaaaggaagagauugcuaaugaugauacugagguaucuccucucuugggguaaaggagacuugcugucucuaaagggaccucucaggauagagauugcauuucuuaguaguuuaccauaguaaagagucugaaacuuauagacccuguagccuaguauuucuacaguuaccuaauuuuugucucagguucauauuuacagaguucaugagcuugauauaaaaaucagaauguccauuaauuuacaguaaaaaaaaaaaaaaaaacugccuugggaaacagacucucaggucuuggcuagcacauucucuucccuguagauuuaccacaugggaaaccacguuauaauuaggagguugcuuagugaguauguaggcagaacaagcgguauguuuggaaugugugauggacucaggcuuuucuuaacuucucaaagaccgguuaguuaccucaucuggcaauuggggguaauaauauuaaauacuacauugcauagggcauugggaagauuaggcgaaaggauccauguagaguguauacugcaaauugcuaaacacagugucuggcacagguguccuccucuuaacucugguaaguagucaacauuuuaaucccucaguuaggauacaaauacuacuguaaccucauugugaacguagaaaacucuuccuucuaaauacugcuugaaugagaaaggccagauuuucuuuuccucuucuaaugaucguccuuagaagacgauguuugaccaacccauuucugacuguuaaaugcuuuuuuucucccauugaguuaaacugacucauucagucuaccuaaugucagaucuugaguccugggcuccauuuugcucuuuuuagguugcccauuuugaauguucugcucaauccauuuuauuagguugagcucuaugaaauugcugauauucuccugguuuucauccacaaaaauggcagugucauaugguuuaaccugauauaauguauaaugauuuuaaauuuuaauuccuuucagaugauccuagcaguuccuauuccaagucaguugaugaggucugagcccccccaccccuuuuuuuuuuuuuuaauguauaaggccugaacuguuauacuucuuucccugugaucagguuccaagaagguucuucuguuguaugugggcaugugucuuuuguauaguguaucauuuuuccuuuucucuuuacauuuagaucagaccagcauuaaccaggcgaaugauuacuuguacuuccuuaacugauaguuuacguuuugcauuuauuauuaauuuuuuugauuguuaagccaaaguuugcugcucaguauacauucuguuuauuauauucuaggacauaagcauuaauuuuaaaaccgucacagcuuugguaaggauauuguggauuaguaccaggauugguagauuucuucuguuauacuagaauuucaguguaaugcugauagaucaaagucagaaugccuguuggauacucuguucaauacuugcacgacgggaucuuucauacuccaaaccucagcaucuggcaguauacccagguaauaagccugcacauguacucacugaaucuaaaauaaaaguugaaaaaaacaaaccaaaacaacaacaacuacaaaaagucagaaugcguaacaauugaaaaaaaaaaaaauucgguuuuauuuugugcacauaacauccauugcauuuaggaaauaaucuguauuuauuuuuuauuuauuguuaaacguauuuauuauuuuuauuauuauuuagaaaagaaucuguuggauugcuccucugacagauuagcuccuuuccccuccuguuucugguucuuguccauuuacaguaugucaguucuacaugauuauaucuaucuuuggguagauacauuucugugcuuucccccugaauauugugucacaaagaguuuuccaauuuggcauuuaauuuccuagucauuauuuuuaaaucucuaagaaucuuaaacaguuaaucaucugauuuuaauugugagaagaaaacuuuuuucucccacuggugugucacucuccuuuucuucuuaaaguugaccauucugguuuggagaucagcaguuauaaaauuauagauacguaauaccucccucuugcuuuuuaauucuuaaauacuauuugaugucauauauaaggacaucacauucauauacugaacugaauauuuuuguuuauuuaacaaauauauauugugugccuucuauaucacccagcuaacuuaagcauuauguaauguaugcaaaauaggagaguuuauuagagacaaauuaaaaauauuacuauuaauuaucaccauaguuauuacacuuaauaauauacacuauacaguucaugacuguuuuuuauuaagugccaggcccuagcucuaagacauugggaugauucuaagauaguucauaugguaauucauuuaaucugcucagaaauuaugagauggaggugauauccauauucuacaaacgaggaagcugaagcacuacguaaguuguucagggucacgcagcuaguacgagaaagugcugggaggaaaucuaagaagcuguggaccugucaucauccuaguuaugauuuagugucaggucaggcauccucuugagugcugaaaaaaaucuuugcuucuuugggauugacagucuuuuuugcuggcaccugagaugggccuugcuaaaggacaucuguuugucuucaauaucauugccacguucugcaguuccguuaagugacccuguguugagcaguuucugugggcaagguacuguugcuggaguggucacuaggagauacagaaaugaacaagaccauccugcccucagcuuacaguuuaaucaggaagaaagauuaaacuguaagcugaaaauguacacaagaaauguacacaagaaaaugcacaaaagaaaaugcaguacacaagaaaaugcaguacauacugagugugugcacaagaaaaugcaguacauacugaguguguuguagaagcucaaaaagauuauagaagcacagauacauauuuuaauuccaugccauggagucagaguagagagcauuuuaauuguuccuugaugaaguuaauagaaaggcaaagggaauugacuagcuuucauuagggaaaacucuuuaguaugacaguaggagacuguuacuuggaacuuguccaaagagagaaaaaaggagaugggaaaucuaagagcuauauuggaacaaauggaugagagaagggaugcugauuugggacaugacacccauacugaagcugucaguaucaguaccuccucuguuggucuacuacauguaugaucuguugaaaaccucgugagaagggaaauguuuauaggcuagaugcugugcagcuuccaucaccaucuugaaaguaaucccuccuuauuaucucccugguucauucauuuuaccuuuugcaguugguaagaauggaagcaucuucucaaaagauggugcaaaucucucuuuaggcuuauaaaauaauuucaauugccuauauuaaaaaguuaccagaaagaauuaggaagucaggagcuuuugaaaacuguauguuuuuucucccucaguccaaaaauaacccacaguuuugguuacauuucuuuuuuaugugugugcugguuaucuuauuuuaguuuucuguuaggagagcuugaggauuuuaauagcauuaaucuuuugcaauguaaauuuuauucuaauaaacagugaagcaaucuguuagccucuguaggggcuauaaaagaacaugaguuguggcuacugcucugcccucaggaagcuuaaguuguauuugagaagaugaaauuuuaagaaaaccuccggagguacaaauagguaauguguuuuuaucacgguagcagcuuuuuucuguguugccuucuuguuuuccuguguucagcuauauuaaacuaucauucacacugcaguuuuuagccccuuccccagcugugcacuacucugccucaauuuagguguauccuagacagugaagcucuucuugaagucacguaccuggcuaacacuuuguguucauuguaucuuuugugauguucucuguagcacuuaauuguuugcuuguuuuggcuauucagauucuuuuuugguuccauaugaauuuuagaaugauuuuuucuaauucugugaaaaaugguguugguaguuugauaggaauagcaccgaaucuguagauugcuuucagcaguauggccauuuuaacgauccugauucuuccaauccaugagcauggaauguuuuuccauuuguuuguaucaucugugauuucuuuuagcaguguacaacacuuaauuuuacuuucuaguaugcuugucuuucucccucauuuagacuguaaacuccuugaagacagagccuuggacauagaguuuacucagauaccuuugggacugguaagaacuuuggagaacaacaacagguguugggggacagugauaaguuuaauauuggugacugcauuugaaguacagcaagauacucagauagaaaugucuguuaacagaacauggccuggcacuugauuaaggugguagauguaggccauaauaugguaugaguugccaagaggccuguggauagaucccuggguaauacccucauuuaagaugugguaaagauuuuaaaaggggguaaaugugagcagaggaggauggguuagagaccugugagaauaaguaagugauacaauggacaggagggaacaguacugucaagugacacagaauuaagaggaggaugaggacugauaaaaagccugagaucauuaauagaugauggcuaauagaagcauuaauagaagauggcucuucauagagagccaucuuaguaguguguggacagaagaauggauucaguuugucagggucaaggugagagugggccauuaggaggaagcauugugaauagaucuuuuuaaaaagugggauaaaaggagggggagaaaaagaauagccugauggguuaucaaaauccaggagagacauguuuuuuguuuuuuuuguuuuuguuuguuuguuuuuuguggcagggagguggguggagaaaaauggucuuuuauguaguagaauguaucugaauauuggcuagucugaggaaaccaagagaaaggggauggaaguggugguagcuugcaguggcaaucaaggaagcaaggucuuggagcagacuugaggacccuggaaagagcuggaguaauuuaagaaggucuuggaauugaaagaggaacaugacaggaaguuagagauauguccguggaucauauaugacugagaaaaaauucugauggaacuaagaacucaguuuuuaaacuuuuaccaacauugcucagccagaugguaugucuauucagggguagcuaauuaaccagaugggugguaggaggauaaagagcaagugagacauaagagcaaaacuggagucgcugaccauugagaaguaagcauuuuuagggaggcaaguguugaucagaaaggaucuugacuaccuuugaacuugaaggucagaauguuuacacaagacucaguagaagugaagagaaauaaagugagauaaguuguucacuggagagcaaauuuugaaaauagaacaauuccaagggaugauaaguuuaccuuguggcccuccgcuugaauagcagguagagaauacagaucaaagucuuagaaugaaggucaagagugugugaaaccagagaguuugaaggaucaccaacauguugugauggagugggcuacaguucaacacaucccuguugcccauauucuuugcacuuuggugaguuaaccauaaauaaauucuugucugauauccucuuaaaauagaauuuaccuuauuuuccaaccagauuauuuaaauguuuugcagaagugaguauugauuuacugaacuguucuuuaauaaucacagcuggaaauugcaaaagaucaucaacuaugaaacuauauaaauagaacgagauaaagaaaugggaaagugccuucuucccuuaguucucuauucaguuggugaagaacuguaauaaaucuuauugaaaucuagaguuuuuaauuaagaaaacagaaagcucauguuaaauuuacagauaagaguuaugccucccucaauauugccaacuuuauuuuugugagcucuuuucagugacauaaugagcauccuguuuccuuaagcauguaaguguagguucuugugaauugacaggauagaagcucuuaagaacugaguaggccgacagagcagcuggugugacauucaaguguucauguugccuucuagcuccugaacagaaggaaaaacacaguuuuaauuuagaaaucucuucuuugacuauagcugaaaauuucaacaccagugagacuggaaaaugauagaacauuugguucucauauuuaacuggagauauaguauguucuuauauuugguaaacugcacaggauuauauaaaauuaacuuuauuuuuugagcuuuucaaaagcuuauuuuacuaggaaacuuacuguaaagaugaaagguuucuaaaaugccuaaauagaacaauagaauaggagaaaacaaaguaguuuauuuucugggagagcaaaagaaaguagguaccuaagauucucuguuaaacuuuuaaaaauuuaauuuuuuuagguguuuaaaguaauuuaacauauguucagaauguaucaauaugagucuccacauuuuuugaauaaaagaaauuauuugcaguguuuauguauauuuguguauuauaaggcuuaaauggaaaaauauuaguauacuugguacuaaaaaucaaaacacacaaaaaaaucaacucaaguaauauuuuuagaaaguagucugcuuucaguuauccaugcacaucaagaauagcauaauaggccgggugugguggcucacgccuguacucccagcacuuugggaggccgaggcgggcagaucacggagucaggagaucgagacuauccugaccaacauggugaaaccccaucucuacuaaaaauacaaaaauuagcuggauaugguggugcaugccuguaaucccagcugaggcaugagaaucgcuugaacccaggaggcggagguugcagugagcugagugcacugcacuccagccuggcaacagagcgagacacugucucaaaaaaaaaaaaaaagaauagcauaauaaagaaccauaaguaauuugcuuauauuuguuugaggaaacuuuuggaucaaggugacaauccagcaguuuguucccuagucaagguugaggcuacacuuucugucaguaguggcucuccagaccaguagcauuggcaucacuguuaucugagaaguuguuagacagucucaugaaguguucgaucaacugagugaggcucaggaaucuguguuuucacaggugauugaggugauucugaugcaugcugaaguuuaagaaccacuaaucuguaguguguuaacuuuuaaguuuguucugguuuugguaaauucagagggauuguuuuugguuuuguaaguauaaccuugcaaaauuagaccaaccucccaagagacagcuaucauaaauguuugggauaagaugauaccaacugacuugaccguagaccaaaaauuucuauaguucaagauaccuguguuugagaucauucacauuaaaauuuuaucauauacucugcuuaauuaaguacuuuguuggcaugaaugaauaaucuguacugaaaaugacagcuaucaaaagccaaaauaguuaucuaacagccccagggagggaggugagucaccuauucugcuuugggcuggcauauuucuuuauagacuaaagggugugggaaacaggagcugugcuugggccuuuaggauaagaaaaccugggugguuuuuucuuuuuuacacuuucacugagccagacuguuacauugugguuucaucauuuuaauugaauuguggaauucugaaauaugagagaaacaaaauaaauaggcccuguaaaugcacaugcaaauaaauuuuuauuauuaucaauaaacgaaucucguuuacucugacuaaaaacagaugaaagcaauuauaaaggcugcugugccauccagccccucccuacugacugcuuugacuucuucgaaaaaaaggacaguggaaagugaaaacaagcagcuagagaugacaguguagugagaauaagagucagacaucagagaaaugaaggcagaagaacauuucaauagggagugguuaacaguagcaaagguugcuaguagguuagauuagggcuaaauguguccauuagauuuaagaacaggaucaauggucaccuggaagaguaguuucaacgcagcauaaaagaggaagcuagauugucauggguugauuuaugagugggagauaguguagaaacagcaaauuuuggagcagauguuaguuagauguggaguuaaguguuuuuuuuaccaaaugguauuuacuggguaagauuguauucauuauuauuuagaccuugccaacuuuauuaccauguugauuuggcagauuuuuauuuagcauggguaacccuaacaaauuauuuuucaaauaaauguauuguuucuuucaggcuguaugaaauauuauaauucaguauuauuucuuugcauacccucaagaaucuaagacccugguuaaaaaacuuugccauguagcaggcguguaauuccuuuuaaaaucugaaauauccuuuaacuuauucuguugucuaaaaggauuuaaaggaaagcuauaauauaucuggcauaccaagaugguuugaaaacuccuugaaagcugugacuuucucuuaacucaucuaacaccuaacauauucuuuuaaacaguguuaggaaguuuuguuuagcucugcuauuuaaauugugguugcuuccauuguaaaaucuguuuuucaaauuuauuuuagcuuaugguucaagaguaccuacuauguuccagacagugcugggguuaaaaaugaauggcacagauucucccaugaguuacaguucacugggaaggacagagagguaaacaaaucauugcagcugugugauaaaggcuauaauagaagaacaaauuaaugccuuccuuauucuaaucuaguuguuucccacccugagagauuugcuaaaguguucaugccaaguuuauaacugacagcagcuguaacuugcccuuuaaaguacuguacuuagucucugccucuggaagagucuacuagauaaguaaguuacuuaggggaguaggacuaauuuuagucaacacagacacagggaugguauuuaggaauccuuugagacuaauaaaucaggcauuuuagauaaugcuuauuuucugcuuuaucagcucuauaaaacuaaaauccuuuggugaauuuacucuuguuuauauguuauucuuuacucaucuaauauaaauuacuuuucuaaacaagcaguauagguuuaaugaucuuuuaugugaguguguauguuuucuuuaagccccuuaagaagugaaaaaugugacuugaguaaauuuaaauuugagucauuccuugauuucuuuaaagcauuuuaaugaaauaauuugaauguaccaaaacuuuguagaauaaacucuuuaccauucuuaaucuuguaguaucuguuugauauguauaauaauagaccaucugcucuuuucacuaugagagugagauauuacaugcaagcacuuauauuuaaguuuacaguaaauuaucaugguugaaggacuucagauuuuuagggugugaaucggguaaaagguuauugucuuucugcagaaagugacuauguaagaagguugaaagaucauagucuuuuuggaagacugaguaauaauaaaacuccagucucguguuaaaaaaaaaaaaaaagaaagaaagaucauagucucucuugauaagauauggagaucaaagauggauaaagcaugguuuguugccuuuaaauaacuuuucaguguaaugggccauaaauuuaggcucaauuaugugguauacuauccaaaccuucuauaggacauuugcagugcuaaguuucagcuuguccacacugauugagaaucacugcugauaucuaagaggacugggugggguagggcuggauuuuuaaacucacgagguagcugucacugucaauaaaaugccaauagcaaccacagugagaaacagcuauguaggcuagcucucgcucuugguguaacuaugucugugugcaaaggaaguggaauugauuuuguguuacagaaaaaaacacacacaaagaaaaaaacacacaaugaaaauggagaucucuugaguucuuuuuugaaagcccguagucaaaaauuauuuuuuaguucuuuguuagucaaauggugcaucuaauggucagggugucaguaccaguuucgaaguacagugccaguuauuucccugaugguaguagccuccuuaaaacuuggauauuguuuauccugcgauuuaaauuucagcuauuuacucucauuuuuaaugauuuugugaguauuuaauacuugcuuuauuuuauaaguaucuuuauccauuuuggaaguagacaauuaugaguguuugguuuuaauggccauaaaaugaacuauuggauuugaucuccaacaucccuuuagcuguuaaauucuagaauucuuugcuuuguaaccaugauuuaacagaaaagucuuuuuaaaauaguguuuuauuuugauuuaguaacuuuuauaaaaaguaauacuugcuuaaucacuccaaaaaaucaguaauuacucugauuaagguaucauauuaguauauuuggguccggggaauaagcucuaauuguguacaguuaugucaaaguugauauuaauuuaugagaugguacacauugacuucuaaacaccaaagaacuaaaaauuugaaacuuaaaacuuuguauucucauuaaaugaaugaaaauaaagugucuuuaucuuuagaagauuuuuuuuuaaacccuaaaucaauaauuugugcucauauagaaccagucauggauuaagacccuuuguaaauacuaguuuuggauuuaaaaauuuucugagacauguauuaaaacuaaucaaaauuugacuuaacauuuaaauuauuucaguauaucaaaucauauacugauucucuuuuccucuuguuuuaaaaaucuuauuaaaccuuccauaucugaaaugguuugaggucuuccucaucuggggugggagaaggcuauucucugcagaauggaucugcaaauauucuuaaagaacaguaaaaauagcuaaaauguauuugucauuuacugugugucaagguaaguucaaaggguuuacauguauuuacacauuuaauaagauguguacuguuuuuguaucuuuauuuuacagaugagccuguuacauaauagguguguauguccaaggcaaaguaaaauagaucuguuaccucccuuuguuagauauuacguuccuggcccuacugccugagaacacacaugcuuugggagugagggaaggcacuuacaucagucaugcuaauuaacaccaaauuaaugcauuuuuuagcuuugaguaaacugaacuuuugucuuugcauauaugguguugcauuucuuauaugccauauuuguacaguuauguuuugggaauuaaauguaagaggccauacuucuauaccaauuaaauuuaaccucucauucccauuuguccagaucccaauucugucauguaacguauugccgauuuuuaccuagcuuugaguugcuuauagauuggguaaauacaacuucuaggucuucaaauuucuaacaaaaauuucgaaucauucaggaauuaggaacccaacagugcguuaagaaaacaccucuuucuagauugguccuuuucuaucuaauauauuuaguuguauuagcauauauuucugucuugccugcaaaaaucucaugcugauguacaauauuaauaaucauuuuuagcacuccaugucuuaccuguuaauuuacuuugcuauuuucuuauauuuauuuaguuuuucuaauaauugauuuuuuauuguugagucuggauaacuuuucucuucuuuuuuguuuuuuuuuguuuuuuuuuuuuuuugagucucgcuuuguccccaggcugcagugcaguggcgcgaucuccgcucacugcaagcucugccuccuggguucacaccauucuccugccucagccucccgaguagcugggacuacaggcgccugccaccagacccagcuaauuuuuuguauuuuuuaguagagacgggguuucaccguguuagccagaauggucuugaucuccugaccucgugauccgcccgccucggccucccaaagugcugggauuacaggcaugagccacugcgccugaccaagucugguuaacuuucacacaacguuuccuugcucuguaaaguaaccuuaugaaagaaggaauugaaauuguauuauuaaccaaccucuuuaugagcucuaguaacuacuaggauauaaucauccuuuugucuuuuucuaaggcccuacccauucacaguaaagauuauaugucaguaaaaauccaccuuauuguucuuuuugaauacuguaaccuuuuuugcccaccuccagucuuccgcuacgugugcuugugcguguguguguguguguguguguguguuuuguaauaccucaaagacuaccaacagugguuuguucagagacaacauuuauucugggauaaauuuuguaagccaggaggccuacaugugcuuucuuuaaaaucucccucuucuugggccucagcuugcacuuaacauuuuuucuuagacuuuucaaguagaagauaaaauucuauuagaaaacaaagagaagcaaaauagauguucugcuuucuguuguauaucagucccaaauagccugugucucaacuugauugucauguuguagcuaacaagugaaaagcaaaacuuuuuuauuguccuucguauuuuugucaaccagccaguuagaugaauggaagaguggguaaagaagaaaauaguaaaaggagcuaugggugaucuagaaauagacaacaaccugcugcauaauuuguaggugauugguaauucaaauagguccacuuugggaaaguggcucauuugcauuuggugcuuuugucugggcuuccuuuucuuuaaauuucuuuaaacagugagggaauugagcaugauuaauauucaugugcuuaucaaagcucuguggcuugcaaaguaauagaaaacucaaccccugaagggcauuuauugacagauuacggaaaagaucagugaugggacaaacuuuagucacugauugacccaggggcucaauugauguccaggauugacagccacaugcuaucucuaucucucucucucucucucucucucucucucucucucucucucucucucuccuguuugaauucucuguuugaauucugugaagagaaaagacagauuggcacauaggaauaaaaaaaaacaguuuuauuacugauaaaagcuggaauggaugacuugguuuuugugugacaacaacgcucuaguauugaacccagaacuaagcaauuauuuaccucuacuccaguaggcuuuuaaaccuuggggucugccccuaaaaauucaaaccagaauacaugaguccuccaguuaucuggcuccccaaagaaggcagaggugaagaagcuacauaugucuaguuucucuaggaaaaucuccuaucaggcaggucauuucacguccauggugauugaugggauagcaggccaggaguuguugaggaaaauuccucuuuguggaaaccagaggacggaugaacaaacaugcccucaacacacagacuuaucuuaauuauuuuauuuguuaaauaauaaucuauuuuaagguuagugugauguucaggccaacaaauucuggauauagaaaccuaaggagauuaucaaauaaccacccucuccaguuuuucaaguuggauuauuauuauaauugaugugugcguaggagggaacccacuuugccugggagaugaguaaaauugguaauaauuagacaagcauaaggauuugugaagugggaggaaggaggcaaugcaagaaaaugucuugcagaaucuguaacugucacaucuuugcaaguuuaaccuaaggcaagcaaacuuuucucacccagccauccucaacucacucauaugaauucuaaguuuuuagcccauucuccaguucagucauucucacaagugugcucccuagacugauagcaucagcaucaccccaaaaauuauuagaaaugcagauuauugagccccaccuuaaucugccugaaucuaaagaugcuugagguguggggcccagcaaucuaacugauucucugggugauucugauauaugcugaaguaugaggaccauacaccaugauguacagacaucuucauagcaguuucauagcugaagauuuauugcauuugccauucuaaucuuuucuaguucuaaucaucaaacauuuuaaaaauauuuuggagugcagguagauugcuugaggugggaagacguuaaaucuguaaaauggagccagacagucaugagcagcagugggacugcauuuucaucuuguagguuuagauuuaguggcaugaugccuauuucaaaaacuaaauguagcagcaaaaugcuuagggcauuguaugugugagacauuagaaugaggaagaaccaagggguuaaugauuauaauuugcauagaggaacuugaagaucaggaagaaaagggguuauauacagaagagacuuuucaaagguagaauuaacuuaguaacugacugaagccggaaaggauggaaucaaagaugauuuaagauuccuagccgaggugguaaggauaauggugguggcagagcuauuuaaugagugaaugagaugaguccauuguugggcauguuaacuuugaggugauuguauggagaggagagcuuaucuuuaggcagauuaguauaauaggaggacuugaaaguaugaugaagaaauaaauguaaugcauguauucauuccucaaacuuuuacugagugucuaccaugugucugguacaguucuagguucucaagauguaguaaugggcaaacucugcccucagaacuaauacuguagauggagggaaaaaaauaacauauaaacaaaugaacaagauaaauucagguaauaagaagacugggcaaggacaacaaaagaguagagaauuucuuuagauagggggucaaaggaagaccugaggugguaacaugugacaaaucauauagaguauaguuuuugccggccaaaagauuuuagagucacagaguggccaaugagaauuacaggaaauaauauuaaaggaucuguuaugcuuuuuguccuuucaggggcuauuccauaugaaagacuuggagagagagauccaaguauaauguuaaaaggaacuugggcuuggagacaguccaccucagacauuucagccauuuguuagcugggcagaaaacucacuuucuugaagucugcucuuaucacuagaagaagaaggaguaacaccucaugggauuaaauuguaaugauuaagugagagaaugaauuuaaaacaacuagcauagugcuuggaacaauaacaguaauacugaguggaucauaaaauucagucaugugaagugcaguuuuauuuaauaauguaaucuaaugucuucugauguacaguuuuauuuaaaaguuguacuuugaucuuuuaucaugcaaagcacuuuaaaagcacaagacuggaguucaaaaauauuuauauuauuaaauuaucuacuuuagcuaccuggugacauuuagaaaauaugcuuacaugcauaauacucuuaagauagauuuuauuaacuuuuaaauauuuucuucuuacagauguguauaucucaugauugauauggagaaacuagucaugggccaaaggucaagauacuucucugggaaauguugcugcugaugcugcuuuacaaagucauacaaugaguguuugguuuaagaaagauuuucauacuuaaaagauuuucaucuuggaaauacaucaagugaaaauuaaauucuuuugggaaacauuuuccuucugauauauuauacuuguaaugggcgacauggcaaacaacucaguugcuuacaguggugugaaaaacucuuugaaggaagcuaaucaugauggagacuuuggaauuacgcucgcagagcugcgggcucucauggagcucagguccacagaugcauuacgaaaaauacaggaaagcuauggagaugucuauggaauuugcaccaaauugaaaacaucucccaaugaaggugaguuuuauuaugcuuguuuuugguucuuugugcaaagaguucuauauauuuggcuuauaaaugagcaugcuuauauuaucuuggcgauuguaugauuaugacauaauuauagugacauuaaaaauggguuaguuaucagauuaauacaguuaaaguauuuuuauauuaacacauaaauguugcaaauuaauuuauauguuuuagauuggcgggaugaaauauuuuguuccauuauauauacuacugcuuccuguuuaugauaaaaagauugucuucccuuugagcuauagaggauggaaccaggcuuggaugccucccagggauuugguggaaauaaacucucagaucacuauccuucauuuugcuggguggcuuaaaauaguugucacucucaguaguugauugaguugguuuuagcauaugaggcuuaaccuaaccuuuaauaauuagcucaggaguuccuaaagcaaaugaaauagaagagauggaaguuaguuuuucaccuaacagacauuuccuuuaaugaaacuaguuuuuagucuuugaauuauguugaauauuccuguguucacagaagccuuugguuucauaaauuuguauuuguggcagguuuuccuuuugagaaucaaaaaggagaauucauuauaacuuucuggcauuauggucuuugaaaugauuucagaagauugccuuucauaaauuaaucagauuaaacauaaaauaaagguuaggacauuccaggaaagcauuuccaaauuguaaaggcagggaugggaagggacacauaugaggaugaauggggauuacaauuuauuuuauuaaggaugagaaauuauuaauguaaaauuuuaaaguauauuaguauauauuccaaagcuaauucuagagaaauuaagcaaaaguauuuuucuuaauauuuuuccugaaacauuuuaugccaugcuauugcuuagauaauauauaauguaauagcaaaaagucuuuuccaaaauuaaauaacuuuaaauuauauuuaaaaauucuuuaaaaccuuuguaaccuauguaauucauugugaauuguuaauuauuuuaaugauagguaguuacuuugauuucucugaaguagcaugaucuugaggaagccagagucaguauucacacaugucccaacagggcuucuuuagacuauuuggaauauauucuuugccugcaagaccuguuaacucuucaagguuuucuguaucuuuucaaauuggaaccacuagaaacaccagcuucuuaguuauaccuuagauaugcuacaccauuuugauguaguuggguuugauuacuacaagauugaucccaacuauuaauacauuaaaaugguauugcauaucuaagguauaacuaagaguaucaggaacaguucccauggacuugaauagacaguaauuugacaaaauugguugcauacuuaagguauaacuaagaguaucgggaacaguucccauggacuuuaauagacaguaauuugacaaaauuugaagcuuguucauuaugcaaaccgacuuugagauguuauauagcaucuuagagauuuguacauuaguaugcuauucucagcugguagaucuauuaauucagcuuaaucauuaaaaaaucucauuguuuuaucaucaucaaauugauaggggacacuaacauuaaggagcccucaauauaacaacauaguuuguucauaaaagcaauauugaacuuuaguuucaaaucuucacucaacuguacuuccccuaaccagguccuugcauuucucuauuaaucaaaguucuugucuucugauaacugaauaccccaccauuugagaaugagaauggcuucucauuuuuauagacaugauuucucaugaguuugcacuacaguuucuuucacgguauuauuuggagcggugccuuuuaaauuggcuuaauuagugaaguuaaguuaacugaaaauuuuaccucuaguacagugguuuuuaaaauuugagaaggggauaguuauguacccuuuugacaguauguuggaagcuauggauaaucucuagaaauauccacuuagcacucaaaauucuaugugaggccgggcgcgguggcucacgccuguaaucccagcacuuugggaggccgaggcggguggaucaugaggucaggagaucgagaccauccuggcuaacaaggugaaaccccgucucuacuaaaaauacaaaaaaauuagccgggcgcgguggcgggcgccuguagucccagcuacucgggaggcugaggcaggagaauagcgugaacccgggaagcggagcuugcagugagccgagauugcgccacugcaguccgcaguccggccugggcgacagagcgagacuccgucucaaaaaaaaaaaaaaaaaaaaaaaagaaaaaaauucuaugugaauuguugcugcuuugggcuauuagauaaauucaugcauuauccccucucuaauucguagacaguuuuugcucauguucuuccuaguauugugaauuuaauauuuacuaaaauuuguauaaacuuguccucacuguuuauauauacacaauuuguuuuuuugaaauauuuuaaaaagaaugugaagcaagccauuuuaagcauuauacuuauauuuacaguugaaaauacaaaugaaaacagcagugcaguggcucgcaccuguaaucccaacacuuugaaaggccaaggcgggagguuuucuugaaccuaggaguuuaggaccagccuaggcaauauagcaaaaccccaucucugcaaauaaaaagauuaaccacugugguggcacaugcaucucugcuauucaggaggcugaggcaggagaaucacuugaguccaggaguuugaggcugcagugagcuaugauugcaccacugcaccucagccuggguaacagagggagacccugucucaaaaauaaaaaaaacacagcagcagccuucacaagaauguuauuuccaaaggaauauucauaguuuuaguuuaacuuaguggaaauaauucacucggaagcauuuugucacugaucaagcauacaaaugguaauaaaugaaacaugaccaggaguaagcaauuaggaguuuguacguccaaggaaaugaacuagacagcaaguacucuuucguuagaauacccuguuuauagucagggaaagugagaauuaaacugauucuucaaaguacaugaauuucaguuagguaaaacugaaguugucuuaccugucccuuuaguucauucauuuauugauucauucauugacauauacuuucuucagacaugggauauugauuguccuguguuuuauauacuuccucuaaaaaaggugguggggccuggcaguuacugggaaggcaguuguugguguauaauuaaaucaucacaauuuuagagacuuuauguaagaauaugugcaucuuagaauugcugaaauuuuguaguauuuauuaguaucugccacgcaguaggcauuuuucuaggcccuggguauacagccaugaauaaaacaaauaucucugccuaauuuucacauguucacauggggagacaguucacaagacaacuaguaguguguuggcgauacauguuuaaaaaaaaugaguggagaagggaaaucagaaauauugggggugucgauauuggauuucugucaaguauggaggagcaacccaagacauuucuuaagcaaaaccacaaaaaugauaggcuauccuuaugauggguaacacuuuuugugccauauuggcuauuagcacuugaaaauauuaaaauaaguuaauauuuuaacaaguuuauccuauuuuacagccaaagaacccucaggacaaaaaaguuaagcaguuuacccagagucucacucuggcuccagucuuauucuggcuucagagaccaugcuuuaaccacugcauuguauguuaccuguuacaaaaguucaguucacauagcuuguaaaagaguugcacuaugaagaaagagguagcuguguucccucuucucuauaguaauuuuugauaggggaaaaaauuuuuggaauuacauggugaaaaaaauuuugguuuaagguucugcuuaucaauuuguucuuuauuuaaaaaacauacccuggccagguaugguggcucacaccuguaauccuagcauuuugggaggcugaggugggaggaucguuugaacccaggaauuugagaccagccugggcaacauuaaaaaagaaaaaaaugagccaggagugguggcacaugccugugguuccagcuacucaggaggcugaggugggaggaucgcuugagugugggaggaucgcuugagugugggaggaucgccugagucaaggcuggcagugauccaugugugaucccacaaaagagugagacccugucucaagaacaaaaagagugcccuauucaagaaauuguauuuaugugauuccuguuugucuugcccauuuaucacuuguuuucuaacaauauguuuugaagaauaucauaugcauacuggucaauaggaaguguuuugaccagauauaauuuucauauuaaaaacuucccagugguucugauuaaccauccuaacuccuaaagaaauuggaacuguaaauuucaaagugaacuggaauugaggcuuguaacuucauauuuuuggcuccguuagagaaagcaucugucuuacaguccucagaauccaagaaugcacuuuuauaccaaaauaaccugcuuauaacauccuaacugcauaaaauuaccuucacaguuuuuuuuucuucuguaucuuuguuguuuuccugcauugacuuucuuauucauauucugaaucacauuccuugauccuuauauuuuuacacuagcuuuugguauaucuuucaucucauugugguccuauguuauauuuuauacuggaugguaggguuucugguauacaggccuccagcccuaggaucauguuuguuauucagaguucuacauuaaaaaaggaauucauuuuuauaaaugaauucauaaaaauuaaaggcaggugccaagugguauucuguaagaggcauggcuucauggacuuguaaagggcaagaaagcaaaugagacacuaagcuuuuaaguggugguugcugaaauuagguccaggaguuucuccugagcuuuagguuugaaagcccaaaacacacaaaacccacaguguuuaacugguugcuugucagucucccccaccaaacuaugagcucuuugagggcaagugguagggaaaggcauccugagucauuucccuuuguaugucuagugcacagugacguaguaggcauuugggaaagaauguguaaguuugacuuuagaacagugucucuuaaauuugcaguuagggacgggauugccuccucuuuugaaauugagaaaaucaugagaauauuagauuguuucccaagaagaauaaacauaaacauaaauuuuuauguacuuucuuggucugcacauuuuccggugucccucacuuagaaaagucaguuuggcugcugcuauagguccaccaugauacagacuguguuacuccguuugcgcacugcuauaaagaaauaccugaggcaggguaauuuauaaagaaaagagguuuaauuggccucaugguucugcaaggcuguacaggaagcauggcaucagcaucugcuuggcuucuggugaguccucagggagauuuuacucauggcagaagguaaaguggaagcaggcacaucauauggugagagagggagcaagagaaacaagggggaggucccagacucuuuuaaacagccagaucucaugugaacuaacugagcaagaacucacuuaucaccaaggggauggugcuaaacuguccaugagaaaucuucccccaugaucuaaucaccucccacuagaccccaccuccaacauuuggaaucacauuucagcaugaaauuuggagggaacagacauccaaaccauauuauuccaccccugcccccaccaaaucucgugucuuucucacauuucaaaauacaaucaugcuuucucaacagugucccaaaguuuuaacuaauaccaguauuaauucaaaaguucaaaguccaaaaucucaucuggagaugaguuccuuccauuuaugagccugugagaucaaaaacaagcuauuuacuccaagaugcaguugugguacaggcauugguuuuaccuucccauuucaaaagggaaaaaucagccaaaagaaaggagugguagaccacacaagucugaaacccaacaggacagucauuagaguuccaaaacaaucuucuuugacugcauauucugcaucuagggcacacugauacaaagggcgaugucccaagaccuugggcagcuccgccucuguggcuuuauaagguaggugcagccccuguggcuacucuuagguuguaguugagugauugaggcuuucuaggcuuaggaugcaaacugccaguggcucuacuguucuaggaucuagaaaacaauggcccccuucccacagcuccacuaagcagugcccuaguggggggacuuugugggugcuccaacccuacaauuccccuuggcacugcccuaguggaguuucacuaugggggcucugccccuaggcgggcuucucuuguggcaccaagccuuucugauauuuccuuugaaaucuaggggaaaacugccaagccuccuccacacuugaauucugaguaucugcaaauuuaauaccacauaggaacuaccaaggcuuacggcuugcacccuccagagcuguggcccaagcuguuccugggccccuuugagcagaggcuggagccagagcagccaggaugcagggagcagucuccugaagcugagcaggacagcugcacccugggccuagcccuugaaagcauucuuuccgccuaggcugcugggccugugaugggaggggcuaucccaaagaucucugaaaugccuucgaggccuuuuucucauugccuuaucuauuagcacucagcucucuuuuagucaugcuaaucucucuagaaagugauugcaccacagcccacuuguuuuccuucucuaccacagguccaggcugcacauuuuccagacuuuacccucugcuuugcuuuuaauuauaaguuccaacuucaggucauuccuuugcuccugcuaauaguaggcuguugaaucagccaugccuguucuugaauguuuugcugcugagaaccgucuugugcuagauacccuaggucauuacucuuaaguucaaacuuccacagaucccucaggcauggacacaauacagccaaguucuuugcuaaggccuaacaagggugacccuuguuccaguucccaguaaguuucucauuuccaucugagaacuugucagcuuggacuucaguguuuauaucucuaucagcauuuuggucagaaccguuuaaccagucuuuaagaaguuuccagacuuucccucauuucccugucuucuucuaagcccuccaaacucuuccagccucugccuguuacccagcuacaaagccgcuuccacuuuuuaagguaucuuuauagcagugccccacaccucaguaccaauuuucuguguguguucauuuuuguguuguuauaaagaaauacuugagacuggguaauuuauaaagaaaagagauuuaaugggcucacaauucugcgggcuauacagguagcauggcacuggcaucugccuggcuucuagggaugucucagagugcuuuuacucauggcagaaggugaagcaggagcaggcacguuacaugaugagagugagagugagagaaggaggaguucccagacucuuaaccagaucuggcaugaacuacugagcaagaacucucuuauuaccaaggggaugaugcugaaccauucaugaaggauucgcccccaugauccaauuaccccacuagaccccaccuccaacauuuguaaucacauuucaacgugagauuuggaagggauaaacauccuuacuauaucacagacauacauacauguacauguaauauaaacacauacagacacacauauacauaugauauauacacaaauacaaaauuucuaguacagaauuugauaagacuguaguaugugcuguguguuagcugugauugucgguuaaaucuacauccaacauuccaguaaauuccccccacuuuauuccuaaauugggacauaauuuuauuagugccugcaauugggaugcuacauuuucuuguaaaauauuaaggucuuaauauaagugacauuuuauuucauuguauguucuuuucaaauauaaagacaguacuucugagcuguuaucuacucauagaucaaauauagacuuuuauuucuccaaacaaugauggagucagaccccaaaagcauguaauucugaggcuacuuuugauguguuuugguuauauuuucucuuugugaaguuaacugggccauaagaagaucaauuccaugcaugaccuuggccucauugccacuacacuacaauuaacugagccaauuaggcagaagaguucucauuauauuuucuuauaaguuauuccuaguaauuugauaucauuauuuauauuuuuaaaacuaggaccaguaauuucuuugccaguuccaccagcuuagcuauaucucauacuuuacuuucucccuccuuacaguagaagccuccuccugcaucuguauuagacaaacauugcagcccugaauugcauggccucuggccccuucgaaggcuuaccugugguauuacccuucaucuccuguaucaucaguguugucuucuccacuugaucauugucauuaagucacuugucuuaaugucugucaccuacuuuuaaaaaaaaaaaugcaaauaaaacccauuugaacucaucuucacugauuuauuucugcccacuggaucacacucuuggaaaaaguuagcuaugcuuacuguugccacuugcucauucccacuguccguucagcucuuuucuaaucagacuuucuuccacaccguugcacuggaauauuccuuacaaggucaucagccucuaucuagugaaagaaaguguuccauucucuggucugucacucauccuuuuaacaucauuugucauggucagccacaucaccuuuuuaaaaccucuuuucgucucugggcuucugugguacuaccugaacauguuuuguuuuguuccccacuccccugccuuccuugccucccucacuggcuguuucuucuuaggugccuugggcuccucuugcccuauuugaacaucaguguugggugcuccaacgcuguagccucagccuagcucccuucuugucuacuuuaacuuucugagagcucucauugggcuuguggcuccagaaucaucuguauauugaugacucuggcucagacuucuccuugaguucucaauauggauagccagcugucuacuagacaccuacacuuguuuuguuuaaaucuaugaaacagaaccauuaacuccucccuccccuuuccuccuaauucuucaauucucaaaauugccugucuuggaauaugacuaccauccacccacuuaagugcuugaagaccccucccccucgcaaaaaaaaacaaaaacaaaaacauucuuucccuuucauccuacauccaguccuuaaguacguugucugaucuccuuccaaaauaccuggcaaauccacuuauccccuucugccuccacuucuaaaacccaaauacaagcaccaucaucuauacuuuauaagcagcaaccucccaacuggucuuuuuccuucaaucuugcucucuucaauuuccuucagauagcaauuuaugugauuuuucuaaaaugcagguuaguuaccacuacucugcuuuaauuguuuucauugcacuuuaaggugagaaugccauucuccucucccuagcccccauguucuuaccuuuggccacuuuuuccauuuugacccucucuucuuuccuccagggucacuggguuuuacuacaguggcuuugcuucuggcuaguaaaucuucuaaucuuguuuugaucucugggccuuuguauuugcuuuugcugcugggaauguucugcucgaaagucuucucacccuugaccccuggaaguucagacagaagccaaauguuagcuccuuagaaaggcuaauguagcccacuaagagaguucuauuggcccuuuuuuauugucuucauuguacuugucuguaguuauuuuaauugucuacugucuaccuccaggauaguauaaacuuauugaauguucuuguucacacugacuccucagcauguagaacagucccuagaaguaguaaauauucaguaaauauguauugggaaacagacuauuguuacaaaacuguucguuuuauuauauuuagauuguguaaguuuauuaauagaaauuaauuguccccaaaauugaauuaauaacuauaguguucagucaguuuauaauuuguguuccacuuauuuaacuuaagaguugcccuguuuaugauuuaugaacuguguauaccuucucuuuugguucuucaaaacaaccuuguaaguuuggccaacugauauuagugcccucccuugacccccaaagaguuaagugacuugcacaagauuucaguaggugaaccggaaccuaggucuucuacuuccuauaccagauaguuuuauugguauaguguccuaggugugugcuuuuguguguguuaguaguuuagaggaauuauaauagcauuuaagaccuuuacuucccauauacucuccaagauacguuuuaaagcuaucuuuagcucuguggcuguucuuuucagugguaacauaaaauauuggucccuguuauaaccaauauguuaagauuuggccaauuauuuuuuaguggugauaauuaucagguguuacagguaugucauauauaugcaauuaaugguagucuuuauacagugugaguuaggcucauauaaccacuaucuccauuuuuuuuucuuuuugcugguaagagcauucaaacacaagacaagacaaaccuacgcauagacuaaucucauccuuauuacugcaguccauugcugccuugcuuucuauugacucugucuuaaagauuagagcucuuuggaagcuuucaacugauaagucuuuuuuuuuucuuuuuuuuuuucaacugagaaaucuaaaauacuuuccguauugcccaguauggacccuguuauaguugcaagugagaucauuuucugaaaucuuugaaucuuguugaauccuucaaugaaguaaauaauuacuuuaaagcuauauguucauuucucauuauuuauucuaauguauuuauauucccucuucuacucuuugccugccugagcagugagauuaauaguuaaagcacuuaaagcugagagccuuaacaguaaucuacuguuuuccugucuuccuccuuugauguucucuuggaauaggcucuugccaaaaaaacaaauugaaguuagguuuaauaugagaagucaaaaaugauguuauccugguuaucucugccuucuucucuagcauucuuuuucuuucuuucuuucuuuuuuuucggaaacagagucuugcucuaucccccaggcuggaguucaguggugugaucguggcucacugcaaccucagccuccuggguucaagugauucucaugccucagccuccugaguagcugggauuacaggaacccaccaccauacccgguuaauuuuuguguuucuaguagaaaugagauuuuaccauguugggcaggcuggucuugaacucccgaccucaggugaucugccugccucggccucccaaccucaggugaucugccugccuuggccucccaaaguguugggauuauaggcaugagccacugugccuggcuucucuagcauucuuaaacagacaaggaaaaauaucauuugucacugcugucuguacuguuacauucccacaauaauguacauguguacacacuuugcauuaacuaauugggauauaucuggguuugacaggaucaacaagguuaaagacuuacuugguagggugaaggaauggcaaaauggauguucauccaacuagcucugucuuaaccuccucauaucuuucuaauuccauacuccagacgauaaauguuacauccuacaguauaccuccuacaguauaccuuuuaccuuaagugacaauagguacauucaauagcaccaccuauuacuucuaagaaagaucauccuaaguuuccuguuauaucaaucgaaguauaacagagacauuuuaguagagaagcuuuuagaguuugugauagauuaacuuuucacuguuacucagcaaaugagaguaaaaaaucagacuuucacaguuguccagggugcaauaacuaaaccaaaucuguaucuauaucuauauaacugaaccaaauauauauauauguguauauguguguguauauauacauauauauacguauauacauauauacacauauacacacauauauacauauauacauacauauacauauauacauacauacauauauacauauacacguguauauacauauauacguguauauacguauauauauacguauguauauauguguguguguguguguguguguguguauguaucuuuauauauaaacuucccaguuuugugggggcaauauccucaggucagggaaauguuuaacuccaauaugaaaaccaucagacugucacaacaguucugauugcuaacaucuacaagaugguauaggauaguacgaucagaaauaagcaguucuggccaggcaugguggcucacauuuguaaucccagcacuuugggaggcugaggcaggugcaucaccuuaggucaggaguucaagaccagccugaccaacauggugaaacccugucacuacuaaagauacaaaaauuagccgggugugguggcaugcaccuauagucccagcuacucgagaaggugagguaggagaaucacuugaaccugggaggcagagguugcagugagccgagauugugccacugcacgccagccugggugacagagcaagacucugucucaaaaaaacaagcaaaauaaaaaacaaaaaacaaaacuaagcaguugggaaagugaaaauucuuagugcaguccuaacugaucuacuuaaaguguucuuuuaaagaccugcacauguuuuucagugauuuaaauucuguacacuuaaagcaugaaaguaaacauuuugguagggucuagagugaugaguugagguauuuugaauaaaacuauauauuuucauuuguaagaaguaaaacuguucacugaaauuuguuucuuuuuauuagguuuaaguggaaacccugcagauuuagaaagaagagaagcaguguuuggaaagaauuuuauaccuccuaaaaagccaaaaaccuuucuucaauuaguaugggaagcauuacaagaugucacuuuaauuauauuagaaauugcagccauaguaucauugggccuuucuuuuuaucagccuccagaaggggauaaugcacguaaguaaauggggggaaaaaagacaugucugaugcuaguucagcuaauucauuuaguuaaugcacaauaauaauagcuggccagcauuuauugauguuugcuaugugcuaggcacuguucuaaguaccuuaaauauauuaucucagauaacuuucacaguaacccuaugaauuagauuguguuaccucccuuuuacaaugaggcacagagguuaaauaaccuauccauauaugcuuacuaugugucuggcacagaccuaugccauguauaugacauggucuuugcuaucacaguuuuuaaguuuuuuuagaacacuauacugugaaacaauuucaguuuuuaguuuuugguuucuuuuggaaaaugucauuaugaaagcaaaauucuguucucuucccaaauucauuacuugucaaguucuuaaaguguuuugcuauguacaccauuuggauaauuuccuugccauuauggaaaauguccuugccauuauacuauagguugaacaucccuaauaugaaaauccgaaauacuuugaaauucaaaauuuuugagugccgacaugaugccacaaguggaaaaauuccacacauaaguacuuaccacaaauuuugucucauauacaagauuauuuuuuaaauauuguauaaaauuacuuuuaggcuauguguauaagguguauaugaaacauaaauugauguuuggacuugggucccauccccaagauaucugauuuuauauauaugcacauauucccaaaucugaaaaaauuaaaacauuuuuggccccaagcauuucagaaaagggauacucaaccuguacagaguauccuaaccaauagagaaauacauuauagcgugguagauuugcuuuaacuuguggcuacaaauguuuuuuucuccuaucuuucccuuucucuuuuaaauuucuuuaucugccuuuuaaaaaauuuguuuaaaauuaauaguucugcugguagauucuguaacugguaggaaaucuagcaugcauuuugguuacuauauuuaaguagcuguaauauaaaacaaaccaguaguauuuuauguaucaaaaggcugauucaccaaaauauuuuugugaaagcuucauuccuauacccuuucgaguugugaagagauacuugcuaacucuaaaaguuggguaagguaauuauguuagucuguuugcauugcuguauaagaauaccugagacuggcuaacuuauaagaaaagguucugcaggcuguacaggaaacguggugccagcaucugcuucuggugagggccucagaaagcuuauagucauggcagaaggcgaagcaggagcaggcagaacacauggagagagagggagcaagagguggccuugaggggccaggauuuuucaaggaccugcucuugugugaaguagucaccauggggagggcaccaagccauucaugaggguuccacccccaugauccaaacaccuccccuuaggcccugcuuucaacacuagggaucauauuucagcaugagauuuggaggggaaaaacauccaaacucuaucaauaauuauguaauuauuuauaagauguaccuaggcucacguaagacuguauucuuucucuuuaaagaaauuuggacacagcauaaaucaguuuuucugagauugguauagauuaagguuucuuagaagcagcacgacugacauauugagcggcaaaauuauuugucacaauauucauucugcaccccacccccagugaggcaaccaaaaacgucuccagauuuugcugugugucccauagggggcaaaguugccucugguugaaaaucacuauagauaaggagaggcuuagacaauauucuugucacuguugagcuaaauuauuuuuuaaacuuuuauuuauuuuugcuaaauaaguaguaccuauuuuacuguuuaaaaaaaauaaugggggugggggaagacaguccaaaggaaauaauauucacuggaaaucccauuucuuagagauuccugcuauacccuuuuauguauauauccuuuaagauuuuaaauauguauccguggucuaugugucuaugagcacuaauauauguaaagguaugauggugcauagauacauguguuuaucugaaaaggggagucauaucaucuucagcaacauacagcugaauuuuugucaguuuuccaccugucuagcugucacuaucaaauauuggguauugguuuucuagaauugaguuagcagauuaauaaaagcuuuuuacuuugaacauuuuaguuuucuuagaaaacaaaagaaaaaauacuuucaagaaguggaguuuauuaccagcaagguccaggacaaaucuuuuuggaauucaaacugcuuccuuuguaagauguagugacagguccuuuccuaaauuuguuaaaggagauacagguauuaaaauccaacugagaagauaaucuagagcugucgguguucuaaggcccuuuuaaaagagucagaguucacuagaaguucuuaaugaaacauauaaagauuuuuuugcuccauggugaaaaguuauuuaguauuugcauuuuuuauuuuuuauuuuuauuauauauauaaaauaaaauauguauauugagacagauauauauauaaaauauauagagagagacuauauauauauugagacagagucucacugugucgcccaggcuggagugcaguggcacuaucucggcucacugcaaccuccaucuccaagguucaagcgauucugcugccucagccuccugaguagcugggacuauaggcaugugccaccaugccuggcuaauuuuuguauuuuuaguagacacgggguuucaccauguuggccaggcuggucucaaaccccugaccucagguuaucugcccgccucggccucccaaagugcucagauuacaggcaugagccaccgugcccagccuugcauuuuuuaaaaucauuauuaguacacuacauguaucuuuuugucucguuacaucucaacacugaggugugguaacuugcuuaaaaggaaucuauuuguaaaucuacagucauagaaaucuaaaugaucaaaaugucuuccuaauauuacuugaugugaaaauauaugcuauagcccaaaccauaaauaaaucuauaguuacugguaucugcacuuaacaggaguucucaaacuuuuuggucucgagaccucuuuaaacucuucaaguauugaggacuccaaagagcuuuugauuaugugaauuauuccuauaaauauuuaguauauucuaaauaaaaauggaaaaauuuuugaauauuaauguguucucaccacaaaaguaacuauaugaggugauggauauauuaacugauuguggcaaucuuuucacagcauauacauauaucaaaauauuuugcuguauauccuaacuauaugcaguuuuaucaaucauacugcaguaaagcuggacaaaauauuuaucagugcauuuuuaaauaauaaucuauuguauauucacauagauagcauuuugaugaaaaauguucccucaauaaugaauuuuuaaaugaaauaauguaaagaguggugucauaucucuuuaaugcccagcuuuauugaagauagcucgguucuccugucugcuucuguauuuauuaugucacauuaucacaugcaguguaaucuuuggaaaauuauguuacacauuaaugaaauaugagaccaauaauuaugucuucaaauuaugaaaauaggaaucccucucagguuucacgacagcacuuugagaacuacuucucuguacuguuaauguacaaacuugguacaucacccaaugaauagcucaacuaggagguuuuaaaauggaauauuugccuugugguagagaguauugacugaauuuagauugugcaugucucucaguugaauauauuuacaagagaauaccuuugauaauacagguuuuuauuauuauauuugagcuuggacuuuacugaaaacauuguuaaaauucuuuauauauuuauacauauauauaacuguaagcuguagucauuuuguaacuuugauccuuuuuccccuauaacuucucuaaaaauuuguaaucauugucaguaggaaaggauuuauauuuuguacuauuucaagauuauuuuggucuuaucuguaugauguagaguagaacuauauaugaaaugauauaugucauuaauuugcuucaaguucucuuuugaaauauucaguaguuuagugauggauauccaugucagauucagagcugaaaauuguauaauuguccguaauucuuuccccuccuuaaccucuguuguguuggucuuuaaacuuuuuugguuauuuacucuaucaggaaaaaaaugagcacauaccuccaaaugaugcauuuauuaauuauauuuauaacuauauaauuuguauauuuucagcauauagaaaaaauagaaauugaaaguaaaagauaaagcugggcacaguggcucaugccuguaaucccagcacuuugggaggcugaggugggaggauugcuugaggccaggaguucgaggccaaucugggcaauguggcgagaucccaucucuacagaaaauuuuaaaaugagcugggcgugguggcaugcgccuuguggucuaagcuacuugggaggcugagguaggaagauugcuugagcaugcagugagccacauuggcaccacugcacuccagccugagcaacaaagugagacucugucucaaaaaagaaaaaauuaaaauuuaauguuugcuuucuucuuguagccauaaaacauuauuguuaaccugauuuaggucuaaguuuaauuucagaaguuggcuuuaaugucucgcagcuaaaagaaacacaacauuauauaaauccaagugggaaaaguguaguuacuaaaucauacucauuuucaugauaccuacccaccaguuaugcaaagguauuuguuaaaauaugacugguaaauuccauugucugaugucaaucuguuguuuuuauaugcuguuauaaaguauugcauuuuuuguguaauaaaugacaucaaaacccaguaaaaugcuucacuuggauaauauguuagcuguguuuccaaguuggugaaaguggucagcaugguguucuaucaucugauucugaguccagaguugcucuaauucagaguuaaucuccugucuucuggcuagagggaggaauggagcggggagagucauucuuacagccuugacuguuaaacagaauguaaaucauaaaaucacuuuaacugguuauuauacacaaugacacauggugauuucuugagcuugaaaauaauuaaaauagaaauucugguauuuguguuggaggggguucuguuggauuauccugcuuguaccucacaguugaauccugcuggugguucucaggauauuuuuuguaacuguucacgucaagucuuccauuucauccccaauugauuuuacuucauucccugucuucccucccagauugcuuuuuagucagcacccucacaccucagauuuuuucuucagucuguacucaccaugcuagaacacgcuuuagucauuucuagugucauuuauuuacucauucuuuucuucugaauaauccuccugcuuugucuguuugagagaaccaauggcuuucagacauuucaauucaauuuaaaaagaaauaacuucacauagcaacccagaagccuguauuccuucaugcgaauuuauaaguaaucagcguuucaggaaauaauacuuauccuuacuacauacauauccuuucuauuuuguuuuguuccauuuuucagaaugcuggucaugagccacugaauugauuuuggacucacaacuagauuacagcccgaagucaaaaagcacuguucuguuauucuucaccauuauugacuauagaguuuuggcucauucucuccccccuccccaccucccaccccacauccuuuucugaucucuauucugccauuuguacugauuuuaaucucucccuggauuuuuuuuuucuuagauggcugguucucuaccaauauuugguagcucaaaugucaugcauaccucaauggggccuucucugcucacugaaccucaguuaucccucuuuuuucauuuaauagcacaucacuauguuuuucuucauggcacuugucgauaugugaaauuaauuauuuguguauuauuaucugaauucuucauauaccguccccagucugaguauggauuccaugaggagagagagcuugugugucuuacucacuacuguauuucuagccccuaaaauagugucuggcaccuagccugugcucaaaugguuggaauaacaaguagcaguuugcuuaacuuuucauguuauaaaagccaaguuuuaaucacauuucaguaaaaaugacauaguaaauaagcaugauucauggguuucacguaauacuaacuucucauguauaucuugucuaucauauguaauaauuaauaugguuagcucuugguugagugcgaagaaagccuuagccacugcuguaccuacuuuaccaguauccucacauuuaauccucacaauaacucuggaauagcuggugguaucauaauuugacgaugaagaaaccaagucucaaaaauuaaguaacuugccuuaggacugauauuucaucuccuucaguguccuuacucuuaacuaguacccuaccuagacugccucccucuacugagauuaagaauuacagaagcagggaacuugaaagugacauagaguucuuauggaauacuuugaauuuaauaaaguauuuauugcuauaaguaaaauugauaaacauaauuaacacaaaaauaugauuuagacguacuauauguauguugucaucaauucagaaucuuuuugauaagcauuuucuuucuuuccaaauaguuuguggagaaguuucuguuggggaggaagaaggugaaggugaaacugguuggauugaaggagcugcaauccucuugucuguagugugugugguguuaguaacagcuuucaaugacuggaguaaggaaaaacaguuuagagguuugcagagccgaauugaacaagaacagaaguucacugucaucagggguggucaggucauucagauaccuguagcugacauuacuguuggagauauugcucaagugaaauaugguaaguaaguaaaaagagcaguacaucugacacuaaacauaaaauuacuguaaucuuguuuauaaguuuaguauaucaugcuuuuuauuuuaggugaucuucuuccagcugacggcauacuuauucaaggcaacgaucuuaaaauugaugaaagcucauugacuggugaaucagaucauguuaaaaagucuuuagauaaggaucccuuacuucuaucagguaaaaauuucauuuauaucuuugaacacuuuccucuuucgcaacuauguaccauugucagcaaacaccauuuuccuaagagucaauaauauaaagaggaaucuguauuuuaugcuaccuucuacuguuguaauccuugcagacuuuuuuugguaagcugacaaaaacauuagaaaacuuugaaugcagagcuauauuuuacaaaugagggaccagaguccaaaaaaucaagagauuugagauucagcauucaugcuaguguaaugauaaaacugaaauauaggccuaaugauaucucuugaguuggucuguuauucuguaucaugacuauuuuuaaugccuauugaaguauaaaauuaaagaaugaauauauguuuaaagcaaauuaaugaauucucugugaugcucuacaaaggacagguuguuuuuucuuaagaacugguaaaauccuuaaaguuuaccuaauccaacuccuuuaacugcugaagaaugaguuugagauauaaacuauuuaguauuauaugauuaaccaagaguaggucuagcagucacaccuccaucuagucagaauugaauuugcaaaugguuaagauauguucugggauuggagaagggaaggauaggugaggauacuguuugaaauggagggugacagcuugggaggcucuuguaguaaccucauugugauagcuugaacuaaguugaacuaaguaaauaugaaauggaagggguggugggaaaaauuacaaguucgcuuccaaaacacugaaugagagaaagcuauaguaucacaaauugacccccaagucauauuaauuauucuaacuuuuagguucugggguuccuauucuuauuuucccaguauucuauauggaauuuaugaaauugucuaucagaacuguacuugucagauugaauuuauacuagaguuuugggaaagccaaauguagccuucuacauguagucuucugucauugucagguguugauagauugccaacauuuuauacauugucagaugauugcugcugaaaccagagucaaaccugugauauccacaagggucaguuaaguuagaaucacaacuuuagagcaaaaccuaaguuuaaccauaacuuuuuaagauuuauaaaugcaugccaaaagaagcuuauugcaaagaaccagacacauuuauauuggccagaaaauccuauugcaaaaaaaucagaguaauuacauuuauaaacaccauuauaaauaggauaaaaguuccaauucuaauauagacuuaacguuucaucaaaaaaaaaaaaaaaucuugagauguguauaccuucaguauccugugccacuuagaacauuaggagauauacguaaugcuaaaugacgaguuaaugggugcagcacaccaacauggcacauguauacauauguaacaaaccuacacauugugcacauguacccuaaaacuuaaaauauaauaauaauaaaauuuaaaaaaaagaaaaaagaacauucacacccuguuuggauuuuucuuuguauuggugugguugucauuuauaccaaauagccagaaagagcuuggauauauaaauauaauguauuuaaguauaauguguuaacucauucuacuuaccuugccaugcuucuaaggaacuguaguuaauguuaaccaaauaaaaucuauaaccuuuccaaaggagagggaagcuaucuaaucauaccuuaccaucacagauuaaccagaccacaauguguaacaaacuaagauagucuccuguuugcuauguauacugcauggacuuuuauguacaucucacuuauuuacauagugcuuagcucuucagguugauuuccuuuaacugaacuuugguccuuucuguuuuaacagagaugacugguaagcuuuauguagacucagguuccuaacacaccaaguauaccaggagaacucuauaaauuuuccacauuuaagaaaagacugaaauaacuuuguagagucccuuaucgcaguaugggugggaaaguuuuucugcauuuauuucccuauuccaaaaauguacuaaaaaacaugacaugcauuuauuuuuaaauuuacucucaugaugccaucucugacugcuguucuuggcuucuuaaguuuagauuuuuaaaagcaguauucaguuagugguggggauaugaccaagacuuaaaacuguuuacuuugccugagcacauucacugccaacaucugauuaccugugguaaggcaaaauagaaccuaaacaauuggagucuggagaaaaccagaauuguuaaaagaaauaaauuaucuacuuuuucacuaucuugaauuauauuucuuguuuucccugcacuuucacuggcaaagaagcuaauaacuagugaaauaaucaauauggauuuuuaaaagcaaggaagcaaaggccuaaaaaacaauauuggauaaguuacucaguaauuaauagccaaauauggauucuuaaauacuugaguaaguacauauauuuuaugagcguacuuagcaaauaauccuugagcaucaacuugguucauaagauuaugguagaugcuauguucacugugcuccagaagauuguaaacaaggaaauaaaauacaaaucaaugauaacguguaaaaaaaaaaaaguugcuuuaaagccugcuuaaaacuaacaaaaagauuagacggauuagaagccuuuuagugaauaagaaaagauauagagauguggauguacaagucggagaaccguaagcagacuuaucagcauuauaacugaagaagaauauacucuuuauccucugacagagcuggacugaaucuuugccuugacauuuaauaguuguauaaccuucaggccgagcacggugacucgcaccuguaauuccagcacuuugggggcuaagacgggagacaauuauggagaccagccugggcaacacauacucugucucuacaaaaaaaaaaaaaaaguuguauaaccuugggcaaguuucuagaaaaugagaauaguaaugccugccaacuuccaaaauuguuuugcgggacauagaauuuaauccauguucccaucucugauuccuaguuuucuguaaugaaauuuuauguuagaguaguggaugaguaaguuuguaagauugggucggucucaaggugaggacuuuggacucaauccaguaggcaacgaagaaucagaaauuuuugagccaugagaaguauaugaugaaaucacaauuuuaggaagauuaaaauggauuucaggaugaacugggaagacacagagacuagguagggggcuauugcaguuacaaaggcgugcuggaaugaaagcuuguguuagguagagguuaugagguugggugugggaaaugugacauugguugucauugauacauacguuguuucuuuauaagcaguguuuuucucagagaagugucccucauaccuuagguuacaauuaaugagcauucauugaaccccuacaaauucuaggcaguaugcuaagcacuuuacauuuauagguuuauaugagaaauguaaaucucauauuucuaugaaguguacagacagggaacugaguuguuaaaauuuaccuaauauuacaugguaagugaguaguagauugagcuuugaacuuggauaugacugauuagaguuaaaaccuuaagcacaagaaauaaguuuuauuuaaugucuuacuaaauguauuuuauugaucaagacaugguggcucacaucuguaaucccagcacuuuggguggccaagacaggaggauugcuugagcccaggaguuugagaccagccugagcaauauagugagacccugucucuacaaaauuuuuuuaaaaaaauuagcagaguguaguggcguguaucuguggucccagcuacucgggaggguuacuucagcccaggagauccaggcuguaguaagccauguucacaccauugcacuccagccugggugacagaccaagacccugacuuaaaaauauauauauauauuuauauauuuauauuuauauauauuuuuuccuaaauguugaggcuguuaaaaacaauauuacugaaguuugaaauuuggugguagcaaggagaucuaucaguauuuuuaaaaacaaacuauguuuuugguuauagguacucauguaauggaaggcucuggaagaaugguaguuacagcuguagguguaaauucucaaacuggaauuaucuuuaccuuacuuggagcuggaggugaagaggaagagaagaaagaugagaagaaaaaggaaaagaaaaguaagaauaacaauuuucuauaauugguauuuggaaauagggcaaauaauuuguaagaacuaguaccuucuuucaagagauucugguaugaaaaauucuacaaaaaguuaaaagaagauuuuucuauuagacuuaauagcaugggccuuuagagaauacaucaguccccuuuaccauggccagagaaauucagcaucuacuugaauacuuccauuggcauucuugcauuuauucucuagguguagaaucucccaucaucugaucagcaaaaugaauugaacucucacggcggauuuuuucugcuacuuuagcaguggcuuucuuuaucagccauauuauauuuugguuucacugagcuuucuuuuaaucuucuucacauuucuauucuacuauacuuaaugugcuugguuuuugaacacaagacuaggacuucacuuugacaccuuacauuucucuuguuauauucagcccaucauuagauaucaaaaucuuuuuaaaauguugauccauuguaucuacugucccuccaaguguucuguuaucagaaaacuugauaaucauacauaccauuuaucugcaaggaucuuacaagaaacuguuauacacaagagacaucucagaaucuccuaguuaggggcaugccacuuuuaaaaagcccuccccacccugcuucuaagugucugcuauaccacccuuccuucacacucaggauuaccccucuggagucuuuucccuuuagguugacaacauuuuacggugguuuagccacuuagauuuauuugauguuauuuaggauaguaaacccauauuguuguuucucacaugaauauuuugaaacauucuaaaauaacugccuggcuaaaauccugguuugcuauaacuacagcaguguuuuuaauauuugagugguuuguuuuguucuuugaguuuugcuguuagcuauaaaaucucuauuucgaaacaaaaauguaugugaaaaauucuggacgcagauccagguggcaagccccccauucuagguuuuuuuucuauguccuccuugaagcaguucucaaugugcuuccauacguuucuuaaggcugaguagaacgcaguuugaaaaccagcacaguaaugauuccauuuauugaauguuuuacaugcacuaucucauuaauccucacaacuguacaaaguaaagacuuauuauuuuuuuacugauaaguaaacugaggcuuacggagauuauauaauuugcucuagaucaaagugcuaguaagugacaggucacacccucuucucuggcucaagagucuacccuuuuaugcugugcuccauccuaauccacaagaguugaaagucauugaacgcugaagggaaguuugcauccucacuguauuccacagugucuuuuccaguaagcuucuuuucccccugagucuuauacacugguuuuauuaaucuagucuagaacauuccccagaaauuaacaucuaauuuguugacucccuuuuuuuguuguuguuguuuuuuuuuuaaagaacagggcaacauuuuuucuucugugggccuccagcccuucucccauucccuugacugccuuagcgauuacucagaagcaguccgggguaaugugucucaguucccucaguggccuggacuguggccgucuggucucuccaaacuugagcucauuaaaaguagcuagguauuaucuuacuaucuccucaucaaucuugagcuucuauuccuucuugaccauguuuguuccauguuuuccguuugaagauaguucuccucgauaaagaagcuagaagaauauaggaugaaugguucuccugcucuuuggcauuuuuaauauuguagugccuacuccagacaauaggccugucccuucauuacuuuauugcuucagauaugcucaucuuucuguguuuuccaaauauaagcugauuuggagagcugccuuaccugguagucuuacuggcuuauucuauacauucguauucuaguuuuacuaaguuaccucuccuaucuuuuguacauauuuuguccucacucucaucaacacucuccugugugccaguugucuuuuuuuuuuuuuuuuuuuuuuuuuuuuuuuuugagacggagucucacucuaucccccaggcuggagugcaauggcgugaucuuggcucacugcaaccuccgccuuccggguucaagcaacucucccgccucaaccuccugacuagcugggacuacaggugcaugccaccacacccggcuaauuuuuuauuuuuaguagagacaggguuucaccauguuggccaggcuggucuugaacucccgaccucagaugauccacccaccuuggccucccaaaaugcugggauuacaggcaugagccaccacacccgacugcccguugucguuuuauaacaucccuuccuccucccucucuaccccugcucuuccuccucccucuccaccucugcccuuuucugcuuucuugggguuauauuuguauuuaguuuuaaaacuuuuuguaucauauuuagguuuauuacagcuuauaaaauaaugaaguccuauggaaaaauaaaacaaauauagacacccuaaauuauuuugcgguauucucccguagguaagacuuagggagugauugacccagcaggucaucacaagucaaauguuuucuaaucuguagacacacacaccauuguguaacaacuguuauagaaaugugaacuacuucugcauaauuuagcauggcuguauucauuucuuuuggaaagcuuuaauucccauuuuguuccuacagauaagaaacaagauggagcuauugagaaucgcaacaaagguaaauuuaggaggacaaaaguacagugagcuuguuuucauuauauccaaaaaucuacuguauaccauauuuauucaaaaguaagauacauguggcagggaaaaucaacaauauacguuagcuuggguuaaccuuucuuccugccggugucuuagucaugucgucacugcaauguuaauaagauuuuaaguaugauuugugguacagguugaguaucccuuauccgaaaugcuugggaccagaaguguuucagauuucagauuuuuuuuuuuuuuuuuuuuggauuuuggaauauuugcauguacauaaugagauaucuuggggaagagacccaacuccaaacacgaaauuuauuuauacauugccauauacaccuucuacacauugccugaugguaauuuuguacaauauuuuuaauaauuuugugcaugaaacaguuuugacuauuccgcaucacaggagaucagguguggaauuuuccacuugugucaugucagugcucaaaaaguuucagauuuugagguauuuuagauuuucggauuaggguaaauuuauguagauugacucaacuuaaguauuucaaguauuugaacgcugguuauuauauaguuaguagcaaaaaugcauaagaaacaaaauauauagcauaaauguuacugcauuuauuuaagagucauauaugcauauuucuauaugcauaugguuauacauaaucucuacauuauggucauaaauuauaggggagggauuauguuguuuagauguuaccuaacauaacacacaggaaaagaaauuuaguauucuuuaguucucaguuuaaggacccuguaugccucauccucauuaccuagcacaacauuuucaaauaugguacaaaguuucacaaccuaacgucacuauugucuuauuuucucuguguagacacacacacacacucacaaagcugaaugcuuauaccuuuacugguuucuguaagaaacugauuuuuaaaauuucuuuaaaauguuaauagugauaugugccuuuaaaguauagugaaguucuauuugcucuuaaauguagcaaaagcccaggauggugcagccauggaaaugcagccauugaagagugaagaagguggagauggugaugaaaaagauaaaaagaaagcaaauuugccaaaaaaggaaaaaucuguuuuacaagggaaacuuacaaaacuggcuguucagauuggcaaagcagguaugauauagagaagaaaauaaaguguuuuauuuuuaaguaugcuuucugcuuaaaaauugucuuuugacacacuuaaggcuggaaauuguugcuuugugaauagaaggggaguuugaaauauuuucaguucuagcuacaaugcaccaggcccuuugaguuacuauagguacuuauaauuugcuaauaaguggucggguuaggauuagugccuaagucuguccaguuacaagccugugcacucaucucugaauuucugcauuaaguggagaaaaggcaaccugugagguuauuuaguaaagaugaacuaauuauauuuuaauaaaauuucaucacacauuuugcucaucuuuuuacugguuaugggaauuuuuaguuaugucucuaauguuaaaguucugcacugaauggagucguuguagugcggcugaaguuucuauauuacugccaucacuagaaaauaccuguuaauacagccauucuuuaagggaaaaagcagagcucugagguuagaaacagcaugaccuccagcgguagcaucuuuuuggaagaacacuguguggauaaauaagcauauauuauuaaaauugcuuaaauugcaucauuuuacugcucucuaggaguaugauggaaaaagugacguuuuugcuucuguccucaguacacuuauuaucuaauagcaaauauuugcucuuuguaauauguagccaagugguaaugcugacucauguaguguugggggaaaagguggauuugaggugguaaauccacuuaguagacauuagauugggauguuagaaccagauauguggacuuacaccuuuuuuuuucuuuuuuucuuuucuuuucuuuuuuuuuuuuuuuuuuuugagacagggucucacucugucagccaggcuggaauacaguggcaugaucacagcucacugaacccuccacaucccaaggcucagguuauccuccugccuccacccccgaaguagcugggacuacagaugcacgccacuacacccggcugauuuuuguauuuuuaguagagacgggguuucaccguguuggccaggcuggucucaaaugccuaggcucaagugauccucccaccuuagcuucccaaagugcugggauuacaggcgugagccacugcgcccagcugccucuauuuuugggggcgggggguguugagggugggagacagagucuugcucugucacccaggcuggagugcaguggugcgaucucggcucacugcaaccucugccuccuggguucaggcgauucuccugccucagccugaguagcugguauuacaggcacgcaccaccaugcccagcuaauuuuuguauuuuugguagagaugggguuucaccauguuuggcuggucucgaauuccugaccucaggugauccacccaccucgacuucccaaagugcuggggauuacaggcgugagccacugcgcccagccagcugcccuauuuuuuaauacauaugucaaagagcagaguaucccacaagauacaugguuaacucuugguuuacuaaguuaaugaaacaguaaggauagagcaaaaaaauugaagaaauaauacuuuguguuauauaauuuuauuuauuauaauguuauuuuuuuaaaacauggguugaguauuuaauucgaggucuccccauugaugagauuuuuaccaguuucucuuuaagcaucagggagcuugccucuugaacauauaaagcaccaguuuauucuaagcuuuggauacuuccuuaucauugcguauuauuuugucuuaguuucaguacaaggccaaagauauaauuaagucuaagaaagaauccuaaguguuuuucucccaguucuccuggggacaagacuguacuuggaagcaaaaaauuaaaucugacaaugucaaguuauaaggugcaagaaagaaguaauuucucagagaaauucaauacuaucaagcaaguuauaacucuuuacaguguuuaauuuauaucuggcaaggguuagugucuggaaauuuaauaaucacauuuuucuuucauuucuauucugaaaggucuguugaugucugccaucacaguuaucauucuaguauuauauuuugucauugacaccuucuggguucagaaaagaccauggcuugcugagugcacaccaauuuauauacaauacuuugugaaguucuucauuauuggaguuacaguuuuaguggucgcagugccagaaggucuuccacuugcagucacgaucucacuggcuuauucagucaaaguaaguagaaaauaguucaguagacguuguuauguuuaaagccuuagcugguauagaaaaugcccaucuaguuacuccuuuucugcuucugaaagugaggacuuucauauaaauguacacuauuuucucuagaaauguugucauugaugcccuguaccucccaccaguugaauaucucugaaggagaccugugcauuccacauagggcagccuugacacaauacuaagcacgacucugcugggcaaaguucuagcauaauuuucucuacgugauaguuauauugucaagucaugucaccuccucuuucccgucuguaaaauuaaggugagcguguuaggcuaauguuucuaaaaauuaaaaaaaaaguuaaaaauuaugauuuccauguguaaaaccuuucagucaguucucaugacaauuagaguaaaaugcaaacuccuuaccauggccugcagggcccugccagucuggccuuugcuuaccucucagugcucaauucccuucuccuuuggcccagucucaccagccuuccugaugauuuucaaacaucucaacuguauucuuacuucagagcccacuuguuccuuccuuugaguaaccugcucucuuucuuuauucaggucucuucaaaugucaccuuccucugaccacuugauuuacaguagcucaguccuucuuguuuuccaaguagaaugcuaagaaaugagcuuugauggcuuugcuuacugcuguuuaccuuaaaguaauaauccuuuugaagauuauuaauuuauuuuuaucaauuuucuaucuuacggaaaagguggauuggaaauaaaaaaaaaaaagauguagcuuggacaauuuugaacuuuuuuuuuuucaaaaugaucuugcagguaaaaaauuauaaccaaacaaagaaugcugcuuuuguaaauuuucaaauguuaauuacuaguucucuuuaagaaacacugcugacagugagcaauauuaauuaauuagucaucguuucuaccuuugcacucuucauuauuagaccugucuugauaagaauuuuuuuugcuuacuguuugaguuuauuuucuuuucaggcauuuaacaacuuucauuucaaaaauaaaguaaauguaucaaagugauaagauacaguauaaucaucuaucuguccuuuuuugauauuuuaaaguaauuugaaauauuugggguaaauacaaguuuuggacacauagaacagucauuuuaccgaacugccauuaguucauuuugaguagucauuaaugauacuaauuuuucaauugauuagaaagauacugguaggauugacuuaugcuuuuugaauagaaaauuaauaagaacaaguuaacuacuuuuuuaagccuuuauuagauguuuaucuagcucuguuaccaauuacuguucuuuucacagagguauagucuuuauggauucucuguuaguguuucacaaaacugaacaugguuucuuuacugcagaacuucauuuuucuaaucuuuaauauguaaaucacaaguaauuuaggaaauacacauccguuuuucacauauuuuuucaaggaaccaguuuuuuugcaguaucuugcaaauuagucaucacaaaaaacacuuuguaaaauaacuccauauaguuuuuaacccauuccacauuaagugcugagaacuaauuauaagguauuuuaacuuaaaugcccugugagacuacugugaaaacuguugguuuuuuagaaaugauuuuuucuguuguaaaugagagaaagaagugagaugcaguuugaugcuaaggaugaaaaugccaagucugccagcauauagaauagcuaaaaaaugacucauucuaguuuugauauguuaacucuaucagaguuaauaauaaaaaaaaaucaagcaacuacauacccacaagcucuuuauuuuagcugcuaaaggcuauuuuuuccuuggcacugauguaagaaucuuuuguuuuccacuuaauaaggaggcuuaauccuuuaauauacucuuacacuacuauaaguaccacuguacuuaacaguacagauugucauugcucuugcaaugugaggacauuuugcaaaaaccguuggagacauauauucaguauuauuuguguacggauguagguaccugaauugauucacuagguuauguuaugcagcaauaaaaugauugaaaccccagaaagcucugguacuguguuuagcuuauuuuaauaggucaaauaugcuaaaaaaaaaaaaauuucaguauuacauugguacuuuauacauuguauuuauagaaagcugggaguuuucuaauuuuaaaacaauuuauaaucauuuuaauguaaugaggugauugguuuuauaugcagcuuaacuaguuuuuuuuuuuuggucacuguagaaaaugaugaaagauaauaacuuaguaaggcaucuggaugcuugugaaaccaugggaaaugcuacagcuauuuguucagauaaaacaggaacuuugacaaugaacagaaugacagucguucaagcuuacauaaaugaaaaacauuauaaaaagguuccugaaccagaagcuauuccaccaaauauuuuguccuaucuuguaacaggaauuucugugaauugugcuuauacaucaaaaauauugguaagguuuuugaaauaauuuaugaaaauuaauuuuuaaaucuauaaugaucagacuauauguaagucuucagaccaccauuacuguauguaaacugaacuguuaaguuuuuaaaaggcauauauuuauuuauauaaugguuuuuaaauuuguguuaugagugaggucugcugaucaacauaaacauuguuugcuuacauuuuucuccuauauuuugaauuuccuguguucagaaacucuccagccuuauaaccagagcauguauuuaauuuuaaauucuuguuaagcucauuuuugagaaagaucaaacugucuuacuauaggaggucagcucucaacuuacagaaaauuuuuaagccgauuucaacuuaaaauaacauguuuuauauaugguugccauguguucuguuugguuucucaguaguuccuaccuaaaaggugguccuuagaccuuuuuagaacuaaugcaguaaaguaauucuagacuugugccaccauauaauaaaaaauuuucaacuuacaaguuuuaaaaaucuuauuuauaacagaaagaaugcgauguuauguuugacuuaaucucuucuagugauuuauggaugaaaaucauuaacaaaaauaauauugcaagcuguucauuagggaaaacauacaugaauuggaugauuacauuggaaaguuaugggaucuugguucuagaucuagcuuugccuuuuacuagcugaaagucugagcuaccuucuuuaauuacugaguaaagaugaucacaucugcccuuaauaccauugugauaauuauguaaagugguauuucugaaggcacuaugaaggaauugaagcuucucacugcauuuaagagaacaguauuuuaaugaauguacuuuuaagccauaaaaauugguagauuuaauuuugaaugauuuaguauaaaaguuaagugaaaacaggaaaaggaaauuaaaauuaaguuccacucuguauuaggaaccaacuauaaacuucauacaucuuauaucacuuaauuuuggggucauaagugcuccuauuuuacagaugcugaagccaaggaccaaagcaguuggguaauugucaaauuucacguagcuaguaacuggcaggacugagauuagaauccaugucauucucaccccaggcuccuuucuaccuuacuuuucuauauccuucuuuaaaauguugauauuagacaauugcuuuguaauuuuauuuuagaauaucgcagucuguuuuacauuauaaauuaaacguucuuagagaaacgagauacuagcuacuaaauguuuuucucuuauagccaccagagaaagaggguggauuaccucgucacguugguaauaaaacugaaugugccuuguugggacuucuuuuggauuuaaaacgggauuaucaggauguuagaaaugaaauaccagaagaagcacuguacaaagucuacaccuucaauucuguuaggaaguccaugaguacuguccugaaaaauucagauggaaguuaucgaauauucagcaagggugcaucugagauaauucugaaaaaguaagaguaaaaugcuuggaugaauaaauugcugacuauaguugcuuuauggaguaucuacuguguuguuauuguuguugucuuuuugugaacaucaggcauuugauaggaccucagaguuuuuuagcauauuuuaugguauccagauauuugccccugcuauucugccauuuucacacucuagcuucucuuauuucuuagcauuuuguuauagggaaaauaagcucauuacauucaaucugguauguuuaaugaaguauacuuugauguuuauuuuuagaagucgauuuacuuguuauuuaauaugcagaaucuugaaaagccuccugggaagaaaaucaaguuuaugucuuucuuucuuucuuuuuuuuuuuuuuuuuauuuguuuaagguggaguuucccuguaucacccaggcuggagugcaguggcgcgaucucagcucacuucacccuccgccccuggguucaagggauucuccugccucagccucccaaguaacugggauuacaggcaccugccaccacgccuggcuaauuuuuguauuuuuaguagagucaggguuucaccauguuggccaggcuggucuugaacuccugaccucaaguaaucugccugugucggccucccaaagugcugggauuacagacgugagucacugcaccuggccucaaguuuagaucuucaacgcucauugugguuacuggacucugaaugugauaagagaauuaugaaguaauuuuuagaauagcaaagcauaaaagcuggaucuuggaaauuccccauuuauaucaaaaugagauuuaucauguuuaugcugcugcagugucguauuuaaauaucuccugucauuuugaauacuaauuuuucuuacuguccuuuuacagaucaguagcuuuaauuuuguuauuacauguucacauauaauuucccugauguuuauuuguuauuaaagguggugaaauuauuuuaguuucuuuaauuucauuaaagaaguagagaacugguuaaaaaaaaauacugguuaagagcaaguugggaaaauuggaacucauuugaaauuauaauauuuaaaauauuaaaguaaauguuuaagauauacuuuuaauuugcuuacauguggauuauaagccaguauuaaugaacacuuuacaauuaguuuaagagacaaauauauaaauaaauaacugaaggcagcauauaauaaauugguacaaaguuuuugggugagagaucacacuguagggauguggcauuuaagauagauuuugguaugaaaugagaacuucgagguggggaaaccacagcagaggaaaggagaugagaauaugcaggucauacuggggaggggaauaucugguuguauaguucagcugaauagugaugggcuuuuguggcacacaggccauauacagcuuucuucuugccacaguacacucaguuaccugauuucauugaaaagguuagaaaucuguuucaacccuggcuugcuggguaguagauagaugguuuaggagagaauuuuuuuuagucaaaacugaucaggcauugacucuuucucugcaacuaacuagcuucuggauauggggcagauuuuucccuuacuuccauuuuucucaucugagaaagcgggugaugaccaccaacucuguggcacuuaaaugaaguaaugcauaccaacugucuagugugaagccugguggacaguaaacauacagcaaguguucccacaguaauauuugcauuuuguuguggagacuuuuuaaauguugggcugagcaguuaaaauugaaguaagccagauaaugcaaaugagguauuuuuuucuucaaguaguagaaucaucaaagcugugauuaaagauaauucuugcaucagggaacaagguggguuagagggaaaaaaaaaaucaacuagagacauaucaguuaaaaggcuauugcuauuacaauagcuguagcuuuguagcuugaaguaagaaccagaagaaaguaguagcaggagaaauaaaaaggaguggacacauugaggaggcuguucagaggagaaauguauaggacuuaggagcuaauaguagagagaugaucaggaaaaauaaguauuaaggugaaauuuuagacuuacaucaaaaugauuaggguaauguugaugcacauuacaugggcagugaagaggcagcuuccagucuuucauccauuaagguuuagguacugauaaaacaucuggguagaauuuuucagcagugauggaaagcuuugaaaaacaaaacagaagauguggauuugggaauuaccucccuagaagcaggaagagauggcaucaucaagggagaggaguauagagaggcauuaugaaaaacaaacuuuaaauagguauauaguaugauuuuuauucauuauguaaugaaagaaaagguaguagugucacugaaaauaacuuuuggcauuaacucucauucugauagaaugcuuauuuuaacaauaaguuauuuuuuuucuuucaugguuaaaacaauauaggugaugaaacaacaucucagguaagggguugacuacgcuuggcuuuuuaccuuaaaagaagaaaacauuugugauuuugguauuauuucaaacuaaugucugauucuguaccaaaauggugaaguauauaguuuauucuccuuugccacccagggauucuuuaugaaaguuugaaagcacugcauuuccaaaagacaagguuuagagaaguucuagaguaauugauaaauggagaacugucaaaugagaaccauacauauuaguucuguuuuguaaaagggagggugaaaagugaauuuaagucuauaaaaaugaauuauauguaauucucuaaauuccagauaucagaucccaugauuucuaggccugccaguucacuuaaauggcauuaaccauuauuuuuuuaaauuauugauguuuggauucaacauuuccuuuuagguguuucaaaaucuugagugcuaauggugaggcaaaaguauucagaccaagggaccgugaugauauuguaaaaacugugauugaaccgauggcaucagaaggcuugagaaccauaugucuugcauucagagauuuuccagcaggagaaccagaaccagagugggauaaugaaaaugauauugucaccggccuuacaugcauugcuguuguggggauugaagauccugugagaccugagguggugaaacauucuguguucugcaugugcagaaucucauaacuauagaggaccuaggccuuaauuguaaccaguuuucuaguaaaauucuugguguuugugauuuuuuuuuuuucugugugaacccaagauaaaugaaauaauaguaccuacagugcauaugcuagcuuuuaugguuuuuaaagacagugucucuuugggauccuauguguucauagcaccauaaccuagcacagugccuugaaguggguagaauuuucaguuauuauuuaucuuaaauuaaauaauaggugccauuauuuguuuucacagucucuagacuagcauugucuaguagagcuuucugugauaauaggaauguucuguauauuguuuaguacaguagccacuagccaugugugaauacugacuucuaguuuucaguggcuagugcaacuaaaagacaggauuuuuaaauuuuauuuaauucaaauuaaaauaucuugcuaguaguugucauauuggauggcaugcagcucuagacugauuucccucuuuaauuuuuuuuugcuauuugguuuuucaccuuuuuuaaguuuguugaacaacuacugugugccaggcacuauccuaagguacuagagacuuaagaguuuugagaucugaucaccggccucaaagaaguuacugucuuaugugggacgaaccaaacacgugauuauugcaacccaagauauuacuaccuugcuggguauauacagagcauguuauaugagcagagaacacgaguucccaaccuagccuaauagcaucuuuuuauugaguucucacugugugccauauacuuaagccauguguuuuacaaguaauuuuuuuaaaugucuaccuuuaugagguaugcauauuauuacucuuauuuggcagauuuuuaagaaucaaaaauguauagagcguuagacauguuuaaaaauacauuuuuaaaaaaucgagaauguauagagcauagaccuaguguguuaaaauaccagcuuugucuaaaacacaugugcuuaaaagacuacuguacuguauugaccacuggaggggucagguaagacuuccuagagguuaauuaccugaucugauucuuaaagaaggaggaaguauuaucuaaaccaagaaagagagcgagcaguuagguauauucugagcaaagaagcaacauaaauaaaagcacuaacagaaaaccacuuuuguucagugacuuuaucagcuaauugauucaaaaccuaauguguagcacucuuuuaggagcuggaaauacugcagugaccagaauaggcuugagauuuauauucuagaggaagaagacagcuaaguagguagaaugauagauacauggacaccaugucaagugaaaaaugaauucugggaggaauaagacuuggucccuguucucauaggccuuaagauauucuggguggcaggguggcauaucaggggggaugauauuaaauaagacaauuacaagugcagaagggcuauauaagauaugcacgguguaaugaaauaaaguaauggagagagacugcauuaagaauuucugaggauguggcauuugaguugcaaucugaugguucauagugggucugccauguaaauagcugcaagaagagcauuccaagcaaaacgagaaaugcaagugaaagugagaaaaguagcuauuuuaaagguggaaaagaggccaguguggcuauaaauguaaagaagaaaggggagacgagaugaucucuggccuuacugggcugugaggacucugaauuuucugaaauucaggcugggaagugacaugauuuauguuguuaaaauacuauuuuggguacguguaagacagggauuagagaugaagaagaguagaagcagggaagcuaaugagauuauugcagugaucccaggcaagagaugaucauggcuuggcccacaguuguggcauaggagauggaaagaaaagaaugauuucaaaguaaguggagauagaaccaguaggaaguaauauguuggguuuggauacgcuguuuuugacauuguugaggugucugagacauccaaauguaugucaagcauuuggaccucagagccugaaagugggcuagucugaagaaaucacugaugaaacuaaagauauuuagagaaaguguguagcuagggaagaaggcuuuuaugacuaagagguugccacaauuagaagucuuauaaaggagauggucgcuaaccaucucuguacaaguuagagaaccagucuguaacuugguggcugauagaggguuaccaauguaauaagagaaccagaaacagcagccuguugagagauuaagauaaauuugguuugggguuuuguaauuucaaaugcuuauaaaauagccagguggguaauguuugccauguggucacaggagaaucauucaaagguuguuuuuuuauuuugucuuguuuuuguuuucuuuaaggaaggagucuuccuauguugcccaggcuggaguacaguggcuuuucacaggcaggagaucauggugcacugcagccucaaacuccuggccucaagcagccucccaccucagccuccugaauagcuguaauuacaggcaugcaccacugugccuggcuuuucaaaguucuauacauugacuuacgguuuaaacuuuaacaugaaaucaggguaucugcaacuuucauucuuuggaagacaucagucuauuaucaugcucuuggcauugcaguugauggagaguuuuaucuuuuuuaaagcauguaaauggcacuuguuuuucaguaucacaaaaugagauggguauuuauauacuaaauugagacgauguaauaugaaacaguuuucucugaguuuauuuuguacagugcaauucugguggagggauucuugaauaauuagaugucuagaacaaauccaguuuuuauuacauauguauaaguacuuggccuugcuuuaguuucuuauauguaaaaguagagauaguuuguaaguuuuaagcugaaagcaucuggugacuaguaggcaguuaauaaauguuagugugccuuucuuauguauuauuugccacauaguuuuaaccugagaccaauuucucccuuuuacucauuguuucccuguccagaugauccugggauacuaccuaaucaaggacugcuuagauacaaaaauuuaagauagauuuuaucucaaaugagauaacaggagauauauacauuuauaaaacagacaaguguuuuuagugucaaauauugauuuuuuugaaaaaauaaucuaagcaggcccuguccuuuugcucaucacucuggcacuaggaccuaagcacagugccuggcauucaguaaauauuaguuugaguaaaugcacgugaugucccccuccaaugauuugaaucacuaagaguugacuggguagagggaaauaacuuuuaugauguaaaucuuaaaacuuauagauaaauauguauuuaaauugcaauuaauuacauugcauacauguuuuaaaacaugguacccugggccgggcaugguggcucacaccuauaaucccauuacuuugggaggcugaggcagacggaucgccugagcucaggaguucaagaccagucugggcaacauggugaaaccccaucucuaccaaaaauacaaaaaauuagcugugcaugguggcguguaccugugaucccagcuacucaggaggcugaggugggaggaucacuugagccugggaggcagagguugcagugaaucaacauuauaccccugcacuuuauccugggugauggagugagacccaucuuaaaaaaaaaaguaccuugucuggaaugugcaccccuuaaaaaauguaccuugcuauuaucccaaagauauuuaauucagcaguucaguaaauacuuagcuccaguuacaugccuggugcuuauuuguuaaaugaacaaaagguauacuagguguuggugaugcaaagauaagguaaagguccuaccuucaagaagcucauugaagauucagguaaacaauaacuauaguaugacuuaaugaucuguaauagagguauguauaagaugaaggugcaguuuugucuagguagaccaagaaagcuccagauaaguuagauuuacacuggauuuaggauagacuucacaaacagcuaggcugcaguucaaaguuagccuucagucaaguuaucuuuguugggcggggggaguuagaaacauuaaguaugaagagauuacgcacaaaucucuguuucuuucuuuugcaguuacagguucuguuaacacuggggucucauuccaucauggcagaaauaggcuagagcuaaauagcucuuucauuaggcauuugucucggggguuugucauuuucagcauauuuucuucauguauguuaccuccgugauccuuuaggcauuuuaauuugcaaccccugcuccaguaggauccguguggauuuucugguuacagaaaagcaggaaaagauuuucuaggugaaaggaacuguaguagcacaggcacaaacacugauuguguuauacugagaacuuugugguuuguguauaacagcugaggaaucaucguauauuuuaagaaaguguauuucugcuuaaaaaauaaaaaacucuaccaucaaguauaucauauguuuuaaaggaggaacaaacuuaaaggcaggguaccuuauaaaaagccauugcaguagguugggcaacaagcaacagagacaugaugcagggcaaguuugagguagaauccacaggacuuacuggcuucuaaggauguaggauaagagagcugaaagaagagguacaggugacucuuagguuucugcuagacagguaaaggaaacaugguuucacuuuuagacaccugaaucgauacccacuuuacagguggaacuaugacucuccucuuacagugagguaggggcaggauguggauucuaaagucauuagaauaugauggaauuagauggaaauugaagguaugggaauagguaagguaacacuuaaaagauauggauugugagccacccuuaacccuaaacaaaagaauaccaacauuuuacucauguaaucuggguaguaaaaccagaaggguagaaagccaaccagaaaagaauugccuaaugguugccuggggaaauggugcuuuaaaaagccuucuguaaauaaauacugcaaacaaauuaguagaugacaacugaaaacgaagccugagcuaagucuggcaguggaauuggaaagagauuauugaaaauagugcaagaaauguugaguauuggaaaugaaaucaaucauuauuaagucauuguaucauugucaucauuugggggacuauaaauuaaugcagucgugugcagugaaauauuuuuccuucuaaaaauaccaaauuaacuuuguaauuuuuuuuuuuaauguaaaccaggugccagaugcaauuaaaaagugucagagggcuggaauuacugugcggauggucacuggugauaauauuaauacugcucgggccauugcuaccaaaugugguauuuuacauccuggggaagauuuucugugccuagaagguaaagauuuuaacagaagaauacgaaaugaaaaaggagagguaaagauuuauuauuauuuuguuuuugguugacagauguuuaauauauuaggaauuuaacucaacaaacacauauugaauaugcacuguguuaggcaccaugcaugaaauaaaugcagucuauaccuuaggaagcaaaauacuaguguucuaagggauaaaagagagaaguaauaaauugguacuaaagggaguaagcauuucuugcuaugaaugcuauauaaaaguagcagcagugaaucuaggccaauuucagaaguacaguauguauaagggaguaaugggagaugaguuggaaaggcugauauggagcauauuuuagggggccccaaacucucugaacuucuuaugcuaaauuaaggaaguucuauuuucauaggcaguagggggauuuuuuaaauuuggucucauaaugauauauaaaaacaguggcuuuuaaacuugaguaugcaucaaagucaccuagcaagauuauuaaaacacagauugcugggccugccccacaguauucgcuaagauagaucuggguccaugcccaagaauucacguuucuaacaaguucccaggaguuucugauuguucuguggaccacacuuugagagcuacugauaaauaugccagauagcucauuaggauuuaagaaacuauguuugggcauauuuuaacuuugauaaacacuuauagauugagcaagagaggauagacaagauuuggccaaaacuucgaguacuugcaagaucaucuccuacugauaagcauacacugguuaaagguaaguagauuuuucaguuauuucacaauuucuuaauacagaaauguguucugcuucccagaauaguaauagauacugaauauuagauugagucauggauaucaucuguuuuaauaaaaucuaaauacauuuccuuugauaccuuagguaaauuguguuguuaagugauuaucuuaaguguuuaaaacaggauauugcucugaauauacccauaguuucugaaguagguucucacccaacaucuaagcaauuuccauuuuuauauuuguuuauuuauuuuuaaccuugagucuauaaaaccgacgucaggauauucuucagaaucaucuuauuaaagaguaauguuuuuauaacacaaauauuugcuuguauuuaagguauaauugacagcacugucucagaccaacgccagguuguagcuguaacuggugaugguacaaaugauggcccagcacuaaagaaagcagauguuggauuugcaaugguaagaauuuacucauucaaauauccaaacguaauuuacugacugguuuguuuguuuguuuguuuguuuguugacuaaauuacuauggauuuuaaacacugucccucaagauuaguucgagggauaauuaauaagcuuaaauugguuuauaagucuaauuaguuuaugcauuagcuuuauuugaugucaugaaaucugacuagauuguuucuuuugagcaauuuaauaauauuguauguuggcuuuguauucuguuaauuuuuuaaugucugucaacucaacugaaccuuuuaauaacccuuuaaugcaggacacaggcuuagaauaguuguguguauuuaaauuaaaaauauaauugaaacucuuccauucaucuacucaguuacucuucaguuauuuaaaaaguaauugaauaccaucauuuuauauauaaucuuuuuuuauugaaaaaaauccuaccuacuuguuuuccccaaaguccucaauuuaaguauuuuauuuucuuugaguuucauuuuauuuuuggaaaauacugguucauaaucacaauucucaaaucuagaacuaucaggaaacugaaauuuuuaaccuaaauuuugcagcagacucauuugauugcaaaauuuguucugaacugaugugaggcuguuauuuguccuacuuagugugaauauucauagccauuguggagauuuuaaugugauuuuuauggggugcuaagcucuuuugggaaaauugagauauaagguuaugugucucauuaucuuuccaaacuaugagagacugaauuccgaaucacagucuggcccuaagguuuucagaugagagauuguuuuuguguacaaauguuuauuugcauaauuugucccccugauauuuugcugcuaaaauggaaauuuagaagaucuaccaugguggcagccuuucaacaggagugagagagaugaggaaaggaaauuauggguaaauuucccucaaucaaaagcagggaauccaaagaucccccgcccuaccccaucccaaauuuaaaugguuggcagcugcauugguaggagcuucugaagacaugugaagcauagcugaagaggucuauggaauaauuaagugcucuuccuuuugcuguaggcaaacaggcucauucccuuuaggaacauaggaucacucacugcugcucuugagcauuuagcaggauucuuauugcuauuuacauucugacagcugaccagaaaggcaguuauguaaaaugaauuuuaaaauaaaaaaagcuuucuucccaaaacuugaauguaagacagauacaaugggcuuuaaauaaauacagguaaauauaaucaaacaaauacacaauacaauggcuuguugguuaguguuuuuuaagcucuucaugguuuuaggcccaguuauaccacuuuuuuuuuuuuuaaaugauaacaucaaaagucuaaauuuaguucaaaaacaggcuggccaugauggcucacgccuguaaucccagcacuuugggaggcugaggcgggcggaucacauaaggucagguguucaagaacagccuggccaacauggcaaaaccccaucucuacuuuaaaaaaaaacauacaaaaauuagcuggaugugguggucgcgccuguaaucccaacuacuuggaagucugaggcaugagaaucacuugaacccaggaggcgcaggcugcagugagccaagauggcaccacugcacuccagccuaggugacagagcgagacucugucugaaauaaauaaauuaauuuaguuuaaaaacauagagaaacuguaagugcuugguagcuuggacuugaaacuacucuuguuaaagcuugaauuuacuuugguuuugcauuuguacaguuaaaacuuagacaaacguauugucuuagaguuuuuuuuuuaguuacaagaaaucgcuguugauaauuucuuucuaaauguaucuccuauuuucaggcagauauagcauuuuagagcauacuuucuugauuuguugaucuauagauaaaguguguguucugcuuguacauuuggcccuuuguauccauggauucugcauccgcagaaucaaccaacuguggaucgcaaauauucgggacaaaaaauauggaugguugcaucuguagugaacaugugcagacuuuuucuugucaugauucccuaaauaauauaguguaacaauuaucuacauagcaaguuuuggucgaaggagagaauccuugucacaugaaauuauucuugccaaaaauuaguuaaccauguauagagauacugcugucaucaaagacugaaucucaugguguaauccaauaaucaaauacaucuaugguaguaaaaccuaagguaauuaaaauacuuuuauuuaaauuuuauuuggauuaaugcgggacuccaaauauugagacuguguucaguauuccagucccggaacauuagaagugaagaguugcugucuccuaaaaauucacagcacauggaaauaauuacaggacagugacaagugucucaggcagaaguccuugacucugccuguagagacugggaaggguuuucuggaagaggugccaguuuagcugagggaaggagaggaaccaagaggcccucauucaucagcgaauuauguacaaguuuuucaaucuaacuagaagagguugcggugcuguaaugagauacgaagcuagaagaauucacagggggccacauuaaaaaggccuugaaugccaugauaaggaauuuuuuuucucuuauccuguagaugaacauuugccaagccuacuucugaugauguaaguuuagagacacacuaugcgauaucauaugacuccuagaagcucauuuuuaaaaagcaguuuaacguuuugugauugaaaguuuuccagacuuguuucaucauagaacuaguuuuuauuugaauaccaauuaacaccauagaguuacuuuuagaaauguuaaggauuuugagcaagggaauggugagauuugcauuuguauaauauggguaugaugagaaucaagaaaucccauugaguuuaaguguguuaaauauaugggacauuggccaggcaugguggcucacaccuguaaucccagcacuuugggaggccgaggcggguggaucucuugaggucaggaauucaagaccagucucgccaacaugguauauuaaaauccugucucuacuaaaaauacaaaauaguggguguggugaugugugacuguaaucuuagcuacuccggaggcugaggcaggagaauggcgugaacccggaaggcagagcuugcagugagcugagaucgcaccacugcacuccagccugggcaacagagcgagacucuaucucaaaaaaaaaaaaaaaaaaagugggacauuaaaaguaaaauauucacauugggagcuggagacuaagauucuaaaauaagauuguuucuucauugaguauuuugagaaagguuucaucugaacuucauguuuaucaaaacaauguaugcguagcauuuaaaaggucaaguaguucuauaagacuuaauagcaaguucccugccacauaccaaauuuuuggcucccaaaggaaacuguuuuagcugcuucuuuuacuuaguuauguaccuuuauaucucugaaucacauaauucuggugcuuuuugauuuuuuuaauauaaggcuuuaacuacugacuuucauuaaugaaggugaggacuuagugcuuucacaagcauauagaccacauucaccgcauauaccuucaugcucacuaccuaucccaucaucugccagcagaguuauaucauaauuuagauuugaucaauauucaguccuuacugugacuuacugugacuguaaaugcuguuucaaccugaucuguguggucuacuguaauuacuuuuccuuccuuacacagcuuuuuauguucccuauaauuuguugucuuuuacuugcuuucuuuuaauuuuuauuugguuuguuugaauuuuuuuggcuuaguuuuucuauguacuuaacuaauucauccccaaauucucuguuucauacaucagagaccuuuagcacucuuaccaauuuuagugucuaagagauacgucucucagcaucuuucaacaugcuuuaaucugcacucgcuguuugcuagccuugcugcacagcugucuucuuggucuccauaccugaggauuuucuuuauucuccuuuguguuggaucuuguacuucaugaauucaguggcaucaucuucuuugguuuauucccuuaucugguggagucaucuucuccagcugcuuccugagaaaggguuugucuuuguccauuuuguauugugauaacagaauaucuaagacuuaauaauucaugaacaauaaaaguuuauuugacuugagguucuggaagugaguaaauccaagagccagggugccagcaucuggugaggaccuucaugcugugucaugucaugggagaagggcaagagaacaccgcaagugagcacaaaagcaagagggggucaaacucaccuuuauaaugaugucacucuugauaaugaaaccacucccaaaauaaugauauuaauccauacaugagggcagagccuucaucauaucaccucugaguuuccaugucugcacuugguugauuagagauuauguuuccaacacaugaauuuggggaacacuuucagcucguggcaagguucgugagguuaagcuuuuugauaauuuuuuagugaauccuacucccuucuaauuacugccuugucucucugcaaagauaaccaguauccugaagauuauuccuuuugccuguuuuugaacuuuguacagaagagucauacauuauguguugaguucaucuucuuuauucagcauuauguuugucagaucauuuauguuaauauaguuguaguucacucauuuuauuaauccacaauuuauuaauuaccccauucuccuguugaugacauuguuauuaguuugaagcuucuaaaugcgucuucaguagacuuucaagagaucuuccuuuuuuuauuccuaccuucaccccuacuuccagugccacguaaaucugccaagucuggagcugacagggggguucuguuguuggggggaaagggggcuacuucuacuuucucuacacuuggauuaggauucagcuuucuugugucugcugaguuacuuaccauuuggcugucugcuuucuagccucuaagguuuuauggguuuuuuguuuguuuguuuguuuuuugguagaaucuccuuuuccucuaacuuugucuucauagaguuuguuugcuuuuuauuaacagauaccuuuuuguguggcuuuuggaaggaacuuggguaaugucuuuguucauuccuccauuuuuaacccaacuugaaccuuauuuuuaauacuucauucuuuguuugauuucugcuaaaccagaaugucuuuccuaguaauaucuuagaauaacucuguuaccuucuuuuaguguaaauuuaaguaauauuuauuagguauaaugguaaacuuuuuguuuauuaaguguguauuuuuugacuauuugaaaguuauacuuaaaacauuuagucuaauucacaaaauuuuuuuuaacaggguauugcuggaacugauguagcuaaagaagcauccgauauuauucucacagaugacaacuuuacaagcauuguuaaagcaguuauguggggacgaaaugucuaugacagcaucucaaaauuccuucaguuccaacuuacuguuaauguaguagcagugauuguugcuuuuacgggcgccugcauuacucaaguaggugaugacuugucuaucaaaacuuguuuacuuuaaauuuaaaaaguauauuaaaugccucuuaaaaaauacuuaauauuuaagcugaagcuuaauauuuuagguuaguuaauauaaaaauauaauccuguucuguuucucaaguuuuuaaacccuaaagguuuccugagaauugcugagccccugaguaguugugaaugucuauuaggaaacauaucuuuucuaggacucaccgcuuaaggcugugcagaugcuguggguaaaccucauaauggauacacucgcuucccuggcucuggcaacggaaccacccacugagucucucuugcuucggaaaccuuaugguagaaauaagccucucaucucacguacaaugaugaagaauauuuugggucaugcauucuaucaacuuguaguagucuuuacacucuuauuugcugguaagaauucagugucuaauaaagcuucaguuaauuguuucuuuuccaagcuaaucauccaagauguuauaauguuacaaauuuucaagagccuaaauucuacuccugacuucccauuuaucuuuaauuucuucuuaaucagugagugcuuaguaaauuugggaggacaauaagcuagauaguagaauaaacaggagaauaaacaguccugaugucuuacccuggcucuccacuaauuuagauaugugauccugagauuaucaccauaguuuugggagcuucuguuuccuugccuauaaaacaagagaguuguacuagauaaucccagguuucucuagcuccuuccaugcugccauuucagaucaaauaaaaggucuagcuaaguuguaauuuguauaccuccuugaaaucuaauuugguaugauaauuacaaaauagucauuuuucauucuuucaggagaaaaguuuuuugacauugauaguggaagaaaugcuccuuugcaugcuccuccuucagaacauuauacuauuguuuuuaauaccuuugugcugaugcaacuuuucaacgaaauaaaugcccggaaaauucauggugaaagaaauguauucgaaggaaucuuuaacaaugccaucuucugcacaauuguuuuaggcacuuuugugguacagguggguaauuggaaaagauaguuucaaauuugccuguuaaaugggagacauuagguaaacagcuuguucuagcaaucacuuguguggaacauguguggaacuguugccuuggugacauauauaauaucauggugauuuaagguauauguuaaagaauaugggaacugaaucuccuguucuuagaaguaaaugccacaaccaacuagacaaacaguuuuauuucuuccaacuguaaagugaaagauauuauuucuuaggaaacaaagucagccaaucaauuaauuguuucccagcauuuuaguauucuuuuuacaucccacauuauaccaaaaaaaagaucagguuuaaauuuuaaaaaaaauuaagaucacuuguacaaauacauauugaauucuucaugcucauuauuuucuugauuuauaaaagaaaauuacuucaguuuuauaucucuacuaaaauccagaccugauugucaaaucaguuguaaucuaauugggcuacuaacaaagcaguuggaaaucuaucuguacaagugcacaaauuaacuuaaaaaauaguggaaccgagaagugaaaaugacuugaauuugaauaaaguagagcuaaaaagaaaggaauuguaacuuuaagguuuuaaaauguuaacuaccaaaauuauuuuugauuuuaauauuugggaacuaguuaacugccauaucaaagagaggccugucagacucacaggagggugaauauuguuaauugauucuuuuuuuaaaaaauuauuuauuuuuuaauuaagacagggucuugcuauguugccuaggcuggucuugaacuccugggcucaagcaguccucucaccucagccuccaaaagugcuagaauuacagguaugagucaccacacccaaccccaguuaauucuuaauauuuccaugcacacuauuuuaggccuuuuagaauaacaagcaaaacauaagcacuguauuaugaauuuauauucaucaucagaccucacucuuuucauaaaggagagcaaaucugagaucaccucaccugaguuagcccauauuucauagaacuuuccaaguugccuuucuucucauauagucuguguuuaucuuaguaugucuaaauguuaacuagaaauaaacagcuauguggaauuuuuuuaauauugugcauuuuuccaguaacauacagucuuuucuacaaaagaguacuauauuuugagaaaggcacagauuauuugaagaguuguacuaaauacaggggaauguaguugcuugggguuauauuggaaacaguauaaaauuauuauucuuggucauaagaauuuuacuuuuuaguaagcguaauuuaaacaugaaauacgcaugcaucaaaaauauugggcagagauuuuacuuuauuucaguugucuuuuuuucuaagaggcaaaguggacuggaggggaaagaggaaaggucuauuucaguugucuuauuuucaguugugacuaauauaauacaauucaucagaauagugguuguucaccuuguuuuagaggacauaaauuugauauuuuuuuaaguauaugaauuuuaaaauuuaagauuuaaguaaauuuacucuugauuauuccuccagauaauaauugugcaguuugguggaaaaccuuucaguuguucagaacuuucaauagaacaguggcuauggucaauauuccuaggaaugggaacauuacucuggggccagguaaaaauuucaucaguuuuuguuuaaaccuaaagugauuuuuuuuuuuaauuucuaguguguauuuucuuuaacaguuucauuacuugauucuaaaugguuaauguggugaguaaagagagggcauucaaagauaaguuuuuuuaaugucguauuaguuccaguaugucacuuguucauuaugauuaugccuguacuauaaaauacuauccuaacuuuuuauguguuuuuuuaacuuguuuuuuagaaguuuuguagcgguuuuuaaaaaugauguauuuauaacugguuaggaugcuaauaucuguaucuuuuacucuauaaccuauuuuuacauuuucagaaaaaaauuuuuuacaacaauguaaaaaauacauggccgggugcgguggcucacgccuguaaucccagcacuuugggaggccgaggcggguggaucaccugagguaaggaguuagagaccagccuggccaacauggugaaaccccgucucuacuaaaaguauaaaaauuagcugggcaugguggcaggcgccuguaaucccagcuacuugggaggcugaggcaggagaaucgcuugaacccaggaggcagagguugcagugagccaagaucgcgccauugcacucuagccagggagagaagagcgagacuucaucucaaaaaaaaaaaaaaaaauacauugucauuuuguucuguaauuuaauccaauaugcagcauaggaaaaacugaccuuagagaauguuuuuauaaaaauaauguuaccuggaaaaaggggucacaaaaugauguuuuagauuugaauugaauagcuuuaacaguguauauaugaaauaaagugccugaaauaagagauauaccucauauuuacuauaggcagcuuacuugcaaaugcaugucauuauuuuuuaaaugugacagugauuuaugcauuguucauuuuaagcccauuacuauaaaacuaauuuauagaaaaucuaacauuuucauagaugaagguuaauauauauuauggcauauaauuugcaugagcuaauuuauugucauucugcaaaucagugaaaccagacuuucagguuuuccuuaaauguagcccaaucuuuacaucuuugugucucuucuuuuucuuaacuauguuucuagauucugagguuucuuaucuauuuugaguaccucauuaauagagaucaucuuuuaaguaagacccauacuaaguguaccaugguagaacaagcacugccuuugguggucaggagaccuagguuccuagucacuccaugagcaagucacuuuaugugccuugaagccuauuucaccuuggugaaaugagguggguguacuagaaguucuccaagcagaauucuguagcugacuacaugcuuguuucucccugauaaacccaacugcugccuuagagaauggauguuaacacauaagcuaauauacguguauugguguuucuuguauccuuuguguuuucuagggcaucuguuuuuguuuggcgucaucaaucaguacuaauccaauuuuaaacuguugcauuuuaaaaaaaauauguaacaaaacuauuuucaguguaaccuuaaugauuuuuuuaaaaauuuuauacauuuuuucucauugaacucugacagcauuaaugaaauguaaacguguuuugcaucuaguaagaccaccugccauuuucauuguauucaaaauaaauaggacuuuuuaaguaaauacauauaucagagcaugguuuuacaauguacugucuugaauguccugaugaaaauaugaaaaauguaaucagguuaauuuccauuuaggaaaacuuuuuauccuucaaacucaaaucuuuuguguagcuaagagaagaauguauuuugcucugggagagaaagacuaaucaacaggaucccauuacuucauugguaaagauagucggauacucucaccacuuuuaauaccuuuaguauuacaguugaucagcuuaccuuuacuugauaugauuuauuucuaaguucauuccccuguguuguagcuuauuucaacaauuccaacuagccguuuaaaauuccucaaagaagcuggucauggaacacaaaaggaagaaauaccugaggaggaauuagcagaggauguugaagagauugaucacgcugaaagggaguugcggcguggccaaaucuugugguuuagaggucugaacagaauccaaacacagguaugggccugguagagagguaggagagaugaugggagccagggcuuuuugaccuggggaggagguucgagugugcuccuuaaacuuccucucuagccuucccaacccacaaauuguauucucuugaaaaguaauacuggugccuggaaugagugagacuuuuaacugauuaugaaagaaugugucuauaugccccuaagcuccuuuuuuccuagcucccccaucccccacuucaucucaaaaugcuauucuugccuauaugcuguguaaaaagugccuuuuucuuuuuauauguugauagauggaaugguccuuucucuuguucucucucucucuugcugagcaagcugucacaaucucugauuccuugcagauggauguagugaaugcuuuccagaguggaaguuccauucagggggcucuaaggcggcaacccuccaucgccagccagcaucaugauguaacaaauauuucuaccccuacacauguaguguuuuccucuucuacugcuucuacuacuguggggugugaguguguguuccuaagugcaugaaauuaacauuuccuacuucacacaccuaacguuucucauuuucuccuuaauguuugaauucauuguucaggcuuuuucauaaagcuuucuuuucguaaaguggauugagaccucaaaguguugucguuguuguuuuauuucuuagagggcuagauaacagguggaacaauugcaaccaaagauuagaugcaaucugugagcuugucucugugcuaacucugauaguuaauauggggaauaaaauuguagcuuagaacuugugaaacuacuauaaauuuuugaguauaugccuuuaaacauguuuauauugcauguuuccuaaaagcaugugauuugaaacucaucuaacagaaccaggaaauugcauuuucaaagcuaagaauaaauuuagcauuuugacuuuuguccaauuuggaaaguaaguuaguagccugaagacaaguuuucaguauguauagccaguugcuugccuucuuaaccugaacuuugccuugcuuugauuuuuuuuuuuuuuuuuuuuuuuugcuugguugugcagugguuucaggggaaaucacuguguaaauuuaaaaaguuucugugguauuuaugguuugggguguuuuuuuuuuccauuuguauagacaauuuaguuaaaaauugcaucauagauaagaaauguucuguuaaguuucaguagaaguaggaaaaguauacuauugauuaaucguugaaccaauaaauguuguaauuuucaauaauugacuaaaauaacauuuucuuucagguuuuuaguaaauagcaaacuuucuaaaagccuuauaagcuauaaaucuuacugagaauucauggcgcauucucaauauauuggaggcauuaaagauguaaaccccaaaauuuacagagcuaccuaagguuagccuugaaguagacagagaccuaucuuuuccauuuggucuccagccagcgaaggacuagaggaaccuugagaagcugcagagaggaugaauuaagggagaaaacagugcagacuuuccacuuaaugccuguuuuuuccguauuuacuuaaguauauuuucauuugauauuuuuuaaaauguggugaaacaggcacaguaagaacugucccuguuuuacaggugugaaaacugccuuagaguuuaaauaacuucucuacgacuaauaagcagaggccgcaugauguaaagcaaaguguuccaagugacucgcuaacauuaagauauuaaauuuacauagagggacagcuagaacucuucuuuuuaaaaauuaccuaccugaauaaaaugguaaccauaaauugccuagccuuaggccugauacaauaaaaaugccucuuccucccuguaucuguggauuucaaacuaugccucucucucuggugcuccuuaccaccuagcccuagaugguaaauguuccacaagccuuuauggaaggccuaccaugugucagaacuaugcuggaaccuccagaaccugcagccuaguaaaggacaaaaaaaaguaguuggaaauuucuacaugguaguaaaacacaaacugucuuaacaggguccuuagccuacccuggaaagucaagaaaaauugccugaaggaggugacucccaagaugacccuugauagaauucaccaaaugaggccucagugauuauaaucugguacuaaaagaggaauaaacuaagggauugauaauagucugguacugaaagaguaauaaacuaagggaagcugaaauggaaaguaaguaucuguuuauaccccacaagaaggagccaaacuaagacuuuauccugauaaacccccuucccucaaaauuuuaaauuugaaaaauucaaaccuacagacaaguugaaaaauuaauacaugaaaaucuuucaccuggauuuaccacuuaauauuuuaugacacuacuuuaucuguauauuaauaaaacuuuuuucugagccguuugaaaauggcagauaccaguguuuuaucccuaaauacuucagcauguaccuaagaauucccguauauaaucauacuuuauuauccaagaaauuuaacauugauaccauauuaucuaacagacaguuaguauucagauuucucugguugcccccaaaauuuccuuuauagcuuuuuuaauccaagaaauaauuauugacaguauguguguuaugagucuagucuccaaccuguauucauucccugccuuuauuuuuuaugacauugacuuaugaaaaauccaggugaauugucuuaugaaggguucuacauuccagauuugucugauugauugcuacugauuagcuucauauuaaacuuuuucgacaaguuuaucucauggguaauguguauccuauucguuuuuauuuaccaauauuuaaauaauuguuuuuuucauuuagagggauaucagauggcuuuagguguacuauacuuauuauauuucucagucugauuguguuccaagcuuuauauuaaauaucaaagcaaucauaaacuuuuaagacaggcaggcagacacauauaugcacacaccucugcacccaggcaucuuuuuuuccaucccaggcucuuuuuucugaugcacaguuacauaugaaaccucugaguuucugggcccauguggcuaggggagcagauacuucagggaaguaaaggugcacuuaagagaguggcaaaggaaaguuuguaguuguugcuuuaucaagguuugagauguuuacuucuuuauucuguguccuauguucuuggaguuauccagggaguaaaucauaucucguuaauacaguugucauuauacaccaagaguugcaguaauuauguugcuguuaccauaaaugucuuucaaccuuguugguggagcauugucuuaggugguacagaacaucagccaaaauauagaacuauguuaauauauuuaaugaaagauuucauuuuaucacuguguuucugcccuaauauggaauaguuuuagaacuaccuaugggugucaaaauuauuuaacccuuauugggugaccuugcuuagcuaaaauagaagaaauaauccauuuagacuuugucaaaugcuagacucaaacaucucugaagagaccuuuuucccuucauuuauuagucagaucuucacucuuacaggucucuagagaaaacauucuguaguuuuuuucuauuuauaaaguauaucauucuaacaccaguuuuuaccauuaguagauuuuuuuuuccugaauaaauaaauacacauuccuggaaaugagaaauugagagaaaauuugguuuucuaggugaaggaucagcaaacuacagcuuaugggccaaaucuagccuguugucuauuuuuggaaauaaguuguuacuggaaugcagcguugcccauucauuuaaguaauaccuguggcagauuuuucacuguaagggcagaguuguauaauuaugacagacuguauaauucacaaaaccuaaaauauuuuacugucuggcacuucacagaaaaaguuuaccaaccccuguuccagauagauaagaacauuacacaggugggucuccuuuugagaaaauuuaauaugcaaguacccaacuuuggaaaacaaucuagaauuuuguuucuaguugcaaaguaucuuuuacuguaccauugcaauucuuuaaguuagugcacauagaaaaguaguaaugaaaacaaauuucagaagugggcaauuuguuguagaagguaagauuuauuggcuugugauuaguauuuuagagcucucucuucuguacaauguuuuaggcaguaaacaauguuauuuucugcuauuaaaaguuaggaugguauuuagaaaaauugguuuuguagguacaugaucuuguuuggauuuguuauauuucauauauuguuuaccuugauaaucauuuucaguuucuuaaaauucaugauuaugauaaucacuucaguuuuuuuguuuaccauaugugcuucaugcaguauuuuuguuuuuuuuuuucucuguugaacaguuuacuuuuacagaauauuuuugacacaggaauuacugaauuuuucuuaauucugauaauuucgagggguauaaguaugcuccacagaguagguuuaaauaguuaauaaauaggaauugaauuuuaaaacuggauaaaauaaauaggcuuggauuuucaaaagccuguaauuaaguuuacuuauauuucuacuuaaauugaauuauuauuaauauaguuuccuuccuaccuaaaguauugugcacaaaauuauuauuuuccucacaguuacuguacugugagaauuuuacauacagaaaguaauaaagaucagagcaggugugagccagcucagugucaugccuuagaucaagagugcuuucuuauguucuuuauaaguagaaaguaaaacaacucugguucgaugauuccugguuaaucugagcuuuauuguauguaucucgagaacuguucuuugaaaauugaauugcuuucgagcauugcugaacuggccuaguaacgugcugaaacuaaccagacauauggcuuaaauagaugugucagacaaaggaagcauuaaccuuaaucuuauggaauguuuuauucaagugaaguuagggauaaaguaaaugaucguauguuuuugucuucucuugacuuccaaggaaccuggaauugggagcccagaaaccuagguuuuaagacucuuuagcacuaauuaggaguuccuuaacaagucagccacccauccucucuguugcucaguuuuauuauuuaugaagugguuagaaaaaaaaaaucucuaauauuguucaacaaauucagauaggaaaaaucuucucagaauugaaguuuugcuaagaagggauuuaaucuuucuuugccugccaccgguguaugugugugauugugugugcacauauacuuguugcccucaccuuuacacucugccccucuuagagcuucacuaacucucaaaucucuaacuuaaguuuacacuuuucuucugagcucuagauauuuuccaaauuuaacauguuuaaaaaguacauuuauuuccccccgauucuucacugcucacuuuuauaccgacugauuacaaagaaaaacagauggaaaacacacacauacacagaaagcuuaacuguuguucuaucuucaguagcagcagcaccagcaaccuuaucaaauaagcaacaucuucaggguugucuugaacaguucucaucacccaucaaguuugcuggcugauccucuaauuuguauucuccuccgugccuacgggcugcugauaccaacaaauuuuuuuuuagaaaguuaucuuuuugcauuuuaagcuuuacaguuuguuauuaggacagucaggauacuugcugaauguucacauguauaaaaugugaauuuuaagacuucacaauaaaacacugaaugaauuacuauaacguuauauuuagcaaacauuguuuacauuccauauguagaacacuuuacaucuuaguaaaggggaagaggaacaagagcaauaaaagaaguugaaaaauauuugcugcuauucaucagucaaauuaaggaacugaaguacaagcaaucaaauagaauggaauuauaaaagaugguaaagcugcaagacauuaauagaauagaugcuugcugcuccaaguguggaucauggaccagcagcuuuagcaucaccuuggagguuguuagaaaugcaggacuuuaggccccugcugaaucagaaucugcauuuuaacaagauccccaacuaauuuguaugcacauuaaaguucgagaagcccuggccucgauacuugugaccuaacauuguuuuaaguuuguagugugcuaacgaauuuaaucucccacaacaaccccguaaggcaaguaccauugcuauuucccauuuuauaguugaagaaaccuguuugaccgagguuccucagguaguaaguggcagagcuggaauuuacacccagacauuuugcuuuuguauuucucaguugacuaugcuguacucucuauauaaagggcuaagugaauauggacuaaaagcagcuuacaaauagggcuuggcaaauaaggaaagacaacuugaaggugagaugugggugcauggcccuaaacucuacauuacauuuuuuuaaacacauucacauguucauuugaagaaauguauuauucauuauugcugucuaaagagaugaauuuggugaccgcaucuuuuuucuagaaugucaaaguguuauuuauuucucuuaacaaugaguaaaugaugucuuuauuacuaaacaggauuuauuagaaucaaagcaaaagcaaacacuguauuugaauugauacauaguaaaugcucaacuaguuggauuuuguccuuuuuuuucuaaaucugaaugacgcuugaguuaauagcacuuaaugucagugugugcacugauguuuuuaaguuugauugcccacuaaucuuuuucauuuauacagcagacugagaggaagaugaauuguugagcuaucugcuuaggggugaaaauacuagaaaacuuuuaacacuuugugucuucuugggaaauuuuucacagaagaaucccagaggauuuguuuuuguuuuugaucuauucuuuccagauaacuguaguaauugauuuaaguuuuaaucuguuacagagaaaaacacuaaaacuuuauagacaaaugauagacaaauggcauauacucaaauauuuauagcuguuuaauggcauuuuauagacauuuauuuggguuuuguucuuauuuuuguuuuuaauuaagggaguagugggguagaugugaguucauuguggcauucagcuuauauuugcuuggcuuuuucauggucggugacacccuaauuccuagcaugauaaauaguaacccuuugugcuugauuuuguuuaacuuauuugaguuguuuucaaaauacauucuuuuuaauuuaaaaaaucagcuaagcuuguguaugguuaaguuuuuguuuuguuuuguguuugauuuguucuuuuagggaaaaaauccuauaaaauggcuauuaaauuuuuagccaaugacaaugagauuuucuuaauauuacuuugaauucuuuaccucuuaauucuuagaguaugugguuuuguuguucuguagugucuuacuaaaauauucauuuuuuuacaguguauugcaaguuccacugcauuacaugcaaauaugauucacucauaccuagcuguuuguggauucaaacucauaaaugaaccauuuuuaaguuguuaauaguguacugacauauuucuguauuuucugauauuuacagauucgaguggugaaugcauuucguaguucuuuauaugaaggguuagaaaaaccggaaucaagaaguucgauucacaacuuuaugacacauccugaguuuaggauagaagauucagagccucauaucccccuuauugaugacacugaugccgaagaugaugcuccuacaaaacguaacuccaguccuccacccucucccaacaaaaauaacaaugcuguugacaguggaauucaccuuacaauagaaaugaacaagucugcuaccucuucauccccaggaagcccacuacauaguuuggaaacaucacucugauuguaagcugaauguuaacacacuagcugcauuguaaagaaacaaauugaaacugggucuuuucacauauugugauggacaagcuaguauucuugucuuuggacuucaacagaagacacacuuguacgaauguagauuuauuuuuuuaaaaaaaaaaaagcaaagcuuucugccagacugagggugcuuuuuggggggugggagaaaugaacugacagauaaacaguaacucagcguaagugaccuguggaucaucaguaguacccaagcaugguccugaacaguguauuagcagagcuuuaguuuaucucaguccuggaugggagagagagggaggaguaaaacugggcaagacaaagagcccuggaucguugaauugauaguuuaauuucugcuguuggcuguuaauaauuuggauuauuuauguuuauaaaugauacagaucuguuuacaagguuuguagauacuuuuuuuguuccuguucauagaugggaagcuuccuuauaacugaugcagagaaaaauuaguccuucaaauacugcuguauuuucaggaaaaaaaaaaaaagggguguuucuauugaaacuguacuaaauuuuugccuacaauuuaccuuguuaaauauuguagauaaauugcuaauacuaauagccaaauagauaacacuaaugcuuuguuuaaaaaaacgaaaaaaacaaaacaaaacaaaaaaacaugagcagugguguucuaaugaaguuaugacaucuguccuaauuaguuucuuaaauacauuuacuacuuaaugguuuugaagcaacuguuuaauuuuuaaaauuuuugaaaacuugcuaauaaccuuuuguucagaauuuaguagauuguuuaaugcaggacaucaacuacauaaugaaagaugcuugaaaugcuuuuguuauuucaggcaaaucaaauuaaaucagacuaucaaacuacaagagaaccuuagucuuuuuuguuuuugucuaaacauguuaguuuagugaugucuuggugaacugugagugaacuguauugauuuuucuaaucuuuagagaccuucacacagcaugagggcuguuggcauuuugaaaaagguuaauaaguagaagcauacauguuuuccuuuuguuuuugaaacuuguuuguaaacauaaauaaauaugcccuuuuauuaaauaaauucauggcaauguuuuuuuaaaagacauuucagcuucuuuacucaguucugcauauacagugcaucagucuguucucuuugaccacaauuggaauacauuucaagaugguaacagccccaugaaguaccgcuuuaauuccuugcugguaaucuaauagaaucagauuaagaaaauuaacacaauuuuaccauuugacauacucuucauugaauuuaguuugucuaaaauagucucacagguaaaaaacauaacaacaaugaccaccauugucuuugauacauuuauuuuaauucuuaaguggccaaauaacagauuagguaaaaugagauuacaugaaaagguucuaaaaugauauauuuagaugcaauaauuaaccauaugcuagaaugcccaccucuaagccaauuggauucuuuagcucucuuuuucuuuccuucaucuaccuucuucucuuuuuugccucugucuuuacccuuuagaaacuggcauguguuagggcccagauuucaccagauacacaauccucaggcugacauaaaguuuacgaggacugcuacuauaacugagagugcugaccaagcaaagaaacauuuaguugauggugcuugauauuuuuggugggugggggaaaucuuuuucucaccaucaaaucuuugcaguaauccucugcaggucuuagaaacacauuggcucugucagcauuuguaauuguacauuuauucaucagguauuuauagugaaucauacuguaaaaaagagguagcaugauaugcuggaaagcauauuagacuaggagucaagaccugguuucuagucuugguuuugccauuaaugugcugcaugaucuugggaaaaucauuuacccuaaauaagggugguggacuaucuugaagaacccuuucaacucuaaaaauugacccuaucaacuggagagcccacaaggcauagggaauagagaaaagggaaauguuuucaguuuucuuuuuuauuuugguuaugcuuaaauaugaauguaauuaccaaaagauuuagaagugcaugugcuuuggaggauuuguauugagcuuuuacaguauucauuuuucaacucaaggcaauggcuuucuacaccaacucuaauccauaaacgggucuuaugacaucuaugaaguaguagcaagacaugcuuaguguguauuucucucuuugagacacuguaauuucuaccagaaauuuccagagcauuauguagguagaaaaaaaugcaagcaagcuguuaaagaucuuggaucccauuauauaguauguauagcugaaaucuguaauucaaucacuuuuucucuuuuauccucuaaccaaaaaauuguuuaauuuugcaucccaaauguuuuuaaucuuuguauauuuuuuaaaaauccuuuucuccucaucauugccuuuuuugugguuguaaauagacuuacuugcacuuugaagaugaguuacuccuugucaucuuacaaauaugugauaugguaauuuucauaacagaugucaguuuugaaccaagaauuggugauuuguuuauaagaaaaaaacuggcuucauuucugugaaauugcucuuugaaaauuucuuuuuacacguguaagccaacugagauaccgugaugguguugauuucuuucaaugaugcuuaccaucuauuuuagccacugagccuuuuauuauuugucuauuuguaaaguuuauuugucuuaacucauuuaauaaauauacuguuuaucuguuucugaau

SEQ ID NO: 16380 - RNA, 2531 nt, Homo sapiens
uaguuugcgaaagucguccgccaggcccagaccgcuggauaggaggcucuuggccgggccgggggcugggggccgggauggcagagggggcccuagcugcgccccgccgcgcugggcccucgucuccgggugcucucaacccucauacaggcccuuagccguucuccuagggacccugcccggacaggaggaaagguuuccggcccauggaguuuagucucauuacaaaagcaaaacaagaauaagacuuaccaaguugcuugccguuggggcugagguccaaggaggugaucgcagcuuuguggccuuugaaauaacgcuccagaacgggguccuccuggaaaggaaaguugucaaguuuugaaagccgccgcagaccucgaauucuggcggcugggauccacgcugccacuuccccggaguccggcuugggaauggccacccaggcggcggcuuggcugggcggcggggccgggcagcagcccacccacgggcgcggcgcccaguccugcuacagggagacgccggcgccagcucuccccgcagagcccgcaaaacgcucuguucgcgcuucccagaguccagcgcaucgcaggaaccgcggccccuuugaaaugcacguucccgggccccgcccgcuggcccaaggcaggcaggugcgaggaugcgccucggcuuugguacuuuuuuuuuuuuuaauacuuccuaggugauucugacgcaggcgcuccacggaaacccuccgagaauucugggggccguggggccgcccagcucaguccggagcuccggaacucggggaagagcguccgggagccgggucuggguuccgcacuccguccgccccgauggcagagagugagauacggacgccccgggacgaggggcucaggacccggcuacggacaccugccuccaucucccuccaggugcggcuucggcccggaccuggccccgcagcccgcgggacaggcuccagggagggaccccccccaccuccaacccguccuuaccguggcugaggccaucgggggaguggucggcccaaggcuccugugggugggggaacccggagaggggaggggagaggauggggaaggagaggggaccgugcggcucccggaaccgucugcccagagcggcagcgccucccggucacuacaacaacggcggcccagucaaaccccgcgcuccaggcauggccagccgagccccgagacaccgccagcccuguaaagagaggacgggagguaugcgccgggucagcuguggccacacaccaagccauguuaacuaacacucgcguucucccugguuugaugucaggaagugggguaguaaccaggacuggaauaagagcgaugaauggaagggcguugugagccugugaucgaugcgaucagaguucuauuacguuuuaaagagacagcacccgugacguuuaaggugauccccuaccgcuuauuuuguugacguaaagcuuugacaugaagaggggcagcuugcuaguuauuaauauacuaaaaggaacuaaauccccugagggcagauuugaauuuauuuaaccacuguuuuccacacagugcccugcaggauauugauauaguugcuggaugugcgugaugaaugaaugagugaaugaaugaauaaauguugugcaugcacuuaauaauuuucugcgauauguuuccauucucaucugcuuauuugcguauaccuuagagcacuaaacuuacacagcuggauacuuaaagucuuuaggaagacuuggaaacaugguuuuuuuuguuuguuuuuugugagaccacguuucuacagcaggcuuuguuacacauaguaucauuugugcuucagccaaacaaugaaguugguagaauuacaaaauguuuucaauguuuccaaguuauaaacuugauuccuagauauuggucuuagaggucacacagagacaguucuucuaauuccaaguccauauccuuuuuuuuuuuuuaacccugccucaaagcgugauguucugagcugaaaauuacauauaguguaaagauccuuagcaacaucaaagggcaugauagaacacagcugguaagacauguguuuuaugcaaaugaaagguaugcuacacaccuuaauuacagauucccuaguugucuagugauugaguuuaauuuuauugaauaugguacuuaacaacuaaacagguaggcuuuagauuacaguauuaguuaauuuaaguauacacuuguuaaauaucuguuguauguuuggccuugagggacacaaugaugacuaagauauuuccccuaccuucaagaacucagcaaucuaggguuggugagucucaugcuuuagcauuuguaauguugauuugggggcuccauuuccagagaugcugaaucaacauauacaaggugggauccagggcccuucugauguaacaagcuccauagaugauuacuaugggagucucagcugucuauguugagaaacacugcauuagucuaggagaugauauguuaagaguguugauauca

SEQ ID NO: 16381 - RNA, 1592 nt, Homo sapiens
ccccugaaacaaaaguauacuuuuuauuuaggcuuccucacuuucugguagucacuuucccccagucuccaguuuuacccugacuuagaguccacaaacuucaucagacccucugugcucauggacuugggccuuucuagagggaagccuaaggcucggcuccagaugagcugugccaguacacccaaugcucgugacaccccaaacaggacuguguaguaauucaucuccaucaugccauaauacuggagcagcaccccacugugagcaucuacauugggccaaggauucuuggccuuacccugcucuaagaggacauugggcacaaucuugcauagcugagcaaccaacuuaaacauggggucauuaggcagguguuucagagcaaacucucgcugacagguauaucguggaucagucuuccuuaguacugcauggccauagccuggaacagcccguccugaguugaguguguuccagauguagucucauaacuucucaucugacacaucuuugccaacuuccuucugcagcuguguuagccagacaagcacuuccugauuugccaguccauggagaggcccugccagcccguucauggcugcugcaaaggacagguaagggucugaaaggccacugcccaccaaguggcugguaugggcacuuacauugccgcccucauggucacuguggauagugagguacaggugcaugagcucagggaacugaugaucaguauagccuaacauguuggugaaacugugagaccaguccagguuagagucaauggccccaauaccacugccuucuccauagagauuucgguagaucuuugcugcgacacaagguagcuuugugauuagauccacagagucuucauaaaucaacucccaguacuuggguucggcugauaccccgugcauaugcuugggcaaaguuacuuucacuguugagggcuguaacagcugcacugagcugagacaugggguguagauuggugggaaaguuguccagcauggugaccacaugggaaggcagagcugcccucuuugcccacucuuuugagagccaagauaccuguuccucuguugggauacauccaguuaccagcagccaaaauaagcccucaggcagggguucuuccccacccuuagccuuggguagcaguuucuggcauucagggauacuaaagccucagaaacggaugcccucaucaggaucaagaacugauguuucauagaccaaucccuucaugccucucaugccaccauacaucauguccacagugauuuggcccaccaccuucuugccauguugcugccugaaggucuuaauucuggccugcuccuuagguaugaggucagccaauaugucuuucaaauucauggaggaagcacuggcaugcugggcugcaagaacaagacaagaugcauucuugguucccaagagccgggcggccgcaguaaguaaagccauggcgggcgaucuccgggaucugguggggagguaagaaggggagagagcugcggcaggaacaggagccgccgccacugcaccagaggccgcgccgacagguugacaagguugaaagg

SEQ ID NO: 16382 - RNA, 26953 nt, Homo sapiens
uggccuuggcggaguuggggauggugucgccuagcagccgcugccgcuuuggcuugcucgggaccauuuggcuggacccagaguccgcguggaaccgcgauagggaucugucagggcccgcggccggguccagcuuggugguugcgguagugagaggccuccgcugguugccaggcuuggucuagguggguggauccuuguaagcaggauuagcgagucacuccacgcucagguucuuuagccugagggcccgugugccacagcauagcuaccccgcccuuccagccucgggucccuaauacugccuugcuucgguuccaguuuccgccgcacaacuucacucauuccaaauguuaauuucugcguuuuuuuucagccccaauucuguuucuccaaaucagggaugauugucggccuuccacagacccucgcgcuugccaggauuaggguguucgcgcgcauuguggguagggguguggaggaagggauccagaaaucuuaaguauuaacuuagauuaguguuagcaaggaagccgucacauuuuauuuagccgggacacucugacaguuugugccgacugcuauuuuugaucaaggcuauuuugcccacuugucuauuuuguggcccaauugucuguuuugcuaacaucagaaaguuauaaugaaauaaucugcaaaaaauguaaggugcuagaaaaccaauaauacuguguaccuugaaaaugcuaauauacaccuguuuuguuacagagguggagcacagugaaagaauucaagaugccaccuaauauaaacuggaaagaaauaaugaaaguugacccagaugaccugccccgucaagaagaacuggcagauaauuuauugauuuccuuauccaaggugcuuaauuggucaauaauaauagauauauacauuaacuuaugauuaauuuauuaauaaaauaugaauuuauuuuuuucagggacaacuauaauugucacaaucuggaaguguucuuauauuuugcuugaagguuauaaaauauaaaacaguugcuuuucuguuuacuuagguggaaguaaaugagcuaaaaagugaaaagcaagaaaaugugauacaccuuuucagaauuacucagucacuaaugaagguuuguauguaguagguuuuaacuauagguuuggcuauuaguggaacuauaaaaaucuguucuuauauaagguaaucuuugugaaaauaccugguaauaucuacaucaccacuaaaaaaugcaauauauuuaaaugugaauuaaguauuuuaguguauaaaacauugcuaguuucuacuuaaaguuucuaaaaggguguguaggggaaauagaaugaguauguugaaaaguaacauaaggaaauauaucuugagguccaaaugacaaaugcagacaaugacugcuauagggauuuguuaagaggggaaaugauuuaagagaugucagaagacuucacaaaggaucaauacugaggaguaguguuagauaaguggaaggcaaugcagugguaagauaguaagggaauucuagagcuguugguuaccauaaauaaauacugagaacaggaaauauguuuauucuuuauauuugaggaaacaaggugcagcaaguuuguagcagacuguagagaaaacaaaucuuggguaaguacuuugagauagguuguugagggccuuaaagguguauuuuaugcuaucagcaauugagaaggcaguaaagguuuucgaaacacaauugauagguacaaaaauacaccuuaagaaggcaaaacugaguauauuauguaggacaaacugaaggaaauuggagcuuuguagacaucacauuauagcggaguuuaaaccugaaauuauggauuagaauaauagcaauuggaacagaaaaaaaguaguggaaagacauuacaaagggagauguugcauuacuggauauaagacuugaggacuugagguaaaaaggagaaucaaaaauguuucaugcuauuaaaaaucuagaaauuguagucuuaaguaagaaaauugccuggcaugguggcucacgucuguaaucccagcacuuugggaggccaaggcaggaggauugcuugagccugggaguucaagacuagccuggauaauauagugaguccuugccuguacgaaaaaauuugccgagcaugauggcacaccaagcaugauggcacgccaagcaugauggcaugcaccuguagucccagcuacucaggagacugagaugggaagauugcuugagcccaggaggcaggagguugcagugagcugagauugugccacugcacuccagccugggugacaaagugaggcccuaucucaaaagcaaaaaaaacaaaaacaaaaaccaaaaacuauuuauucagcaaauauuuacugaacgucuccaugugccagccauugcuggcacuaaggaucauaacaaauaaaacagaauuuuuauuuucagugcuuacauuccaguauaaaggcauauugaaauaaccuuuuuuuaauguuuagaugaaagcucaagaaguggagcuggcuuuggaagaaguagaaaaagcuggagaagaacaagcaaaauuugguaagcaccuuggaaaaaguuuauuaugguauuaaauaaugaauuccauuuguucauuaaacuguagaaaauuaaauuauauucuauaaaauauauauauucaguuuauuuuuaauauauaacauuuaauaauaaauauuucuagacuccuauuuuauggaucugccauauaauacuuuuuguuaccuuauaaucaugauggacucuuuuaaaagaauuaauuuuguuauugaaauuuauuuaaaaguuuguuuugugguaacuaaucaauuaaaacguuuuucuuuuuuuuuaaaaaaauagaaaaucaauuaaaaacuaaaguaaugaaacuggaaaaugaacuggagguaugucuuuuuguauucccuaggauguaauugucauuaauuuuauuuugaauuguuuucaaauuuuaaaauuauuguuggcuggaaaaauuauaaggaugauuguaaucaugguuauuuguuuauucuguauauguucuacaugccuauuaugugccuuauauaguacuaaggacugagcauaugguugugaacaaaauaagaaguuaacugcuggauggagcuuauagucuugggaaauauacagaaagauuacuaguaacugagguggaggguggguggggauuugaggaauagugacgaaaggguguuauagaaguaauuuuugacaaagcugaaggcuaaaauaugaauguauuguugaagaacaaaauacauugagauuccugagaagguaggaaugugauacaaauggaucagccuuugaaaggaggaauacccuuuuccuuuguguuaggagaggaggaugaguggaugagcgugggaagaguggauguguauagaggcuuuuauguuuguaggcauaaugcuuggaaguugagggguuggugaugacaucuucuguuaaaaagagugggaaaugguguggucacauuuuaaggaaauuagguaaaauuugaaauauauuggagacaggacuggagaguuggggaucuggagucagacagauuugaguucuaguccugauucuucuacucguuaacucucugaacuuggaugaccuauuguuuuugauuguauauccagcuccugggaaaaugccaagcacuuucaauaaauacuaaaugaauuauggaguuggaucaguucuguguuaguguuuagcuagguagcugcuguagaauagaaggguagcacaguugaagauauugguaggaaagugguugaagugaugauuaugaagucuuaacugaauagauaaaaucaagauugggguugggugggcagaaggguagggauauggagggagaagaugagggguuagaguguccugugaggucgaaggacaggcauagugggaauaauugaaagaauguucugguuggacaaggaucugaugugggugugggagugagagacuauagugaauucaagaaaaaaauagacuagaacaaaaguuauguggagauugcuuagugggcauuugauagacaucugugggccacaugcuuaaauucccagugcauuuugcggaguuacuggaagguugguggcuuguuucuaccaugaguagguaaagauggagagcaggauauuuugugagaaagcagcugaaguuucuauaggaugauggaggaaugauaggaaugaucaccugaaguugcagggugggguaaaccuagaagcaccaacaccuucuucugacccucauguauuuggaaucugaaagaaugagcaccuuccaauugaaagaguuccaagggcauuaguauacuaaaggauccaaauugcagcuaagccaaggagauggaaaggaggauucaguaaagaaucugaggaugugaaauauuaauuuaucuuggaagagaauuuuagagagcacaauggaaugcuuuuuggaggagagaaagaguaagaacaauuugguuaagguagaggaauaacagaacuauaaggugaagaaaugaaugugagacacauuagaugaccaaaugauuugauguucuuggccaugaccugaauuaacaagacugugagguaaaauggauuuaaucggcuacaaaucuuaagauaaccaaaaccugagcuguuuaauaugguagcacuagcacuaaccacuuguagcuauuuauauuuacauugguuaaaauuaaaaugaaaaauuuaguucuucaguugcacuagccacacuucaaaugcccgaacauagcuacauguagcgaguggcuauugaacuggacagcacugacagcauguccauuaugcuagaaaguccuaugggacagcacuggucuaaacagugcaugguaugagagaaagggcagguuaaggcacucagcuucacugacugggguggagauucugaugguuuguacucagguuccagaucccugaggcucaggaaccuuugcaguuuagucugguuaccuguggcccagugguuacaacagaaugauuaacagucaauucuuugcaucucuggguggcucaggaaaaauuuaaggaguuauuagcugugaacuaaccuuaaguaaguuaaauuaaaaaaaaaaaaguucuuaagcuaauaugauuuuaaauaucugcacugaaguauaaugcaaauuuaaauucagcauaauuauuugcuuguuguugacucauuugaaccucaaaauauaaugggauuaauuuauacuuuggguuuauuacuuuaagauggcucagcagucugcagguggacgagauacucgguuuuuacguaaugaaauuugccaacuugaaaaacaauuagaacaaaaagauagagaauuggaggacauggaaaaggaguuggagaaagagaagaaaguuaaugagcaaguaaagcacuuuuuuuuuccaugaaucuucacuguucaaguuaccuggcuuuuuauuauuauugguaacaauaucaauuuuuauauuguauguuauauuugaaaaaugauguacacuuaucucuaagguuuuauaucacuguucauuuugucaucaccaauuuuaaaauauaaugguacuucuagugaauaugacuugaagauuaauucuuuauauuuggaaguacauuuuucucaggacaucaaacuuguuaccuaaaauuaaugcuuuugucuggaagauugguaucaaguaacuaauagauuuucauaaagaagugaucuuucuagugccauaguuuauuuuggguaaaaguuauauuuguucauuucaauguauuuauaugauuaguagauucgcaaaugaaucuuucgauauauucaauaaugguuaauuaaauaucuuguuuuugguuguaccuuauuuuaugugagauauauauauauauguauaguuuuugaaaaguuguguucaugucagcaguuuauaaaucacauauuuaaaauaacauuuuuaaugcauaguuuuuauuaccucguuauuccuuguuauaaacuaauaauucuugcaguguucacuugaauuuaguuuuaggaaaaaaguuuuuugcagaucaacuuguauuuccuggaagaaaauuuccuauuuuaccucagcuuccuauuuaauguauuauuuauuuauuuacuuaacauuuauuuguuuuuuauuucaccugaacuguuaguaaacuuaguaaaauuuggugccuacaugugguaacuguccugucccuuauacucagaaacguuuuccaccuuuguguccuuuaggucauuguuguguuauauuccauuuauuuuauuuuguccauuguucucucagaaauugagggucauacauuuuaagaaaacaaugauaugcuauuuaagagaauguaucauaaauugauuuguaaggaaaaguauccccauucuucauguauguauuuuacucuaaaauguugaagaaucauauagaaguuagcuaugaaaacaaugugguagagaaaguauggaucgaugccacuuaaauguuaggaagaagcucuuagagcauuaucuguuuagcuaacugcaaaacauagcagacauguggauuuuuuaauagucaucaaggaucuaacuuauaauauacacugguagaauugcuuagggggaugucugugguuuucuggacuuuuguucuucuauauagaccuguaucaguugacuuaucauucauaccacacacccuuagcuaaucagaacuaccuuguccauuuauaucuuagacuauugucuuuuuucauagucacacacagagaaaacuugaauauauggccuguguuccuuuuuggcugcucaauuccuugagaugaaauauggguauggguugcuuuggcaauuacuucuuugccguuaaccagucauucaguuuuauugagucuuuacagcauaccagaggcugcuaguuacuagugauauagugggcaacuauguucugguucucaagaauauucauagucaauaauaagcauaacauagugauaauaugauacuuagggagauacauaaggucauauucuggcauacucuggagagagauaccguaaucagccuugaggugcaggaugugaucuguaaacugagaccugaaguauaguuagacugguaagaggaaugaggauauauauggugguuaauaaaagaacauucuggguagaagauauagcauuugcuaagaccuagagguaagagauguuauggaguauuuaggaaacuacaguuauucauuuugacugaaauauaagugaaaauagcuuucauagaguccuuacuaugugccaggcacuucauaugcauuaauucauuauugcuuauuugauacuugucauaugagauaguugucauuucugccaugauacagaugaagaaauggagacacagaaagaguaauugcccaugguugcacagcuuauaaaugguaaagguaggauuugaaaacagucuuacucaagagucugugcuaucuugccuucccaguuuuauuuuuuaugauccucuggagagauaagcaagggccaguuccuaaugaauuugguucuuuuccugaaaggagccagugaagaguuuugagcacaggauaucaugaucagaucuauacuuuaaaaguuuacuguacuuuguagagaguggauugaaaagggccaagacuaguaaggaaacauuuguguuaauucagggaagugcuaaugauggcauuugccugagaaagacaagugugagagaaguagauguaauuggauguggugaauguaauugguuguuggaggagagggaggauggagagucugccuaauuuuguggguugggccacuaaauagguagauagugccauucauuaaggaggaacacaagaggaauuuggaaagcuugagauuauuucaguuuuguagauguugaguuugagguucuucugggcauauucaaaaaggguaucuguggauauggaauucacaagagacccuguacagaugaugaggauuuaugaaucaucaauguagacauuauugaagccagagaagugauuguaaggcacgucucugagaaaugucuaauaaagcaaugaaauaggaagagugcuucaaggaaaagcucaagaaaggagaaacagagugugauguuugagaagacaagggaaaaaaacauuaauagcauuaaaugcuuuagcauuaaguucuuggcuucucuucuuguaaaaauuucccaauucagaacacagugggauuauuaacuuucaauugauaauaauaaugauaggcaaacuucuaaaauuuguauuguaguuugcauuuuauuauaaacuuucuuuaaauuuuuauuuugaaaaaugucauaucuucauaaagauuguaagaaacacacuguugguguuaauguaaauuaguucaaccauugugggagacaguguggcaauuccucgaagaucuagaagcagaaauaccacuugacccagcaaucccauuacuggguauauacccaaaagaauauaaaucauuuucuuauaaagauacuugcacacauauguucauugcagcacuauucacaauagcaaagacauggaaucaacccaaaugcucaucaaugauagacuggauaaugaaaauguggaacauauacaucauagaauacuaugcagccaucaaaagagaaugagaggucaagcguggugacucaugccuacagucccagcacuuugggaggccgaggcaggcagaucacuugaggucaggaguucaagaccagccuggccaguauggugaaaccccaucucuacaaaaacaaaacaaaacaaacaaaaauuaacuggucaugguacuguaugccugcagucccagcuacuugggaggcugaggcaggagaaugacuugaacccagaaggcagagguugcagugagcugagaucgcaccacuggacucuagccuuagcaacaaaacuagaguuugucucaaaaaaaaaaaaaaaaaaaaaccggaacaagaucauguccuuugcagggacaugggauggagguggaagccauuauccucagcaaacucacacaggaacagaaaaccaaacacugcauguucucacuuauaagugggagcugaacaaugagaacacauggacacaugguggggaacaacacacacugggacccgucaaggggucggggugggagaacaucaggaagaauagcuaauggaugcugggcuuaauaucuagguuauggguugaucugugcagcaagccaccauuguacacauuuaccuaaguaacaaaccugcacaucuuacacauguaccccagaacuuaaaaguugaugggaaaaagaaaaacaauaaccacccacauacccuucauauagauucaccaguucuuaauguugugccaacuuugcuuuaucuuuuugucaguauuuuuacacacacauguauuucucugucucuuguuuguucaaucacauuuuuugcugagucauuuaagagcuaauugcagauaugauacuuugcacuuaaauauuucagcuugucuguuugaaaaagaaagauguucuccuacaaugaacacaauauaauugucaugcucaggaauuuuaauauugauucaacaccauuaucuaguccauaaugagauuucuucuaauggcccaauaauauccuucagucuccccaccuccaauauccaaaguucugucaaggaucacauacuacauuugguucuuuauuauagacuuuuuaaauaucguuguauaccauugugauucuaucgucuccuuuaauaaagaggagaaccagaaaaaugaaaggucauaagaggaaugagguuuggagaauaggugaaaaaaggcaucauaauguuuauaauaauguuugccuguucagagaaacaagaaucacagauaaagucacuuauauguagauaagagaaugcuguauuacuuuuugcuauucuauucacugaucauuuuucuaagaacucuguaugcuucuuguuuaacucuuaugucagcauguaugagaaaacugaguuaaagagauguuaaguaacucauucaugcuuuacuagaaauugguugaugagggacauaaaccuaggccggugugauuuuagauugcuucuuuuaaccauuguguuguauugccuuauauuucuaaguaauuuauguucacugagagcaaauaauagucuagcuaugacuuagaaaaguaaaauaaagauguugggcagaaaaccauuuuauuagggguuuuuuuggaggagcagauuaauuuguuucuguauucuuugguuaguuuguguguguguucuuuuuaauucuuuaaaaugaaacuguuuaauccuuaaauccuuaaguuuugaaaauuuuggccuauuauuuauguguuagguugauauuaaauccuuaauagcuuuaacauuuucuacuuuguuagagaggauuuaaaauuuaaguagauaagcugaauaucuggcuuuauauuaaauuacugcugauggccaggcacaguggcucaugucugaaauccuagcacuuugggagguugaggcagauggaucacuugaggccaggaguucaagaccagccuggcuaacacagugaaaccccgucucuacuaaaaauacaaaaauuagccaguuaugguaaugcaugccaguaauuccagcuacucgguaggcugaggugggagaauugcuugaaccgggaggcagagguugcagugagccgagaucgcaccacuguacuccagccuaggcgacaaagacuuugucucaaaaaaaaaaaaaauuacugcugaauuuuaucuucuucuuauuuauuuuuuuuuuuuacuauuuuaguuggcucuucgaaaugaggaggcagaaaaugaaaacagcaaauuaagaagagagguaaaaaauuuuaguaguuguggugguucaacaaagguacuuauuaaaauaaguaccuaaguuuacauaaauuuauauuuuaaccaggacuggagucuucuaaguaacugauguuuucagacugauuuuaugguaugacuuugucucagggaaauagaaaacaaagcaaaaugugaggccauuaaguauuacauucaucucaggucuaugcggguaaaucuuuuuuuguuguuuuauaagccauucuuugcuaguuuucuaauugaauagaugacuggauuucuauucuuauuucucuuacccagaauccuuuaaaauuuuuuguuacuuguggaaucuuauaaauucugauuaucauuugguucuacugagccaaauaauguuuguacauuguuuauucugauagaaguucuuaaguuucuaacauaauugaaauauuauuuguuuugguagauaauuaguauucuuucuuugguuauucaagauaauaugcaucauuuucccaaaauuuuuuuguuuucuuuaguuucugauuauuauuuuuaauuauguauuaccuuucucauuucuaauuaccguuuuccuguccuuuucuguagaacaaacgucuaaagaaaaaggugaggcuuuaaguguggugaaaucuugggaauuuaaaauauguugugagagcacuauuuagaggauaugauuuuguuauucugaauaguuuuguaauugaauguuguguuugguuaccuucagaaugaacaacuuugucaggauauuauugacuaccagaaacaaauagauucacagaaagaaacacuuuuaucaagaagaggggaagacagugacuaccgaucacaguugucuaaaaaaaacuaugagcuuauccaauaucuugaugaaauucagguaaaauggcuagaagucaauucagagcaaugguuccuaaaaacuuuaauuucauuacaauguaaauauaauauuuagcccuacauguaaauucccugguauaaaucugucacuauguacuuguaaaaugugaaauaaauuacaucuuugaaguugcaacuuuuuagccauuuuuauauuugccugucuuggucauuaagaacaauugagguccuuauguacuauuuucuugauucaauuugauuuaauuggucaaugccaauuaguaaaggucuauaaagaauucucuuuuuuucuagaggacacuuauggcugcguuuaauuuuaauuugguuuaaauuucaguuuuuuuaaaauuacuuuuuaauuauagugucuuuaacuuuuuuagacuuuaacagaagcuaaugagaaaauugaaguucagaaucaagaaaugagaaaaaauuuagaagagucuguacaggaaauggagaagaugacugaugaauauaauagaaugaaagcuauugugcaucagacagauaauguaauagaucaguuaaaaaaagaaaacgaucauuaucaacuucaaguaagaauuacuuuuagaauaacuuauuuauucagacuucauauuaucucauuacuauuuauuugacacuagaaaguacuuuuucuaggaugugaauuuuugucugucuuuuuaauaguguaauaucuugucauguugguauauuuguccauauguguuucuccaaucaccucacaaacacuaauuuuugcaauuuaggauauauaaaugauacuugaaugaauguguagauagcagucauuaugggguuuucuauaaaagacuacugaaaauccuguggaucauaacauuucauuuuaucuuaaaauaaauacauuauaaauguauuagaaaccaauacauuguucaguauuuauguggauuaaauuuguuuaaaagguagaauaauguuuaaaaauaaaauuuucuaguaaugaaagauaauuaugcaauuauaagaugcagaaacuauuaaaugucaccuauaauuccaggaugacuucaaugauaaauacacauauguaauguaauguauccguauguauguguauauaaguaugaauacguauguguguguauguagauauauuuauauauauaauguauauguaaauaugcacagguguaaauauauguuacaucaguuugcaacaacucuugaaauaacuuugucuuuuaggugcaggagcuuacagaucuucugaaaucaaaaaaugaagaagaugauccaauuaugguagcugucaaugcaaaaguagaagaauggaagguauuuuuuuucaauugacauaauaacuuuuucuuuuuguauuuuagauuuaaauuuuagucuuauuuuucuuuaaaugucuuauacugguuuauaacacguuuauuaggguuuuuaaacauaaguuuauuuuauuuauugguuagaaaagcucuagaacuguccuuuuugaucucuagcuaauuuguuauugaaugaccucuuucacaucaaugaguuuaacuuuaaacuuuuugauagaagucuaacuccaaaauauauuuggcaucuaaaauauauaauucgaaauauaauuuaaauuuuuuuacuuaacucauaguuaccuuauauacauuaguuaaauaguugcagguuuaauuuuaguuuuucuaacuaaaugucagguucaucagugggaaugggaauaagcaaagggaucagaauaacuugggaagccuuuucaaaauacacuuuucuuccucaccaccacucuccaaccuuaaccaaauugucaggccuuaccauauuagaagcugggauuaugaugguuguauacuugaaaaacaucagagauuauucugaaugaauaauucuaauuuuaaaaacuaucacuucuagagucauugcuuucuaguaugguucacauaaaucuugugggcaguuuggaacugguuagcaucuagggagcucagauaaccuauauuuuaaacaaaagcauuagcaauggaaauaaggccuauagaaucagucaugucuccauaaacuuuauauaaagggccagacagugaauauuuuagaccaccuggucucugcuauaacuaaacucugcuuauagcaugaaagcagccauugacaauacguaaaugagugagcaaggugguuuuccgguaaaauuuuauuuacaaaagcagaugggaggccagauuugaccuuugggccauagucuaccaaccccuggaaaaaacaguugucuuuaccagauugaauguuggcaggguaaauggugacauguuauauguauucuguacuuuguuuugacuuaauaccauuucauaauuauuuuauaucaguacguauaguauugcuguucuuuuuaaaggcuauguaauuuuucuuuuuauacagguguuaauuugauaauuugugaaguuuaugaaguuuccaauuuugggguuguaaacuguuuuaaugaauauccuuauauauguuauuuugcaaauguacaaguauaucuguggaauaaauugcugcaaguguuguaauugucauguauguugcaaauacauucuaacaguuugucacuuuuuuugcuuuauggcauuuuuugcugugaaauauuucuuuuuaugcuuaguuaaauuuauuauuuuuuaaugacuuuugacauuuguuauaaugagaaaggcuucugaguauaaacuuguuuucucaucuuuucuccuaauaucuuguuuuguuuuuguuuuuguuuuuguuuuugagacagagucucacucaguugcuuaggcuggagugcaaugguacaaucucagcucacugcaaaugccaccuccuggguucaggugguucuugugccucagccuccugaguagcugggauuacaggcaugugccgccaugcgcagcuaauuuuuguaguuuuaguagacauggggucacacuguguuggccaggcuggucuugaaccccuggccucaagugauccuccugccugggccucccaaagugcuggaauuacaggugugacucugccuggccuuuuuuuacauuuaaaucuucgaaacauauaauucauuuugauguaaggaguaucauguggauucaacagagcuacucuguuguccaaacaucuuuuauugauuauuucaucuuuuauugaauugauugaucuauuuucuagcaguguauacuuguuuuaauuuguguauguuuuaauaucuaaaaacguuauuauuuuucugcuuuuagacuucuuuaugaauauuuuuaaugugaauuauagaacuggcuuguccaguucuuaaaaaauaucuuguggauuuuuauuggguauguguuaaaguuauaaauuguuuuauagauugauuuaggauaaaccuuuuuauguuauuugguccuucuagcuaaagaacacaagauaccuuuucuuucauucauucaagauauuuuaugccucuugguugcauuuuaaugcauacuucauaaagaucaauuguauaaaacuuuucacaguuguauggaaguacuucuuguuuauaaaugaguuuugaaagguugaaauauuuuuaaagauugaauuauaaaaaaagaaaauucgguauauauuuuaaaaucauuuucuauuugaauuucagguuguauauacaaaaggaacagagauuaugccaguaguugcucauacuuucucauuucaaauaauuuuuauuuucuguaucauaaaucuacuaacgguguuuauuauuuaugauaaugaagaauguuuuauuaacuuuccuuuugcauaacagauucuauuguguuuauuucuagcuaauuuugucuucuaaagaugaugaaauuauugaguaucagcaaauguuacauaaccuaagggagaaacuuaagaaugcucagcuugaugcugauaaaaguaauguuauggcucuacagcagguaaaaucuuaacagaauuuuguuuaucaaccaguuuuauuacaguuggaacucugaacgaugucuuuuauuuauuauaucaucagugccuaguguagcggcugguacuaccaaguguauaauaaugucuuuugaaauuucuucuaccaccuggucccaauaaaaaauuagaauuaaguuuagaucacggauuagacuuagaacuagaguuacuguguuuauuuuucuauguuuauguggauaguacacacauuguuuugguuagaaauuauuuaacaagaaaugauuaaaaacuuuuagaaauuuaaaauaauuuuauacucuuuuaagguuuauuuuacuguaucuuaguccuaacauacccuauacaaugugaaauaagcuaaaagcaugguuauaauuugacugugcuaccuauuuuauuuuuagugaaaauaacccaaauaaaaggaaguaauacuuuuauuauuugugcuguaguuauaguccacaaguaagaagaugauuugaaaaguguaugcugaauaagaacaauuacaggggacaacauuuuuuaauaaaguacgaaaggggaaaaagcuaaguugaauaaaagagaaagcacagagcaaaacagaaacauacaaaaugguaaaaagguggaauugaauggaggaugaggaaaguaacauauaaggaaguauagaagccauaaacauuagggaguucuggaaauccuauuuuccagaguguuagccauuauauccaucuuucaguauuggaguaacagcaguguaccuaucauuguguauuacaguugaaguguacaaaaugguaaaaggcauacuuguacccacaagaaaauauguucuacagucuuguugaaaaaaaucagacguacuuuuuuccuuaccuuuuuagguuaauauucaugaagggauauauauuguuuuaaaauauuuuauaggguauacaggaacgagacagucaaauuaagaugcucaccgaacaaguagaacaauauacaaaagaaauggaaaagaauacuuguauuauugaagauuugaaaaaugagcuccaaagaaacaaagguauuuuuauaaauauauaguuauuuuauauacaauuauguuuuuaacgacuuuauuuuuauuaaaauaaaaugucaagucaauauugaguuuucuccauuugaauuuuauauuuucaaaaaauuguacaagauauuuauuauuauacuuauauuacuagugcuuacauuuguaaaugauggaugcauuuucuauuauuuuucuccucuggugaaaauuacauuaacguuuauuaccaggucacugguaugaaagaaaugaaaaauugugauacaauuauuuuuauuuaacuuuuuauaauuaacaaagaauggaagauaauaaaauuuugaccaguguaacagcauugcagauaguuuucagagguaauuucacauuaaucuuacccaaauuaauguuucaucauauucuccuuacccugagccauauuaccuuuuuuaacacaucaaauucuaugaauauaaguucuuacaauaucuguguuguuauauuuccauagcacuacauacuauaguuaugccagggcacacuagugcgaacuguucaugggaaauucauggacauguuuauuauaauuggugacuauguauauauguauacacuacauuuauacacacgcgcauggaaucacuauuucuucuucaugucauauauauauacauauauacacauauauauacaugucauauguguguguguauauauauauauuuguauauaugacaugaagaagaaauagugauuccgugcacauauguguguguaaguguagugauguguuugcagguacgguuguaauuucaaaaaugaagcaaaagccuugcucaggagauaauugaaccaauacuuaaaggaaguaaaggagugaaacaugcagauggcucuaagcagugggaauaaguucaaaggcaguaaagcaggaguguaccaaucaugucugagaacaacaaagaagucuuuuuggcuggaguagagucagcaagugaggcagugauaagaccagagagguaaacagaggccauaucauauggggccuuauaguucauugugcagacuuggcuuuuaagugagaagggacaccggggaaaguuucugaagauagaaaugauauaauuugacuuaggcuguguuugcaguagacuguaggagugguaaauaagaaucagggagaccuguuagaagacuauugcaauaaucuggagaaaagugauggugguuuggggcauggugguagcaguggaguuacuggaugcagcaguucuggauguauuuugaaagugauaaaaauggaauuugcuaacagaucagauguaggaugugagagagagagaacucuuggucugaaccaaaaguuuuggucauggugggguugugggaagagcagguugagagauaaucagguacuuaauuuuagacauguuagguuugagaugcuuauuagacauucaagugaagguguuaaguaggcacuuguauauaaaaguuuaagguuuaggacaacaaucuaggcuaaagauauguuugguaacugucucuguaaaaguaauugaaauaaugaggcuggcuaagaucaccaagggaguaaauguagguuaagaagaaaaaucuaaagagcuucuacuuuagcagcuggggagauaaaaaggagcuaccaaaggagacugaaaaggaaagcccagagagcuaggaggaaaagcaggaguauggagagcccugaaaaccacaugaggaauguaaccaaggaagaagaaacaacugcuuucagagcuguguucauugcugcugauaggucaagaugaucacuaaaaguugacuauuggacuuagcaauggucauuuuugguucaagagaaaauggguagagaggaaauguaauaaagaaauauaggaacccuuuuccaggacuguuucuauaaagagaaggagaaaacaaggugguagcuugaggggaaagagggauuaagaaaacauuuuucucuuuaagauggaagaaauaacucaugauuuuagguuaauaggagagcuccauuaaagaagaaacauuaaugaaucaaugaaguggagagagagaacuucuggaacaauaauauuuuuaagaaugcaaugggaugggauccuagugugccagugaagagguuggccuuaacuaggaacacagaguucauccauaauuguagaaaagaagguagaguguauagauaucgauguagguggcuugguagacauccugguaaugggaauuuguggaaguucuaaacugguugcugcuuuuuucucagugaacaagggagcaagguucuuagcugaaggugaggauaggagaagauguuucauaaguuugaggagaaagaagagaagugaaaguauaaaauggucaucugaaagauugaagacguggagaaugugguaugacuguugaguaacuucaagagcccacgauauauauauguauuucuauuuauguguuuauuauauuuguaucagaacacuuugaaaguaguuuaaacugcuuuaaaaggaugacuaauaguauggauugugcguauucuaauuacuaggagaaaaaguggcaauugaucucugcugucaaauaaggaaaaggacuuaucugauaacacuuuagucaguccguaguuauauaaucccuaaagcucacagaagguguguguacuagacuguacucuacaucuugaacuuaacuuguaaaacguaauggcuaaugguauucuuccuucauaagauuaggauuagguuuaguuaucaggaacagagagcugaagaauaauggcaaaaucaagauagacauuuauuucucaucuauguaauggccuagaauuaagcauuccaggguguugccuucaucugccccauccaaaauggauggaaugcagcuuuaucucaugucugugucccaaacagcaagacagaggaagaggggcaagaguuaaaagcaugugcugaaggauaggcagguaaauauaguguuuauuguguagggccauguggaagaaugauaggagaauagauauguggauggaagggagaauagauacugggggacaacucagccugugucauguuccacagcuuagauguuagcuccagacagcugugcucauuucuuaaaaacuuuugugaucucaaacguacuaguuuuaugccuaaguccaauauuaaauauauaaccuauauauuaguaaaugcuuauaaugaaugagugugagaaugaucugucaaucaauuuuggaaugauagcaauauuauguuuuggucuuuuaacaauuuaguaagauauuacaaguaggcauuuaggaaguuuuuagcuuaguuuggauuaaauuuagcugcaagugacagaaaaaucaagcauaauacaauaauuuaaacaagauagaaauuuauuucucuauaauauagacaaaguugaagcaacuagggcaggauuugugugacagaugcucaaauauccccuaucaggaacccugucucuuguugcugugccuaucucaacaugugguuucuaacucaugugaaguugccacccucauauccauguggauuucagcuagcaggaaggaggaaagagaagagagauuacuccuuuauuuuaaaaacauuuuuuuuuuuuuuuuugaaauucacauaugaacuuugcguuuauauuccauuacugacaugaccacacauagcugcuuguguguaaguggaaauuuaguucuuuauuucaaauggccacgugucaagcuaaaaauccauaguuuuaguacaguggacaaaagggagguuaaauauuaggaacagcuagcagucuguaucacaaugaucauuuuuuguaaagcaguauuuugcaaccuuuuaaaauccauaccccuucagcuaagaagguuuuacugaacuucaguuuuuuaguaaauuguauuaguaaaaccaaaacaaaacuuucaucuuacaaauauaaaaugacaacuuuaaaggauuuuuuuuuaauggcauaccacuuuucuugccaccauguugggaucacugauuugaaggaauaaguagucaauucaauucaugauuuuuguuuuuacucuguaggugcuucaacccuuucucaacagacucauaugaaaauucagucaacguuagacauuuuaaaagagaaaacuaaagaggcugagagaacagcugaacuggcugaggcugaugcuagggaaaaggauaaagaauuaguugaggcucugaagagguuaaaagauuaugaaucgguauguauuuuuaucuugucauucaaggagcuuagaauuauucuugccauucacagacuauucugugcuauuuacugcauaccauuuaaaaaacauuccauaaguaucuuuugauaaagauuauccucauuaauuuauacuaaacuauugaaaccuuugagcauuuacuuuuugccagaauuguuuucaaacuuuugaucacagugauuuguccaaauaaucaguuuuggugaagcagcaggauuacuuuuuuuuauuaucuguguucauugggccaccauguagaugugacaccacuggccaauuugacagaauuuaugacaggaacauacugugucaauacaaccugcucuccacuuuuuauacuuuuucauugguuacaacuaauucaagcaacuaaugacuuacuuauucuacugguauugcugauuugcuuuuacuaauucuuuuaguauuuugguaaguguuuuuuauauguaaugcauauucagagucacuuugccuuuaggauauuauacuggaaaguuuuaacuguugcauauuacaucauuauuauuacuggauuugguuuauaaaagcacaauaaaaaaccaguguaaugauauaaauuauaggcauauguacauuuuccuuuagacuuaguaaaaaaaaaaucaugaacuugauaaauuuauucaaguaaaccauguuauauuuuaaauuaaauuggauauuuuucagggaguauaugguuuagaagaugcugucguugaaauaaagaauuguaaaaaccaaauuaaaauaagagaucgagagauugaaauauuaacaaaggaaaucaauaaacuugaauugaagaucagugauuuccuugaugaaaaugaggcacuuagagagcguguggguaagccauguuuuaaguuacauaguuugcgcaaccugauuuacaagucuuuuuuuuuaauuuaaauuuuguuuauuauuauuuauuaaguaguuuaaugcuuuuuucaaaugcuuuuauaaaacauuuaauacaaauaaaaguggagcuaaccugauugaaguggaaucagauuuuaugggguuggaguggugggugggcagggcuggaacauugcuuuauuuggucuagcaucuccucaguaauagcugcuuguuuaaaaagaugaaaguuuauuaauaccacauaucagagauuaaccuuuuuuuuucccaacaaaaguagggucuguauuacccauguuuguuugcaaaaugcucuuguaacagaugagauauuuaaacuucuugcucuguguugugauucuccugccucugccuccugaguagcugggauuacaggugugcaccacuaugcccggcuaauuuuuguauuuuugguagagaugggauuucaccauguuggcuaggcuggucuccaacuccugaccuuaagugauccacccgccuuggccucccaaagugcugggauaauaggcaugagccaccgcgccuggccuguuaaaaucuuuuaaagauuuuuaaguacuugauuuuuauaauuuagacuacuuacguuuuacuuuguucgaguauuuuaaggaguaauuaguaauauagcuugagaguuuauauauuuauuuuaauaaauagccuauuaguuaauauuacuaauuugaguguuaugauagugcagacuaaguugcugcuuuaaaaugaaaauaaauaucuaaauaucaauuucauuauugcuaaauuucauuuaaugcuuucuuaguuaaaaaugaucauuuguaaaaacuauuaucuaaagaaaagacaaauagacaaauaaguauuuuauacagauauauaugugugaaaaguaucuaacuuggauccguaguugugcuaggaccccaaauuagacuucugaucaacuuggacuaucagaucacagccuucugaucaacuuggacuaucagaucacagccaagaaucuggaaguuccuaaagaugacuucuggcccgucuagguagcugucauagacaucauauuuucugugcuuaaaaagcuccaaaucuugguuuauaauuucauuuagguuuuuguuaggauuuccauuaauaauugugauaaaauuuuaacuuggguuacaguuuaaauaucuggaaaauucuuucacagaaaguuaccucauucuucagugauacuggcuaagugaauuauaaccaguugcuugaugguauaugacauuuuugcagcuuauuugaauguuuuuaaguuuuuaauuauauugcuuucuauuguaggccuugaaccaaagacaaugauugauuuaacugaauuuagaaauagcaaacacuuaaaacagcagcaguacagagcugaaaaccagauucuuuugaaagaggcaagugugguagucaguugauuauuuucuuggcugaacuauagagaaauacuaauaauuuauacuuugcagauugaaagucuagaggaagaacgacuugaucugaaaaaaaaaauucgucaaauggcucaagaaagaggaaaaagaagugcaacuucagguauacucaguuauucuaaaccuuuaaaaagaauuauugauaagugaguugucuggauaugaaauuauuugugucuuagcuguuuuugcuguucuauuguggaucugcuacaaauuuaauaaaugacaauaauaaccugaaggagauaagugagugucaguggguucaguccugaaucugaaauagacaaaaacaaaacaaaacaaaauaacaaaaaccaagcaaacaaaaaagaaaaaaaccuuagaauuauggaauuuuugaaaaguuuuauaguauaguauuuuaauuucuagacagcaccaauauguuguuauuaauaauaauaaaacuuaguaguuuuuauguuaauauauguuacucaacauuuucccuuuccuuaaggacuaugcauugaaaagcuuuucuuguaaguuauuauuauuauuauuauuauuaauauuugagauggagucugucuuguucuauugcccaggcuggagugcacuggugcgaucuugcucauugcaaccuccgccucccggguucuagugauucuugugcuucagccuccugaguaguugagacuacaggcgugagccaccacgccugacuuauuuuuguauuuuuaguagaaacaggguuucaccauguuggcccaggcuggucuugaacuccugaccucaagugauccauccacuuuggcuccccaaagugcuggaauuauaggcgugagccaccaugccuggccuuaaauuauucuuuucuaagugaaaguaauguuuuauugaauauaaauuaacaucuuucuuggguuuauuuuacuugagcuaaagagaacaguugguuaaguuuuauaauagccauugcagugcuuuuuuguaagaagaccacacagaaggacugucuuuuucacuugccccaaauccccaagcacguauaugaguaauagcagagugguucuuuuuagcauuaugauuucuauaauacauccaaaacuuucucaagaaaaaacuucaugauuuauuaguacaauaaucaguuuacucauuacucaucauuuauauuuacuuuauaugucuuuuaacuggugcuuauuaaguagcacuuuaauauagaauaggcaaagaaugguagagaagaugaaauucaaaaauuagguucucacauuauuaauaguucauuaaaagugagcuaaaugagaagcuuguauuggcuauguagaauuuuggagggauuuuggaaacaauuauucuaccuuugcauuaaaacuugauuguagguuuuaagaauuaaaguguuggaauaguaggaggguuauuuuaauguuuuuaguuuguuaauucucuuauauauaggauuaaccacugaggaccugaaccuaacugaaaacauuucucaaggagauagaauaagugaaagaaaauuggauuuauugagccucaaaaauaugagugaagcacaaucaaagguaauaguaaaguauugcaaagagaguaaaggaaaauauuuuuuuuuuuuuuuuuuuuugagacggagucucgcucugucucccaggcuggagugcaguggcgcgaucucggcucacugcaagcuccgccucccggguucaugccauucuccugccucagccucccaaguagcugggacuacaggcgcccgccaccacgcccggcuaauuuuuuguauuuuuaguagagacgggguuucaccguuuuagccgggauggucucgaucuucugaccucgugauccgcccgccucggccucccaaagugcugggauuacaggcgugagccaccgcgcccggccaggaaaauauuuuuauuguguuuucauuucuucccccuuuaucucauucuugaacaucuaaucuuauuauuguuguuaaauaaguagagggaaauauuugcuuauuuaaccuguugauucaaagauugauuaaugagacauuauuuacucugaauacagauuaggaguucagauaaagcagagcugcugcauaggagaucaucauucaauaccccacagucagaucagaaugagacagaagagaauaugaccauaggaucauuaucaagaauguuaucugaaauucaccauaguguagaaaguggaaugcauccuuuugucccuuuaacuagacuuucuucauccaugcaaguuaaagagaauucaacuccagaaacuauuacaauaagagagauuuuuaaagcaccaugucugcagucuucaagaaaucuagaaucguuagucagcaccuuuaguagggaaagccaugaagaaauaaaugacauaugccuuuuuucugaugacuguaugaagaaggugucaagaagccaucaagcacuagagaagacuaguuuuguacaaaaaagcaauucaucuuuucauggcuuaucaacagcuucagacauaaugcagaaguuaucacuuaggcaaaaaucugcaauauuuugucaacaaauucaugaaaauagagcugacauggauaaaucacaaguagcaacauuagaagaagaacagguucauucccaaguaaaguaugcugauaucaauuugaaagaagauauaauaaaaagugaaguacccuuacagacagagauauugaaaaauaagcuuaagguuaaucuuccagacccugugucuauuacugcacaaucaaaauuaucucagauaaauucucuugaaaaucuuauagaacaguuacggagagagcuaguauuucuuagaucucaggugaguuuuucuccaaauuauauuucugugguuguucuuuuaugacgucucuaacaaaguucuguaacaauuauaguuagaauauuuuuguuugcacuuuaacaucaguuauacacauuguacuuuuuaaaaucuaaaaugcaguacauugauaugaacucauugacuugucuaauuuauuaaauuuuucuuuagaaugaaaucauagcacaggaauucuugaucaaagaagcagaguguagaaaugcagauauagagcuugaacaucacagaagccaggcagaacagguaguguaaaggcagaacauuaaaagagaugauugugguacuaaagacaaaaaccguuauaucuuuuugccucuuaccauggauguugggagagggagaaagugggauuaagaucaccaucugcuuuacuguuuagauuuuaguuuauuuuuaugauugcugcuaugucuucauagcucguuuuuuuuguuuuguuuuguuauacuuaauugaucaaacuuuucuuaacuugaaaauuauagacuugugauauuuuguugaaaaaaaucaauuuuauucucucugcuuuuuucagaaugaauuucuuucaagagaacuaauugaaaaagaaagagauuuagaaagg

SEQ ID NO: 16383 - RNA, 2494 nt, Homo sapiens
aucaccucauuaauuaguugagaggauuaaauaagauauuauuaagccccagguacuuagugggaagcuuaaaacaauaguugcuuucuccuacuucucuucauuggcauugagacauaaauuaguaucagucauuauggagggcaucgcucuacaaauauuuugugaccuaugcauauguauuggaauuagguaucagacacuagugaaaaagcgugggagagaaauaauuuucguacuucuugguacuaccguaaacgauuucugccagcauauggauaacuuuguuucccacagauaauccuaauccugaucaugguggacacagcucuccuuauuuuccuaaaauuuucucaguuguuauugauaauguugguacuguauuucaguuucuuuauauaucaacauuaaauauuugccugucaccaaaaugugaaguaaaaagcaaaaaaaguccuauaaaagguuuauuuugacuguuuuuauuuuuucacguggcgcaucuaucaaagagcauuuauuuacucauggcaggggaggcguaucagggaaucaaaucuaauuuaauuucuuaacuuuuaauuuuucaaaguugggauuggaagagaggcugagaaaaaacucucuuggcuguuuuaaaagcuaaggauuaguagcaauguucugaccugaaauuuaggucuugugauuucuuuccaagagauuuuucacugcaugaaaaaccuguuugcaauggccuuuuuaauuuaauucaaucuuaauuggauacgaaccguaaaaaucuaagggauuguuaaaaggccuaaaagugcacaaaaguaguuuuuaagaguaauauuaauaaucuggaagugaaaaauuaacuuugcuaaauuacugaaccuuucuaccuagcuucuagguucauuuuguauuucuuucaaauuuugaacguuucaaggacggaaaauuucauccuuagagcauacgcacuguuuaggggacgguucagccauuuucaaaaggaggcuaagcuuuguguucagagguguauauuuuaggaauucuccacguggcuuaauuacgagcaugccuugauuguuagcagagguaagucaggcuucaucuuguaaugagaccccuuggaaaaaagucugcugcugaggcaccaacacagggugggugagggccagcuuucuaaaacggccuuucauaaccuggcgagaaucacugagcgcuaugaggccaccgccugacggagaagccaaugcccagaggcuuuuucuuucgcaagagauguaaauggccggcuugggggaauagguagggaaaaggguucuuugggucacccauuuuuucuagucccauuacugacucuuggagaauauucagauggugccagguagcaccaugccuauuauuauucucacugagacaaaagucagcggcugguaacugguguccauucuuucgcuugaguggguuggagaaagacggcauggcuggaggaauuuguuuuguuuugcuuuggagcgggcuuccucaguugcauccugcaucgggcgggcacagccccgggcucugggaagacgccgcucggcagccgcaguggccgcugcaucaauggguuuuggggcagggaggugcggagcccagccugcgcuccuggcuaccccuccgcgccccgccgccgcccacagccuacccuucuccucugcagccgguaggcggccguaacacgggcgggccgagcacgugggcgccuccgucacacccucacacauacacacacgcgcgcgcgcacacacacauacgcauguacacgcgcacccgcacccgcgcgccuguaucccgugcuguuucccuggcagacacacaggcgcucacgagucucuccuugccagccugcagggcggcgacccccaaaacccagcuccgggucccaaccuaggcaagaagcugcuucucugccaacagcuccucuucggccuccgucacagccaccuggacccuacccuuucgcgacugcugcugcugcugcccggacguggaagcagcaagaggcgcuuggucaagacacacugacgguaauggcaagcgccuacgcuaagggcacaacugggggugagguggggcucgccauuagccacccaggagccugggcaccagcaccgggaacgaauugauggauggaugccgggaaggacucgcugcguccuggggugggaggagggagggcagcucaaaagcccugggagggagaagcugggcugggcgggcaaccgucuaacucugcaucucuguacaaucaggguggggggcgacaggcugcacauguaaggggaagcacauggguugaaacgugccgccauccuuucuucccgucguggaaauugcccacagcauccccagagaccuacucguuuccaagccaagucgggguugguugaagggugggguccaacacgggaaaguccaagaggaaaguugggaggguuggggcagagagagacgc

SEQ ID NO: 16384 - RNA, 2494 nt, Homo sapiens
gcgucucucucugccccaacccucccaacuuuccucuuggacuuucccguguuggaccccacccuucaaccaaccccgacuuggcuuggaaacgaguaggucucuggggaugcugugggcaauuuccacgacgggaagaaaggauggcggcacguuucaacccaugugcuuccccuuacaugugcagccugucgccccccacccugauuguacagagaugcagaguuagacgguugcccgcccagcccagcuucucccucccagggcuuuugagcugcccucccuccucccaccccaggacgcagcgaguccuucccggcauccauccaucaauucguucccggugcuggugcccaggcuccuggguggcuaauggcgagccccaccucacccccaguugugcccuuagcguaggcgcuugccauuaccgucagugugucuugaccaagcgccucuugcugcuuccacguccgggcagcagcagcagcagucgcgaaaggguaggguccagguggcugugacggaggccgaagaggagcuguuggcagagaagcagcuucuugccuagguugggacccggagcuggguuuugggggucgccgcccugcaggcuggcaaggagagacucgugagcgccugugugucugccagggaaacagcacgggauacaggcgcgcgggugcgggugcgcguguacaugcguaugugugugugcgcgcgcgcguguguguaugugugagggugugacggaggcgcccacgugcucggcccgcccguguuacggccgccuaccggcugcagaggagaaggguaggcugugggcggcggcggggcgcggagggguagccaggagcgcaggcugggcuccgcaccucccugccccaaaacccauugaugcagcggccacugcggcugccgagcggcgucuucccagagcccggggcugugcccgcccgaugcaggaugcaacugaggaagcccgcuccaaagcaaaacaaaacaaauuccuccagccaugccgucuuucuccaacccacucaagcgaaagaauggacaccaguuaccagccgcugacuuuugucucagugagaauaauaauaggcauggugcuaccuggcaccaucugaauauucuccaagagucaguaaugggacuagaaaaaaugggugacccaaagaacccuuuucccuaccuauucccccaagccggccauuuacaucucuugcgaaagaaaaagccucugggcauuggcuucuccgucaggcgguggccucauagcgcucagugauucucgccagguuaugaaaggccguuuuagaaagcuggcccucacccacccuguguuggugccucagcagcagacuuuuuuccaaggggucucauuacaagaugaagccugacuuaccucugcuaacaaucaaggcaugcucguaauuaagccacguggagaauuccuaaaauauacaccucugaacacaaagcuuagccuccuuuugaaaauggcugaaccguccccuaaacagugcguaugcucuaaggaugaaauuuuccguccuugaaacguucaaaauuugaaagaaauacaaaaugaaccuagaagcuagguagaaagguucaguaauuuagcaaaguuaauuuuucacuuccagauuauuaauauuacucuuaaaaacuacuuuugugcacuuuuaggccuuuuaacaaucccuuagauuuuuacgguucguauccaauuaagauugaauuaaauuaaaaaggccauugcaaacagguuuuucaugcagugaaaaaucucuuggaaagaaaucacaagaccuaaauuucaggucagaacauugcuacuaauccuuagcuuuuaaaacagccaagagaguuuuuucucagccucucuuccaaucccaacuuugaaaaauuaaaaguuaagaaauuaaauuagauuugauucccugauacgccuccccugccaugaguaaauaaaugcucuuugauagaugcgccacgugaaaaaauaaaaacagucaaaauaaaccuuuuauaggacuuuuuuugcuuuuuacuucacauuuuggugacaggcaaauauuuaauguugauauauaaagaaacugaaauacaguaccaacauuaucaauaacaacugagaaaauuuuaggaaaauaaggagagcuguguccaccaugaucaggauuaggauuaucugugggaaacaaaguuauccauaugcuggcagaaaucguuuacgguaguaccaagaaguacgaaaauuauuucucucccacgcuuuuucacuagugucugauaccuaauuccaauacauaugcauaggucacaaaauauuuguagagcgaugcccuccauaaugacugauacuaauuuaugucucaaugccaaugaagagaaguaggagaaagcaacuauuguuuuaagcuucccacuaaguaccuggggcuuaauaauaucuuauuuaauccucucaacuaauuaaugaggugau

SEQ ID NO: 16385 - RNA, 8715 nt, Homo sapiens
uccaaguucaugaaucuuuugaauucuuuccauacaacccaggaugcaagcuucugguaagacaaauggauauuuauuaagauccuguaagaaacaaggcagaaaauuaaagucauuaggaguauagaaauaaaagauuucuugggcuuucaccucuguaaacuugaggaguuuggcuaagucaguaguuggaagcguaguaaggucagaagucaccgucaacuuccguuaaaucccaaagcuuacaauuauuuaacagaggaucaccuacgcuaacagaauguugggauuuuguuuguuugggguuuugguaaauaauuauauacauucaggggucuuaguacuggguagcuuauauaaguccaaaaauaugauuguuagccuugccuuuugauuaauaaaaugggggaaauauguuguuaaaaaaaaaaacgaaaaagggcaagaaacuauuugaaaaccaggcauuggguugaauuggaagugaauacacuucaaaaggucugaggagaaaauauuagaaaccacugauuuggauaaugucuaauagcucuuuuaacucuuagucuuuuaccuaaauauccuugauauuuacagcauaguaaaaucugguuuuccaaggauucugaugaaagaaaagaaaaaaaaugaaaacagauggacaaucugagaaguaacuagugauugaugguaaaugugaacaaugcuucagaaaggaaaugaaaugucugcagcagauagaaguguguaaauuuugccuucacuuuagagcuagaaucacuaugagugguagcauuucagaaucagaagaauggaaagcucaguugauuaucauuacacauaggaguaaaaggaaagguucacauuuuuauugacagcucauaucgaaaagacagcuccucuuagagagaagugaauucuccuccuucuuguuguuucuucugccaccuuugcccucauacagcacgcucuaucuuuaucuucuucccuuuucccuccuccuuuccugucuuuucuuaucuuccuccauucucuccccauuuccuuucugugcucccucuccuuucugcacucaccuccuucaccuuucaucuguaggugacacuaaaccgagguuuaagaagagccaccuuggcugggugcaauggcuuacgccuguaauccuagcauuuugggaggcugaggcaaguggaacacaaggccaggaguucgagaccagcccagccaauguggugaaacccugucucuacuaaaaauucaaaaauuagcugggcgugguggcacgcgccuguaaucccagcuacucgggaggcugagguaggagaauugcuugaaaccagaagguggagguugcagugagccaagaucgcaccacugcacuccagccugggcagaagagugaaacuccgucucaaaaaaaaaaaaaaaaaaaaagccaccucacagaguugauggcagugugagugcugcuuuuuguacauuaccucauucaguucuggacacaggaggggucuccaaaucaugcugcgugggccagggagucugauggaagaagucauacuugaguuauggcugucucagggaugcugugaguugacuagcuugcugggaggcuggagucuggcucacacauucagaacauuugcagguuacugagacaaccaguaccaaggacuuguucuggagacuaaccagauauggaaaacacugagguaggcagaaaucaguuugugaugggcuauugaugguaaacuaaggagcuaaauggaaagcucuggcaaacccuugaaugagagagaaaugaucuaacagagaauccucuaacagaaguaggaugaacagauuaaaggaaaaaguagggggagaccaggugggaaucuuucgcaccaagucaggaaggaaauagaguugucacaaaagcugagggaaggaagaggaggagaggcaaauucaagggacuaaagagguugacucuuuagaacuuggcgaugaugugaaaaugaguaagaaagaguuuaggaggccaggcgcaguggcucacaccuguaaucccagcacuuugggaggccaaggagggcggaucaucugaggucagggguucgagaccagcgugaccaacauggugaaaccccgucucuacuagaaagacaaaagauuagcugggcgugguggcacacgccuguaaucccagcuacuugggaggcugagacaggagaauugccugggagguggagguugcagugagccaagauagugccauugcacuccaaccugggcaacaagaacgaaacucuguuucaaaaaaaaaagaaaaacaaaaaaaaacaaaaacaaaaaccgagaaagagagaaagaguuuaugaauuugucauuguauuagucuguuuucauguugcugauaaagauguaccagagacugggcaauuuacaaaagaaagaguuuuaauggacuuacaguuccauguggcuggggaagccucacaaucauggcagaaggcaaggaggaacaagucacgucuuauauggauggcagaaggcaaagagagagcuugugcagggagaccccuguuuuugaacucaucagaucucgugagacuuauucacuaucaugacaacaccagaaagaccugugcccaugauucaguuaccucccacugggucccucccacaacacuugggaauucaagaugagauuuggguggggacacagccaaaccauaucagucauaguguaugacugucuggcuucucauaguauuuucugugugaaaaaacacaggaggaaaguaguuuugagaggauggauauacaguuuguuuuugggcaugcugaauuugaggcuccacuggcucugaaacuuuuguagaguuacaagcaaauaguaucaaugucuuaacaaaauacuuaauucauuuauugugcacuugauaggugccagccuguguccuaagcauuucacauggacugucucauuuauuucuuauaauaaucacgugagguguagaaaucauuauugcgagggaaauuaagcacaacaauguuaagugauuucacuaaaguuacacauuuagaaaguggugggauauuguguaauuccauuuguuugaaaugcucagaaaaggcaaaucuguagaggcagagaguagauuaguuguugacuggcauugagaaugggauuauuguaaaugaacauuagggaucuuaaaugauuuauggugaugguugcaccacuugguaaauuuacuaaaaaucguugaauuguguacuugaaaccgauaaauuuuauaugaaaaauaaauauuuagaaaguuguaaaaaaguaaaaggauuucaaauuggaauuguuauauuuaauuuuagguguuuucaguggauuauaauagaaaaaugcucuuaaauguaguagagugcuuccuuaucagaaaggugcccuggaaauugugucuguccuuuuuuuuauuuuccuuuuuaaaaaacaaaagguauuugggucuuuuauuucuaugcuaguguuucagauguuuguugauuacuaccuacgaagcauuuuccuguuacuuccuggaaccugcuguuccugaucucuuucaggauaaugugcuagauagcuaagcuggcuuccaccucccucauuuuccuucgcuuccucucuuccugcugaauucaggaauuguguuagggaccgugaauuuuuuuuaaaaggauaauuaaaauguugucacauagcucacauucuaaaauuagauauuaaaaaaagucaguggggguuuccucauagaaacaagggaagaccuuuacugagauugcuucucaguuuauuggucuucauuuguuuuuuggcucaugggacuugaacauagguaggguacaacuuuauuuacauaggagccaagagaaaacuuccucuugcuaucucuagguuugcuaaaaaucagcugacaaaaagcagauuaauagaaaaggcauacaaaucugccgggcacgguggcucgcaccuguaaucccagcacuuuaggaggccaaggcgggaggaucacgaggucaggaguucgagaccaggcuggccaagauggugaaacccugucucuacuaaaaauacaaaaaauuaaccaggcaugguggcgggugccuguaaucccagcuauucaggaggcugaggcagagaauugcuugaacccgagagguggagguugcagugagccaagacgagaucacgccacugcacuccagccugggcgacagaacgagacuccauuucaaaaaaaaaaaacaaaaaagaaaaggcauacaaaucuuuuaacaugcauaaggggaaaaucagagugaugacaccaccaugcagugagauauggauguuuauauccccuuuuucuuaggggaaaaggagaugggaaaguguggaugauuuuagggggauaggaaaugauuuuuaggggauuucggugggcuugaaaaauauucaguggucuggaacaaagucuguuggccacgcagagcacacagugguuugugacaagucuguccagguguacugacagacuucagacuuucuuccugcaguaagaguucagugaaugaaaacucagagaagcaaccagagguaguucuuuucuuuguugggucuggacuuuaggcagauaaggaaacuuuaaagaaggacuucaucuucugccuugaaagagagagaauugagagacaggauggugggggaugggaugguagggaugggguagggauaucaaccuugaagcugcccguucaguucagcaugucaaaaaaccauuugggauauugguuucugagcccuaacauuuagaauauuucacauuuuacuguagcugcuguaaaagguucccugugacuguaucagccaugaguccuguagaaaucagauaaugacaacagaagcaauuacuuccuucuccccuccgcucguauuaucaucaucuacuuuuguuauuuucauuaggaaguaguguauuagaucauccaauguuacgugaaauugaagagggauaagagguguuuugauucuuuugcuugguuuuggaaaacuuggugucuaaauuguuucuucuuuuuuggggucaaaugaaucuaauuuugaaugcaauagggaauuuuucgauauauuuuugguauaucuuugggcaaauggcaacuugauaugcuaguuuaaauacugucuucuaaagagcaagcuuuuuauuucuagacaucuagucuuauuugugccaucagagagcuugcugguagcagaauuaaaaaucauuaugcuauuaccagucaguggacacuuguuaagaguuacugguacauucacauucguaugcuugucugguacauuuuuuuuuuuuuuuuuuuugagacggagucucgcuuugucgcccaggcuggagugcaguggcgcgaucucgacucacugcaagcuccgccucccggguucacgccauucuccugccucagccucccguguagcugggacuacaggcgcgcgccaccaugcccggcuaauuuuuguauuuuuaguagagacgggguuucaccguguuagccaggauggucucgaucuccugaccuugugauccgccugucucggccucccaaagugcugggauuacaggcgugagccaccgcgcccggccugucugguacauuuuugcugagugccaguuaaauguagggguggacauacuaucaggugcccggauuuaucaccgaaucuaaguaauguguguuuaagauugcacuauagucuaccauguguuacaucauucacuaauagaaaaugauaacauugacacagaaagccaagacuuaagguuagugaaaugcuuauaagccucuucugcuucugacauauaaguacuguauugcucuuucugcaauuuguugauacagggcucugcagugagaaagaaagguauauauagaggagauaauacuuaccugguccuguagaaauaaaacagaaauaaaaaccuccacauguaaagcaucacgaaucuuaaggguggaagcugauagggugauuuagggauguuuguaccaaugaggaauauauaucaccucugccuuugugugcccagaaguugagguccuucaagcaguucugugauaaaauucuuucucacauucggaaccugcucccaagacaaauguauuaucuguuugcugauuuuacuuuacaggcaaaaggcacuuuuuuuuuuuuuuuuuauccuggagacagaguuuugcucuugucgcccaggcuguagugcaauggcgugaucucaucucaccacaaccuccaccuccuggguucaagcgauucuccugccucagccucccaaguagcuggaauuacaggugcucaccaccaugcccggcuaaguuuuuauuuuauuuuuuuaguagagaugggguuuuaccauguuggccaggcuggucuugaacuccugacuucaggugauccaccugccucggccucccaaagugcuggcauuacaggugugagccacugcacccagcccggcaaaagguauuuuuuauuuuuuguacuguaagcgucuuaucuuaggcacuuaacuugaacaaauaaaaaccagcucuuuaaaauauucuaaacauuugacaaaugcaaagcaggaaaucaauuauacaauauacuuuaaauuuucaagguaccucuauuauuuauccagaagacauucauuuaguaaauuguuuagcacugagaaugggucaggaauuuuacuagguuugaaauuacaaauuguuagcucaguuuuuuauuuagcuucaauuauguuguaaaaaaccaaaccaaagcaaaacagaacaaaauaaagucgccaacaaaguagccuaauuuccuguaaucaggaaauuuuauucccugacucauauuuccagcuuucuuaauuaaaacaauuaaaaaggaguuggcaacaguggucuuauauccaugaaaccaaguagcaggagcaaaagagugccugcccucucauuaccaguuuuauaaaugagaacuuaacccauuuaugccugguguuccauuauuggaacacuaagcuuaugggaguuauuuauauccuacugcucaaggucauugccaaggucugauuuuuuacacacacaaaaauugcaaccucuggcauaaauggauuaaggaacacagaauuaggcaguauccauaaagacacaaaacugguuauugggcuugauuugaaacuucaucuaauccaauuaaaaagcaaaaaucaaaaaacugcuccaucuauucuuucacauugcaggguauuguggaaguugcaaaacuaagcaagacaugaacuaauauuaacuacauaugguaaugcuagaaaucaguuaaaccugaauuauaccuguagauccucauaucaccguuguaaauccaggcagggguuuuaauucccagguuucagaaagggaagcugcagaagcccagaacauaaaguauucauggccacaaaucuauuaagugacggaguccauauuugaacccugggccccugugcccugguguuggagcuuuugggauacugugaacgucaaggguuggcucaccaucugaauacuaagccugaacucagaagauguguuuuucuuauguguagguugaaccacaugacagggccauuuuugccugcuaagaaugagcaaaaauucauaugguucaauggguacuucuaaaacauacccaugcccuauuauuucugauauguuuuacuuuuauguuuguggaaauuuaacuccucauaggaaaauggaaguugguaguauaccauaggaaaauaggaaguuuuagacaaguuuauuaagauucauauagaaauuguggauccaaauaaacagauuaaacauaggauuuaggauuuagcccuacagauaccacauucaugcccauucuauaaucuguagaguuuaauccuauugauuauaaaaaugaagcaguacuuuucccuuuuaacauauauauucagaaaacugggugcuaguauauagagcuuaauacaauucuacagcuuuagaugauuuuauauauauauauauauauauauauauuuuuuuuuuuuuuuuuuuuuuuuuugagacggagucucguucugucacccaggcuagagugcagaggcacgaucucagcucacugcaaccucugccucccagauucaagcaauucucuugccucaaccucccaaguagcugggauugcaggcgcacaccaccacacccggcuaauuuuuguauuuucaguagagacgggguuucaccaucuuggccaggcuagucucuaacuccugaccucgugauccacccgccuuggccucccaaagugcugggauugcaggcauaagccaccgugcccagccuggaugauuauauuuuaaauaacccugaaucauuaagcacaguuacaaaauaagcaaagacugaaaaucaguaaaauauucacuuaaaaauuuuagugacucuuacuuugcagaugguagacucuugggaaauaguuauuagugaauaagugaaaauaucaugcaacacagguacaacugugagcaaaugccuuuuccuuuuuuauaccuaauuacucauguagcaauuuccuuugggcauaugccugauugaggaaacaugauucuaugucucucugucuuuuuuuuuuuuuuuuucguaaugucauaguguaggguaaagagcacaguuuuggcccca

SEQ ID NO: 16386 - RNA, 3847 nt, Homo sapiens
aggaguguauagacaaaaaaacucauaauuaaaauaaaauguuaagaagaagcauuaguacauguggcuacuauaauauuauauucugguguggacuacuuugauugauauuaggcacuaagacuaauaauggcuuucacuacuucuacuuaaaucugguugacuauucaggagacaagcauaucucaucuuaauaauucauugggcaucaaaaacaguagagucagauuuauauuaguaugggggauguuuuuucuuugaauaaaaaauauuucccuguucuuuuuuuuuuuuuuuuuuuuugcucugugcuucuuuuguucccaaauuucuccagauguaucuacacaguguuucucagagugggaucccugaccuagcaauauuaguaccaccugggaacuuaauaggcacguaaugaaucagauguaaugaaucagaaacucgaaggauagggcccagcaaucuguguuguaacaagcccuucuggagugucucuuguaugcuaaauuuaagggccuaaacuagagaaacuggugcaggugguaacucuucucaugugaaucggcucaccuaaugccucaugcaaaauugcuacuuuaaacagucuuucucaguuuuaauauauuauuuacacucuuugcagugaaguuagcagugauaaugucaaguuuuucagcugaaauuuacuaugaagacuguaucuucuuaacaaaauauccuuuaacucgugauauuuuuuucugccucccauuaucaaaguuuuucuuucugcgauaccuaccauggguuagccuuuaacuaugcugugucaacuguauguggggauuauacuuacaauuaaaacuuguauuugacauacgaaugggacucaaggaaaucaaaacucuucuuggaaacaguaggaacaucugagccaguaauuaacaaacguugauugccaaggaaauucaaaccaagguuuaauaaggaaggaauucuuguaaaaauagacauaauagcuauauguaaaaauaagaauaucucucauguauaaggaauuuuuauguuuuguguagaauucuagagagugaaaguuaugaguacugauauaugauuaguauguugaagcuauuacaauaugaaguuugucugaaaauagacuaggcuauccugugaggugaagaguuuccuguaguuagggguauuuaagccacaucaaauugugggucgauuggguggucuagacccuuccuccucaaguguaguaccaucugggagucauuagaaggguagaauuucagguuucaccccauuccuggugaaucaguaucuacaacuuaacaagauccauggaugaucuguaugcacauuaugucugagaaauagugcuccaguugacaucuaaugaauuuucguauuauuuuuauacuucuuauaggauuguguuguguuguaaaauuuaaauaacagucuagaauagaaguuggguaaauacaugagcuuuaccccacuuuccauuguaaagucgcuaacugaauuaaauacuucccucagaaacaaagauuguuucuuggauauuguaguuaauuuuaagugaacaguuauuuacauacuaguucuuuguuaacuuuggacucuuggcguuacacaaaaguaaaacacgucuuuuggcuuucguguagcacacucagaauauuuucaguaacccccaaaauauauucaguguuuaauccuccaauuccuucaugcauguccucuucauuuucaccaaacccagcaggauucgugacucucccucacagaaacguucccuuucugcucagaguagguacugauuuugucuccugcuuccucagucuguaugaauggacagcagcaacggaaagaaaagaggguagguaaagggagguggagauauaagggggacuggagcgcgauggagagaccagacucugcucaaagcuaaaauuuacucgggcagggaauacuuaacauacaauucccauuaccaaaacaauaugaaugaagaagaacugaagagguaaugagaaaugacagaugccgccacacccuagauuggcucaggucccuacaaccaugacuaccaugcccuggcccagugggaagaaagcugcuuaaagaaaugacaagcacagaagaccggggagccaaaaggugcccaaguccguucccauccccaccagcgcaggcugacacaagcgaaggcuguagagcccauugugugaaagaagcccaggcggggaagcgugugcccccuucccacuuugcccaucccuggcccucgccuucgcagggggcacugggagcagagcgagccucggcagcccgggagcggcucugggggagacgaguguauccgcgggcgcgugugcgugaggaggagagcaaagacgugauuacuucagaauuuauuuaagggccgguggaaaccacugcagcagcuuccaggggaagcccuuguuccagaggaagaggaggugguggcugccaaggaggaggaggggaggagacggaggaggaggaguagcagccaccgcacgaggcaagugaggagagaagaugcuguagcguccucaccggcugccagcagguugguucuuccggccaauugaagcaagcaaagaggcuugcagaaaggccgggaggagaaaaaugggugugugugcuguggcggcgggggggcggcgggggggagggaaggggggccgggggacggcguggggugauguuugccuuuccagagaaaaagcgccuccuuuaagugaaacgagacacgggagcgcgcggaaacaggcugggggccaggaggagaccuguccugcuuuuugcaucccuagggacucguuuuccuuuagguuucuaacucccaggguuagccuuaaacuccagaggggcuccaggaggggagacuggguggagaacuucucucccagauacuucucacgccuuuucuccaagcuuucuuuuggagggacgccccacacaccccggguggcccgggcgcggagggggagcggcgccgcgugguuaaguuucugaaagucaaacccaguccccggucuccggucuccgccccggggcuccagcugcacgcggggagcugcggcuguucuggcaaaggggccgcggcugcuuuaagagccgccucccccucuccuccuuugacaauggucugaaccgagcuuugcuucccaaagcaaaauuuguaauaugccauuuuuccgauggacgcuucuccuuuuggcugcugacggagccacgggaagaugccgagcuccugccacgccaccgggccggggcacguuccgggagggcgccggggcacgcgugugucugagcugccuuucuccucccguugcuagggaaaugguccaggagugcugggugugagccucccuucuccucaagccggagacugcgguugucauugaucaauugaagaagcaaggacccgaaaucacagacauuagguacagaagcugucuuugaguuuuacugucuccuuucgcuguauuuuuugaccaccuccccggccccaccccgcccccagggaagaugagaugcaaauuccuccuuguugauuaccguuaggugccuuuugcuuucaccucauccucuccaucuccuaucucucuaccuccugccuacuuggcuguguccuguugggcaggaugaacaauuuuaguguggaaaugaugaagucaacuucuucaagguggugggggguguggcugagagauaacuguccaguaguguggguugagcuggcucuggcuguccguaaaugcacuaggguaaagaaaguguaaaauguguccauuaaaggugauaaucauauuucccg

SEQ ID NO: 16387 - RNA, 3268 nt, Homo sapiens
cagcccaauaccuuuaaauauuuuauugacaauauuaguauauauuaucaagauauuuucaggcagguaguaaaaguaaauaugauuuaacucaugccuucuguuguacuauaguuauuaaaaugaugugauguuguauagucuuuuuuaaaaaagcauguguuacuguccugaauaaccucuaucuucccuucacacacaaacgacuugauaguauaugguacaguucuaagauaaaggaaaaguuucauuuagcagguucacuugaaauauauuuaaaaugaaaauaugacauuuucacuugugacaucaacaggaccuaaacuggguacaugagaaugguaaauauucagacuuaucugaaaagccaacuguuuaaguauuuucagcucacauguaaagauuucaugucaaugaacaguaauuccauugggguguuauuuuaaaagaucaugagccaaaauauuucuuguaguaaaaaauuuuauuuaugguggaauuuccaaaauuucuuauaucuugaaaugauccacaaaguacuauuuugugcuuacauuuaaaagauacauuucuuacaagaaaagaucaaaauauauacauuaggcaguauuauauuuuuauuuaauacaauauaacuaaaggauuaaagagaaaagaaauaguuaaauauauuuaaaauuccauuuaacugauucucagcuguuuuaauguuuuaaagaaaaaaauaaagcucuaaacaccagagacauuuugaugagcaauauuuauaauauauauauauguauauauaaguuaagcauugcaacaagcuacccucaaucaauggcccccuaucagaaauaguauuacuggaacuauguauuaauaucuaagcaaagaauaauaaagaagaagaaaguauuauuugcaaugaugacuuuuuaguuaaauacacuuucuuauaaaguggcaagguaaucuuuacaaauuuacaacugaaaagaaaucuuuauguacauguugucuugguuugggacuuuuugaagccuucuucuuccuguguauuaggcccuccuggaagaagucauauagaccagaaaauuaguucauagcacaugauagauaagccuggaacuagaagccccuggaguugcaggcugugaaucggugcuggcaacuggagagagagaagccagauccuggagaggcaacccagguugcucugaggaggugauccgguccacuauguuggauaagcaauccaagcuggauaaggaguuuuuaucuguggcauauacuaaggauacaaggagaaaagcauuaaaaaauaauuagcccaagauagacagauuugcuuauguugcuccuuaaauuguaggucagcuccucugacacccagaggucagguggucacagaaagccuaacauagaaauuugcaacaaauaucuggcaauuccugagggguagacguggggaguggggaagcccccugauaauauuucaagcaacauugugugugcauguguguaugcaugugugcgugcgugucugcuagggggauuuggagcagaagauguguuuauuuugcuuuaccaaagccucccuauaagaaccaucacuuccauucucccuuccccaauacuaucagcaagaacagaaucuuauaggcugaauuguuagguugaacuggucuuuaaacuccugugaaguuaucaauucuuaccauuugauacaucaggacaguagaugcugucaaaaguacugcucuuucuggaccagacaggacuguuacauucgggcuauaauacaagacacacaacaaaguuuguuuucaggucuuggcaaaagauguucugaccaaaggugaggcugugcuugcccaccagcucuguaaccgaacacugucaaucaccuucacugccuugauuuaggaagggcuagcccucuccaaauucccagggcacugaggucaaucucugugcuugaagaagaggagagcagcagcaaagggaagaggggguggaauucagcagcaaugugcauuggguuaaccaugcaaaauggauuggaguagaagaaagccacacuaauucagggaaagaacacuuucccagggcaaaaacacauuaaaaccuggcagccuuggagcaaacgcccucuaaaaagaaugcaucaacaucuuucagccaggccucauuggagcaggaacuggggccguguggguauuucuuuccauuuccucauuaaguuagaaacggugccuuuagauauuagcguagggcaugauccacagauggcauauuuugaaaauaaauucaggaauggagaaaacaucugagugaucauucacagccacccaucuuccaugucaacacucgauuacaguguacaccuagaaccugcuagaaaguuaaacuaaaaucuuguucagcagcgguuuggggagucuuucuaaauguggaccccucucuucuuuuaaagcaacucagcaucugccuccaccccacucuccccaccacaccagguuaaaugagguguaaggacuuuagaaaagauuaggguagccuagcagguaccagaucuauugcuuaccaugccaucagagcaguuggagguggggcuggugggcuccgagcagcucugucccggcaggcuauaguaguucuccaccugcucucucagcaacuccugcaggcucucgauguagcggauggcauuccugaggaucuccaccuugggcagccucugguugggguuggucgugguacaccucuugaggguuucgaaagccugguugaccuucuucaggcgccuccgcucgcgcauaguggcugccuuccgccgauccauggugguggacuuccucuugcaggcuuugcaggcccacaugaggcagugaccagccuggugguggccgguaggcgcucgcacgugcucguccucaucugagcccugcagcucugcuuugugcgcuccgaaggcagccacucgcggcacaaacucguccccaaauucacccucgggggacgguaugcaggagccgucguagaaguacucagaaggugagaacuggcagccauccaucacguccauccugcugagaggcaggcggugcaccuggacggcagcgagagggauggggagaaacgggagccuggcgccuccgccgaugggcaaaucccgggcggagcucccuagucugucgcuccgguaauuaacaagggcagacgccuguuggccuggguagacaagcugggguugggguucuuuauauauucuuucgggagg

SEQ ID NO: 16388 - RNA, 166529 nt, Homo sapiens
agggcgccucccaguccggaucucgcgaaguuacguuagauuggccgccggugacggguggccgugcugggggcgggagggcuucugugguaggaagggagguccgcucggccgggugcgccgccccagugcucugugggauacuggaagucucgagcgucggcuccggguucccagcccuccucuggcccgcacucauagaaacauucacacacccccugccuccccucucuucccucuccgccucccccuucccccccucgcgauaagaagacccggcggcaggagaggggaugaagauggcggacgcgaagcagaagcggaacgagcagcugaaacgcuggaucggcuccgagacggaccucgagccuccgguggugaagcgccagaagaccaaggugaaguucgacgauggcgccgucuuccuggcugcuugcuccagcggcgacacggacgagguccucaagcugcugcaccgcggcgccgacaucaauuacgccaauguggacggacucacugcccugcaccaggucugugcgccccgccgccggcucuccugaccgugaggguucucgucggccuccugcucgggccugcccucaguucuccaccucuugaggcugggggcggcgggagacucccugcugcggggugagggggcgguuuccccagagggcgggagggagagcugguggaagggagggcgcugggcuugaggccccccuucagaacaguugcugguggaguugggaaccgggugauuuccggggcauaggggaaaaggaacuguggucguuuggggccccagggccauucguggauaagucugggauuuggggucgagacaaggagggguguagugggguugugccugggccccggugucagugguauauucggagggguggaugcugaaggaagaaaacuaacaaggggcauuacggacgguuaggcagaugaacaucuuugacuuguaggugggcauuggauuuguugcacuuuuuaggacuugauuacaaaugaugauaauaauaguaaucuagagcccuaagccgagugcccugaacgaacgauuuccuguuuucucauuuauuacucuuggucacuggggaggggaaaacaggguguaauuagcugaucugcaccggcugaaaggaaggggauggaaguggguagaguaaggaagcccucuaaagggcuugcccaccuccggaccggaacguguugagucugauacucgaaguuugccgcagugucagagauccuugagccccagguccucgggugugcacugguguuagaaagagaagaauaaauaggggacacucuuuucaaagccgguuaccaagcucugguuuuucuuuugggguugggaaaaaagaaagcuggucacaaacuuuucucaaaauggaugcuuugugcauauuaaaguuuuauaguagucugauugggaucucucaauguuagccaaauaaggagaaacuauuggcaauccagagauaauguugccuugccuuuaacaggccaaaagcaacacaaccacguagaguuaugcauaaaaagcaauuuuuaagugacgguaauaggugacaaaacauaggcuuuuucuauuuucuuagcgggcaacuuggaauaacuguaauagaaaaugacuuugcagcgauagcuuccccuuaacaaugaaaagacuuguaagcuaucucaaaguugccuugguuguguguggaagaugcauagccuuauuuugaauaauguuguaguaaaaacuuguuugggagguugaaacucaaggcuuuauauuucaugaauauuaacuugaugccuuuuaaaaaaaagguguguagugacauuuuuccuuguccugcuuacuguuuaagggagugaugaccauuuuaaauuuuguguaauggaauucucuuaucagacuuggaguauagccuuuguuuacaaaguugacuggauauauugaaaugauugacacauugcaggacaaauauggaauuaaaaauguggcacccaguaaaaauauagcagggugucuagcgcuuucucaauuucauuaauuuagauucucuaaugcauagcaaacuuuuuauuugggugaaguuuauuuaaggcauaucauaacucguaaaauuuuaaaaccaugguguugagaaugaaggaaacuuuuggcauuaaaaaugauaauguaauuauauaagaugaaucuucaaauuucuuucaaguguacuuuacacguuuuagugugaaacagauuuugaaagacgauuauuacuguaggaggucaggauaauuggauaaugguucgcaucaauauguuuuauucaaauugucaaauagaaauuuaaaguuacuauuguuguggaggaacccaguuguauuggcuuagaggaagacgaaaaguuuugauauuuacauuauugugauacugguuuagggaggaagagaaaauacauuuaacugccuucuuaagaucuuuuuuucuccucucaauauucacacguuacaagaauugucagacuuaccaaugucuuccugauuaacugaauucaguggucaguuugguguuguguagauauaucuuuauuggguauuuuguuuuaguugacaaacagaaguuucuaaauuuacuccauuugcguaauaucuuucugucacuuuuugucacugugaguguggguuugacccgauaaucuccaaccgccuccccuuuuccauaacauuuuuccauaucugcaaaugccuuaaaucggugaagccaaagucuuuaaaauaucaagcauuaaaaauuuguguuauguuuucuucacucucauuucuuauuuaucaacucuuguacuuuuuucccauuguuacuaugaaaacagggaguucacuuugggcaaauuuaggacaacaguuagugaaagacaauaaauaaaauuaaaaaccacacacacacaagaaaauuuuaagccuuuaagaaaucucuugaacuuagcuuguuuuccauacuuaauuguaaaaacuaaaaucacugauuuaauaguccuugaauaguucuuuaaaacuuuaaccucucaaaagaucguagaauaccuaaaauguauaacgggguuaauuguugauuguuuuuugaauauucauuuacuuucugguuuugaucaaguguucuaaauuucauugucaagagaaaaguuuuaggaacaucacaacccacaaauaugcuuuugaaaaucgaauauuuugcuuuuacuuuaaagagcuuauauuuaaagguuuauuaauuuguugaaugugcuaccucauuagaaguuauaaaagauauccagucuucagcuguucuuuuuguauagaaauguguccucuguauagaagaaaaagcagcguuucuugucaaauuuccuaucuuagucuccagaguagccuuucucccccacccacucuacccaggaccugacccccaaagcuacaaaacagcacaaaguuaaccauagauacaaauuucugguuuuucuagaaccgaggucuagaguagaauuucauuauuaccaauggggcaauaaucagcuucugauuuuauagcuaccugguagaguuuuacaguaugugauuauaucucuauuuuagcauauuuuguaaagauuuaaggagauuaauaaaguuauauauagaaugccuuauugcugauucuuacugauacuggugugcauaaaauacagggcugagauuuuucuccagcaguuuugaguuuagccuguugauuuuagccuuaaaaucuuuucuuuuuccucugugccagugacuuccaagucaguuuacaguucccucauuucugcaaagcuccaagccucauuuccauuuuuugggguuauguauugauuugaaaugaaauauuaaauguauuguaauuuuauauuuaauaaugucuuuuaaguaguaauauaguaaauacaaguucacccccuuugccauagaauggcaacuacuguauucacguuaaccuuugugauuucuucaaaggauuucuuauuguucaaauauagauuuucauaguugcaauucaguauuauaauuuuacguuuauccguuaacauuagagauacuuaucuuuagacuuuaccagcauccuuuuuaacuaauuauuuuaaaaguauuauuaauuuggugguaagacaauuuuacaucgucaggaauuucuuuaaauucaaccuaaaacaggucuaucuuucuucaucaagucuacucuucucauugauguuccuguuucuguuaaugauguauuaaucuuuagaaucaaguuaaacauuuuaguuauuguuuacucauuccccuugucuaugcauaauccagucugucuucuagcucagucuuuucuuuacaauuaccuuggcaucaguucuuuucuuugccacuuuuuacuggcaaccuaguucauaccuuuauuauuuuauuuuauuuuauuuuuuugagauggaguuuugcucuuguugcccaggcuggagugcaauggcgcuaucuuggcucacugaaaccuccaccucccggauucgagcgauucuccuggcucagcuucccaaguagcugggauuacagacgugugccaccaugcccagcuaauuuuguauuuuuaguagagaugcgguuucucuauguugaucagacuggucucgaacuccugaccucaggugauccaccugccucggccucccaaagugcugggauuacaggcgugagccaccgcaccuagccuuauuuuuaucccuagaguauaguaauagcuuaauuguuuuuccugccucuauucucucccuuauuuaaucuagcaugcauauugcugucauauuaaucuuugaacaguaucauuuugaugguguuauuccucucucuaaauuuggauauaguacauuuuaucauuuagcuuaugguugauacaucuccauuguguuguauccuuuauagaaauugguuaacuugcuuacguuucaacuagaucuuuacauuuuuuauuuccaugccuuuagccaugccuuuuauccucucucccucguuugccaauuaaaauucuagucauuguucaagauucacauucucuuuucugggguguucacuguaccuuauauucugccucuccugcaauaaaaacacuuuuuacugaauaguguuuguguuugucuucccuuguagccucugaggaccuaaucuuccacaauuuuuguauuuccagagccuagcacauaguagaugcucacuaaagguuuauugaauuuuuaucuuuuuaccucaucaauaggaaguuuuagaguuauuuuuauguugugagauauauuuuugaaaccuucgcaucagauacuuagcguauuguucuugcacauaauggaauuugugugauuaugaaacaaauuaaaaacuuuguuguagauuucaauauauuuuaauaucuugagauuuuaaaaaaaucuuuuuuuuuuuuugagauggagucucauucugucacccaggcuggagugcagugguguaaucuuggcuuacugcaaacuccgccgcccagguucaagugauucuccugccacagccucccaaguagcugggauuacgggugcguggcaccaugccuggcuaauuuuuuuuguauuuuugguagagaugggguuucaccauguuggccaggcucauuucgaacuccugaccucaagugauccgcccgucuuggccucccaaagugcuaggauuacaggugugagccacuguggccggccuaaaaaauucuuaauaucgaccuccuuucuauuaaauuuuaaagcagucuagauauugguuaagugguagaaaaauauuauauccaguugagucacuaauuaauuacucacuuuguaagagucugagcuagauccucuagagcggggguucacaaacgcugggccguggacaggucgauccacgaccugugaggaacaaggccacacagcaggaggugagcgacacacuggcaagcuagcauuacugccugaaauccaccucuugucagaucagcagcggcauuagauucccauaggagugcggacccuauugugaacugcgcuucugagguaucuagguugugugcucuuuaugagcaucuaauuccugaugaugaugugagguagaacaguuucauccggccccacuccccaacccacaucuguggaaaaauugucauucacaaaacuaguuccugaugccaagguuggguaccacuucuagaggaauacaaaguagaauuaguuccauguucuaugcuauuagaauuuuaaaauaguuuuucuuuuacuuuccaaaacagacagacuuacagauagguuuaauaugaaauccuuuugcuuuuaaaauacaaauuugaucuacuucuaagggagccauuuuaagcaucuuuguaaaauaugugauccucucgucaguaaagggaauacuuuuguguagucuucuuaagaugugaaguguaaaagagacuggaagcaauuaauuuugaguugcuuguuagcaaauaguuugauuacuauguaaaaucugaauuaagaguuuauaguuuguaacuguuuacccuuuuuuugauggagaauguuaagaucuuggaagaaccuacuggauaacuuuuaaagagcauuaaaauuugugucuaaaagaaugugcaguguaaaauauuucucugcauaguuuucuuuuuagaaaagcuguaacacuuuaugcucaugccuuucaaaaguuuuuauugaaaucauccuaaauccauuuuuaaaaaccuaccuaaacaaacaaauaaaacccucccaaccccaaacuggccccucacuuccuacaaauaagugggcaacccuagccauauauggggugugcugguagggcaccagugcccacacugcugcuguucuaaugcuuuuucuguaguugcugccucugugcuuccuggcaacacuuuuguggucugacuuugaggugucauaaccaagaccaucuuucaugugccucagcuacaguaugauugcaagcugugacugagcauuuucuauagccagguagaaacacuggauggaauagaggaaguguuuuucaucauccauuuguuauuaccacauuuaaaaauuacaguucacauaagaaaaguguuuuaaaaaucuuauuagaugauuuuuaaaagaaaacuauuuaaaaaccuuuuaauagggggaggcauaaaacguuguuuuguuacuaccauaacauguuacuucuugacacuauaugaaguugcuauuuucauugccucugccugcaaaaaauugccaucuuuuacuccacccuucuuuugaaaguuuguggggcuccacaauaagguugagaagaugaugagguauuggcauuuugguauaccucuuugaaagguugaagaacuccaacaauuauaaguuuauucucaguuggagucagauauguaguagccaugacuuaaucaguguuuuauugaggagcagugcuuuuccaaacaauaguuuaauuuucacaacaugcuuuuucacuugcucaaaguuaacaagaaaauaaauggcagagcuggaauucuuaugcaggucuguuugaugccgaaacucaaacuuuacccuaugccagguaucuucuuugaagucugaagaagaaaauauucuuaaaucuuuucaucauuauggugguguuuaguaauuggagguuucucuguaaauuagcugaaaaucaagugaaacacacauauaauuuuuuucuucauccacauuuguuuuagcuagcccauacuuuuaagaccuuucuaugguaauugaagugcaguaguacuguaucuaaauuaaucucagaauucgaaauuguccuaaauuuuaggaagugccaagauuauuuuugacuuaccauuaugugcagaauauaucagcagcaacaagaaacacuccuuuuuucaggacauagaauuuaauuuuuaacuaccuuuauuuuucuuuacccuaauagcaauuuauaucguuucaguuguugggugugugugugggugugguguguguauguguguuuugagacagggugacagacucugucaccauggcuggagugcaguggcaugaacauaguucacuguagccuuccugggcucaagugauccucccaccucagccucccgaucagcugggaauacaggcaugugccaccacuuccagcuaauuuuuuuuuuucuuugacagagucuccccguguugcccaagcuagucucaaacuucugggcccaagugauccucccaccucagccucccaaagugcugggauuacaggcgugagccacugcacuuagccuguuuuaguuuuuuuuaaucauuuacaguaaauuuuuuauacauacguacauguacauauuugauucuuuuuagagacaaauuguaggaaacuucauaccauggauacugggggugggggggaagaagucccuuauauacccuuaagguagggacuuugauucuuuuuuucuuuaaaucuccuuuuguaucggcauuuuguuuuaguagguacacaauaaauauuuaaugauuaaaaaaaauuggacacaauguaaacuaauauuuugaagagcagaauucauagaauauuaaauaauuggguaaguguaacacacugacaaacuuuuaaaauguccuaauaaaaaagcuuauaucaaccacuuacuuuuauaauacuuacaauguaaagguagccauuauuacaaucaaaacauuuauuagguggcuggguaugguggcucacgccuguaguccuagcacuuugggaggccuaggcaggcggaucaccugagcucaggaauuugagaucaaccuggccaacauggcaaaaccccaucucuacuaaaaauacaaaauaaaaauuagccaggcaugguggcgcaugccuguaaucccagcuacucaggaggcugaggcacgagaaucgccugaacccaagaggcagagguuggagugaacugagaucaugccucuucacuccagccugggcgacagagcgagauucugucuuaaagaaaaaaauuauugggauguuagauuuauuuuugaaaugagaucuauuacugauuaucaauagacgcuucaguuuauguaacuuaguuuaaaaauucuuuaaacaaauccuugaguguucauuuagaaaaguaaucucuaggcuggaugcaguggcucacaccuguaaucccagcacuuugagaagccaaggcaagagacuugaucccagaaguucaagaccagccugggcaauauagggagacggugucucuaccaauaaagagaaaagaaaagaaagaaaaagaaaagaaaucucuagcaugguaauauuagaaauaaugcauauuuucuguuauuuuacugauacuuuuuuuuuccaaauaacauuuuuacuauggcucccucuaugucaguauuuucugaccuuauuaguguuuugguuguuuaucuuugcauuguuaugcuggcuaaccauaaaaagacacgcuugaguucuguguuacugcccuaagugugcuugcugcucaacucaaaugcucuuucaugggaggagacauuccacauugucauguguuguauaggcauuucugaaaugacauucaguagaaaccauggaaagaagugaaagcauuccucagcugucacuuuuuuaguagucuauuuaaauguuauguauauuaagugagauauucugcagagagagcuucacuuaauaaaaagcuuuacuuuaacuugaugauuuaacucacauuugagcugaaauuacuauuuucuuaguuuaacaugaccucuaacaauaaaaucauaagauuguacaaagcucaugucauuuucuugaauacugcauagugcagaggagaauacauuuugugagaugucacuuggcacccucuuaaagauuaauaaccaugugggaaaguauauuuucauggacuguuacacacacacacacacacacguacacguaugcacucaaccuuuacuuguaauaaacaucccaaauuauauauauuuuauuagccuucaaaauuguuuuagaugguuauaaacuuauuugaauauuuauauucuugcauggaacacuucuagagcuuuucuguuggaguuucagcuccagaacauuuuuuuaaaauauccucaguguugagaguuuuuuuuucuuucaggagaguuuuuaaauuuugaaaaugauaucauucgaagaugcaucuggugaauaaagguggaucauguagucaucaugguuaauaaauauccgugauuacaugauauuuucuaaaaagcuuauucuuaacuggaauaugaucauaaaugucaccuuggauuuaaguuaacucuuuacguuguguggauuugaguaugcuucagaauuuguaaaccuaaaguacuguucauuuguguucuagauuuugaugaaacaagucaauguuauaguuugugaacauagucuuuuuuguauauguuuguguuuucugcaaaagauuucggugcugccuggcacaguagcucaugccuguaaucccagcacuuugggaggccgaggugggaggauugcuugagcccaggaguucaaaacuggcuugggcaacaaagugagaccuugucucuacaaaaaauuuaaaaauuagcugagcauggcgacacgcaucuguggucccagcuacucaggaggcugaggcaggaggauugcuugagcccaggagguugggguugcagugagcugugaucacgccacugcauucuagccugaacgacagagugagaccaggucucacauuuuaaaaaaagguugugaugcugcuggcucuagaucaugacacuaugucauuaagaacuauuguuuuucucaaagauauuuuaauuucuacaguuuuucuuaaaagguuuggacagaugacauauucagcaauuucuguauuccuuccaaguacauggaaucuacuuaagaacucuguagcauauucaagauuuuuucuuuuaaaaugccuauugcuguuuaacucuuugaaccaucauuuuuuacaguuaaaaugccuuuauauuguugaucuucucaguguuuuccauuauuuuuugauauacaugaaaauuuaauaaguaauuauuaagucuucagugucuugcuuuuauaugggucauccccaucuccuuuuuuuuaaauuuuauuuuauuuuuugagacggagucuugcucugucucccaggcuagagugcaauggcacaaucucggcucacugcaaacgccgccucccagguucaagugauucuccugccucagccucccgaguagcugggauuacaggcguccaccaccacgcccggcuaauuuuucuuauuuuuaguagagacuggguuucaccauguuggccagaccggucucaaacuccugaccucaggugauccacucgccucagccucccaaagugcugcgauuacaggcgugagccaccgugccuggccucuccuuuuuauuuuuaaacauggcuuacuuuuguauguuuaauguuguaugugaauuuuaucccaaauaaaaauaguuguaaaaguuuaagaauaauuauuuaauuaaaacacuaaagacaaauguaaaaaauaaaauguuauccaaaauuucgggacuggacuuugcuccauuuaaaaguuuaacauccuuuuaaauaucucuguacaaguauguaauuuucuauaaauggggucauaccuaauuuucugguuuauaaccaguuuugaaacauuauguauuuuaagaaacauuucuguguuaaagaauauucauauacauuuucccuuuuaaugaguguaucguauuccauugugugugcaugugcauauacaucuuggaauuuauuuuccuaguccuuuccugaugaacauuuaguauauuuuccacuuuuuaucauauggugaauauuauguacaucuuauuuauuuauuuauuuauuuuuuugagacgaagucucccucagcagcucaggcuggagugcaggggcgugaucucggcugacugcaacuaccgucuccuggguucaagcgauugucccaucucagccucccgaguagcugggauuacaggcacccgccaucaugcccggcuaauuuuuguauuuuaguaaagaugggguuucaccauguuggccaggcuggucuugaacuccugaccucaggugaucuacccaccucgggcucccaaagugcuaggauuacaggugugagccaucgcaccuggccuauaccauguacauuuuuacucgcucaucacauuguauuccuuaggauuguuccuuagaaaucuuaucugcaaucuuauguuuugcucaaaauaacaugccauuuaaaugauuguuuauacaaaauacuuuuuaaaaaauuuuuuacuuuuaaguucugguauacaugugcagaacgugcagguguguuacauggguauacuuaugcuaugguaguuugcugcacuuaccgacucauaucuagguuuuaagcccugcaugcauuagguauuuguccuaaugcucucccuacccuugccccugagcccccgacaggccccagugugugaugguccucccuguguccauguguucucauuguucaacuuccacuuaugagugagaaccugagguguuugguuuucuguuccuguauuaguuugcugagaaugauggcuuccagcuucauccaugucccugcaaaggacaugaacucauucuuuuuuaugacuguauuccaugguguguaugugcuacauuuucuuuauccaguucaucauugauggggauuuggguuaguucuaagucugcaaaaggcauuuuuaauaaaguuucuaguauauugaaaauggaaaacuaaccgugaaaguacucauguugacacaucuguuaaauugaugcgauaauguuauccccuauaugucacccacaggcagauuuuuguuuuauuuauuguuuuuuuuguuuuguuuugagauggggucuugcucuguuacccaggcugggagugcaguggugugaacacagcucacugcagcuucgacugccuggccuuagugauucucccaccucagccuuuugaguagcugagacuacaggcgugugcccaccacaacuggcugacuuuuaaaaucauuauuauuaguaguagagacaagguuuugcuguguugcccaggcugguuucaaacuccugggcucaagcaauccuccugccuuggcaucccaaagugcuuggauuacagccaugcacuaccaugccuggcugaggaaaauuguuuuauugcuuuauuacucuguguguguguguuugugagaauaaaauuaguuguauuucacucagagaagcaauuggggaagacaagguaaaaaguguucuuccuuuuuucuuuauguaagguuuaguucuaauguuugaaaauuuugaaguuauuaaaauauuaaacaauaucuguauucauuuauaugaugcuguuauucauuuaaauuagugaauaacucauucaugcaagaaacauagagagaucaccauuuaucauauguccagcacaguacuaaucucuaaaaacaguggucccuggcuacauguaguauacaaucuaguugagguggcagcaugagccgaugauuacaauguaaauaagugguagaguagagauacaaggugaaauuaaaggcuuuauuaggcgggcuuaacccagaguaucaauggaagacaucccugagaaagcucuguaaguuauagguaacuuaucagcagauguuuugagccuuuuaugacccuauucacuacugguuugucuucugaauguaccuguuuaguguaccuuuuugucaguuucuuucuugaagaugaauguugccaagguucucauaugucuauuauucuuuuuuguguuauuuauguaguuucaacuuucuuuuuauaugaucuguccuccuucuuacaugauccauaucuuauuuuuuauaucagucuuccauuuacuaagcuagaaucucagggucuuuuucuguuuucuccucacuugcauacaguacaucuccucuaccaugcacacaccuaaaaaaaaaucaucuuuuguauauucauuuaacauauauuaaaggucucuucugugccagacacuacuaagugcugagaagacacauuuuugagcaaaaauauaccaacaguacccucauagagucgacaguaaaaugaaauuagccauuugggaaaugcaaaucaaacccacaaugagauacuaguucacaccuacuaggauggcuuuaauaaaaaagagaacaaguaaugacuaggauguuguauuaguccuguuuucuuuugcuuauaacggaauaccagaaacuggauuauuuaaaaagauuuacuuauuacagcuauggcggcuaagaaguccaagguuguagggucaacucuggugagagccuucuugccuguuggggacucuguagaguccugaggcagcacaggguaucacauggugagggggccgagugugauaacgugcucaaggucuuucuuccucuucuuagaaagccacaaguuccacucccaugauaacccauuaauucauuaacccuuuaauccaugaguggauuaauccauuuaugagagaagagcccuccugaugcagucaccucccaaaguccccagcuaucaacagugccacauuagggaucagguuucagcaugaguuuugggagggauauuuaaaucacagcagauauggagaaauuggaacccucaugcacugcuggugguaauaguaagaugguauagccacuuucaaaacagucuggcauuuucucaaaagguuaaacagaguuaccguaugacccagcaguucuacucuuagguguauacucaagagaauugaacauguguccacacagaaauguguauaguaauguucauggcagcauuauugaugauagccaaagaugaaaacacaaaugucuuaucagcugaugaauaaagugauauguuuugucccuggaaucagcggaauauuauucaguagcaaaaaggggaugcugauaauugcuacaaagaugaaucuuaaacaugcuaagugaaagaagccagucacaaaagaccacaugguguaugauuccauuuauaugaaauguccagaauaggcaaaucuguguaugaagcaagaaggcagauaaaugguugccagaaacuagagguguugaggggaguuggugaauaacugcuaauggguacaacuuuuuagggugacaaaaauguaaaauugugcugacaguugcacaacucugugaaucuguuuauuuguacacuuuaaauggguuauuuuaugguaugugaaugguaucucaaacauuuaaaaaagugaacguauauauuuaucaguguuuacuacuaaaaauugaggcacugacagagccagaguaauuaucuucuaucagucccccagccucagccuaggcuugguauuagucacuauaauuaugauggugaacagaacagccagacauugccccugcccuaacacagcuuguagucuacuggaguguauagauaauacacagacaauuauaaauuuacaucaguuauguguaaugauauguaaugguaauacaguauggaagcuuaugaaggcauauuucaccuagauugggggaggggagaagacuuuuuuuuuuuuuuugagauggagucucacucuguugcccaggcugcagugcaguggcgugauuucagcucacugcaacuuccaccucccagguucaagcaauucucuugccucagccuccugaguagcugagauuacaggcaugcaccaccaugccuggcuaauuuuuguauuuuuaguagagaugggguuucaccauguuggucaggcuggucuugaacuccugaccucgugauccgcccgccucagcuucccaaagugcugggauuacaggugugagccaccgcgcccggcugagaagacuuucuggauaaaguugauguuugagcugcucagcgaugaguaaauguuagccaagguuguuagggagggaagauuaugggaaacuauuucagagagagggaaaauagcauguguaaagaucuggaagugcacagaagugcugaaggauuuuuuuuuuuaagacaagagucuugcucugucuggaguacaguggcgugaucucagcucacugccaccucugccuccccgguucaagugauucucccaccucagccuccugaguagcugggauuacaggcgcaugccaccacgccuagcuaauuuuuguauuuuuaguagagacgggguuucgccguguuggccaggcuggucucaaacuccugaccucaaguaaucugcccgccuuggccucccaaagugcugggauuacaggcgugagccacugcaccuggccaguugaaggauuuuaaucagguuaaauggacaaccaauuuuucuuuuuuaagaaaaaucacuuuuggcugcaguguggacaaggcacugaaaagagaggacaaagcugaagguagagagacauuugaggaaguuggguagucugagagagaugacuaugagaugaacuagcuuagcggcaggaggguuggaaaauaguagauggacuuaaaauauauuuaugaaauagaauugguaggaauuggagguggauuggcuugagggauuauuuaaagaugugcaugcaccuguuuucuggcuuggacaacuagaugaugaaggugcuuuucacagcaugcaguaaauauugugugcuuacuguauaggucagcagcagaguauugauauugcagaaugauacuggaggagacagucaaguaaacaagaaaugaaaaucaaguguaaaauguacacuauaggcuaucuguacaggauguugugcacacauggaggagggguggccuaacuauaacuaauacauggagaucaugcuuggagugugguuuuuuccuuggauuuagucuguucucuuacuugccucugauucccuggaaaugugaaaaccaaguagaaaacaauuuaugaacauacagaaaaaacgcaggauacagauucgugauuauguuuuuuuuuuuuuaagguuucagugaacugccuaaaaauauaugcaaaauuuuguuuuucuguacuuuucaguucagaagaauuaguaaagaauuucuaaguaaagccaaauuuacuuuuaugauauuauguauguggcagagguguauggggaggaguggaucacagaacuguuggagaggaauaaaggagugguaguaguaacgaucuacaagucuuuuauugacugaaauaguaugcuaugaaaauaaagucacagguuaagauaggugagaguacauuuucucagagcauguuggauuuuucuaauuguauagugaaagaauuuuaacaaucucuaacuucucucaguuucuaaauuuacuaaaugguauuuuucagggaaaauaaagguaaaauauuaguuacaacuaagaaaccuaacaccuuuauacacuuuuuaugucuaauagauuuaauguuuuuucuuuuuugcucaaaauauuacaggacuugcuuugaguauuugauugaggguuuuuugcauguuuuaauauuuuuaaaaguugcaguuaaugaggaaaguaguaguguacagaaagguuggguuauuuugacuuugaguaagcaucagcagauuuguuucagcuuaaaugaaauaggacauaauuguuauauauuaaacucuuuuuuuuuuuuuuuuuuuuuugagacagagucucgcuccgucaccaggcuggagugcaguggcacgaucucggcucacugcaaccuccgcuucccagguucaagcaauucuccugccucagccucccgaguagcugggauuauaggcacgugccaccacgcccagcuauuuuuucuauuuuuaguagagaugggguuucaccauguuggucaggcuggucucgaucucgugaccucgugauccacccgccucggccucccaaagugcugggauuacaggcaugagccacugugcccggccuaaacucuuaacucuguauaacauggcaucuuuuucccuuuucaacccauccuugacauuuagagccagucuuuauaugugggaauacuauauaaguuuuucucgcuuuaaaaacacucaaauguaaaaaauguuaauugcaggacaguauguaugguaugagcccuuugggggguuauuuacauagggaaaaaaucugguaaaguaccucaacuguuaacagugguugucucugggagggaaauacagauuuugaauuauguuacuuuuggaucuuuuacaacaagcagaaaaaaaaaaagaaaaaucucaauuggagaaaaaugccuaaauggcuauucccaguaauauuuuauggauuaaauauagaaacauugauauaacuaaugaauuuuaguuugcuaguguuuggccacucaaagaagcugguguugaugguucaguauuuauuucuguauuauacuugccuuuucucugaaccuuuuauuucaugaggaaugacugcuugacgaugugaugaacaccuugggagaguauucuaagcaaauaauggaauucuggauaugguuagauguauuuuguagcuuuuugcaaguggacuacagaaaguucagagaaaagcuaaguauaauuaccaaaaaggcaagucauuuuugaaggacaaagggguuuuaaaggauaaaauuuggguuuuagaauuuuaaacaauccaauaggagauaaugugaagaaagaauuagaaaagcaguuuuauacaguaugcucuuuugccccauucuuuaugaauguauaaagcauuugucgaugaauaucugucuuaagaaugaauugaaaaaacagccccaagucucuuagaauuaggaauguugaagcccauaguuacgugaauuuugugaaaauauuuuugaaggcagugaaaagaggacuuuuaaaauuuauaaaccagaacaagaauaggaagauggaaggcaacugauggaauggcuuuuaauuuacauacacauuuguuguuuauagguacauuuguuguuuauagguacauuuguuguuuauagguacauuuguuuaaaauggucuucuacucuacacuggcaaaauucuaauauccacuauuaaacagauaguucuggaagagacuguguugaacacuagaugucaauuugaguuuucugaaaacaaguuauguugaccuaucuuuacuuccuuuuuggucaagguuuagaaacauaacugggggaaauguugcaaacaguauagcuugauuuuuuuuguaaagcacauggaaaggcucuuguuaugucuuuacgguuaacaugacaaaaauuuggcgugaauauuaucaggauuaggcucacuaauagcugggugaacuacuguauacaugucagccugcugauugaucacucagugucaacccaaagggaagacuaacauagugguccuuguguucuuaaucuugacccuauccuguguaacguuuaagcagauaaaguuguaggagcugagagagaacuucaaaaagcauaaaauaguggguuuuaaauaauaagaugaaaagauaauggguauuaauuuaaaauuccacauuaaaaauggaugaguguagguugguagagaucauuuuugacagacauaugagaaguaagucauuggaaguuuaacagcaagccuggugucugacaacaguauaauaauuuuuaaauauaccaauuuaauguaaagcaaaaauaguguuaagccuagauuuaaaaaaaaaaucuauucugcauuguaagaucacaucuguagaaugugucuagguuuuuagauuuguuugcuguucagcagaucuuagcaaugaccugccaagggaauggcuucauauaacaaaguuaguucuacagagaaaaacaaaccuguguuccaauuucuuuuucuagaauuguuaacaaauuuauacauaaacaugcauacauucucacacauaagcaagcacacguacuucacaguauaguaauuggagucuuaaaaugcccuaagauucccagaacuccaucaacucaauuauuuucuuaugagccccuugaaaaacaaaaaggaaucaauuuucaaagccgcauacuuaccuacaguguuagaccaaccucuaguaggaaaaugguagaaggauuuugugcauauauuaguuaggagucuugguuguaaguaagaaaagcccauuggaaccggccuaaauaauuuauaagauuauaguaucucauagaacuggggcuucuggaaugaauuagaaucagguacuauaugcaacucaagaaguucucuaaguuucucauuauuguuucuaacaaauccagauuuuuuuuuuuaauagaaaaccagauuuuuuguuuucccaguuuaaaaaggcagaaaauaaggucacuuccagaguuuacauucuggucuaguuaucuagagagauuuaucuccuccugaguucuaauuccagauuuccaggaaagggaccaaaugauccaucucagguuauucauguaucauacaaggucaucaaugguggcugauggggcugaaccccucugaaaaaacaugccuacucuaacuguaaucauguauuuugaggagaugauggggacauaaagcuggaaauaauaagcgaguucagaaagaugccaauauugauuguauaaauguacagucuguacaaauaaaaaaguacaaacaaauguuaaagaaauuuuaaaucagcaguuaucagacuuuuugguuuuaggacccccuuuauaauauuaaaaaucaaggacacacuagccaaauaaauaaaacuggguaaauaugaauaucaguauauuauaucaauguuaauauucugauuauauuauauuauaguuuugcaaaguuuuaccauuagaaacuagacaaagggauaucuugguauuacuucuuacaacuucaugugaaugcacaugacugcaauaaaauaccauuuugaauuuuuugucuguuauuauuuuaaugcuaaaaaaaaauugaggaacccaaagagguuuuuguuuauguuggcugucuguauuuaccaaauuagaaaauaaaguugaaaaaacuuuuaaauauuuauuuuaaaauaauaacccauuacauuccaacauaaauauuaugcuuaugaaaaauagauguauuuuacgaaacaaaaagaguggcaucguuuuacauuuuuggaaauuuuuuuaaaugucuuaauuaagacagcugaauucucauauccacuucugcaucuagccuauugugaugucacauacaagcuccuggaaaacuccaucauaugcuuguaagagaaugagaguauuaaccuuguagacuucuguaaggggcuaagagaaacacugagcuaaauaauugaggggauauacuauguucauggcuugaaagacuguaaguauuguaaagauguucuuccgaaaccaaucacagauuuaauacaaguccaaacaaaaucccagauaugugugcauugucuguuuguguaugcaugugugaaaaaugguaaauugauauaaagaugaaaaagaccaggcacagccaagucaaucuuuaggaacaagaaagugagaggacugaccgacucugauggacauuaagacuuauaaagccacaauaauuaagacaaugugguguuagugcaaaauuagacaacaaacuaaugaaucagaauagaguguggaaaaagauccagacagauauggacacuugauuuaugauaaagguggcauuucagaaaaguggggaaaagagagucuugucaaccugucuauauggggaaaaaguucaucuucaucucccccguaccuuauaccauacacaaaaauaaauuccaguuggauuguagaucuaaaugugaaauacaaaaguaauagauacucuggaagguaacuaugagaauaucuucauaaccuucggguagggaaaagauuuuuaaacaggacacaaaaagauuauuacccauaaaggaaaagauugugugugcauaugcgugugcacauguguguuuuaaacaacaaaauacacagaugcaucacaaaagaaaauauucuauugguaauaaacauacaaaaaguuauucaaucucauucaccagagaaaugcaaauuaagagcacaauagauaucagcacauaccacuggaauggcuaaaauuacaaaagacugaugauaucaaaugcugagaagggauguggagaaacgagaauucucauacacugcuaguguaagaaguaugugagauuucuaauguauucaaauauauuuaaaauuuguuuaucucuugcuugguuguacuuaugcaguagcaauggaaacguacucuauggauuaacauacauuuuaaagcuaaaauuccacaggagauuguugaagguuuuuguuaaagugauugguuauaaaaauguuuauaguugauagggauucucuuauuaugauuaggugauaauuauauuaucagagauucauuaauuuuauuucuucuuuuuuuuuuuuuuuuaaaucaggcuuuccucugucacccaggcuagagugcaauggcacaaucacggcucacugcagccuugaccuccugagcucaagcaauccucccaccucagccaccugaguaguugggacugcaggugcaugcuaucaugcccagcuaacuguuuuuuauuuuuuuguaguugggggucucgcuauguugcccaggcuguucuugaacuccugggcucaagcgauccucccgccuuggccuuccaaaguguggggauuaccagugugagucaccaugccuggcaguguuucauuaauuuaaaaaauguuugccugccuugugugugccggucauaauacugggagcuaaggaauacagagauuagcaaaacaagacccucuucucauuaaauguaucaaugcaaguuguauuaaguauuuugaaggaaaaauauaaaguguuauacaagaacagaagguuuugagaguuuggauggagucugugaaagucaugauugaagugagaacugaaagaccaguaguuguaacuugguaaagaguugauggucgaggguggagagauagauucuuggugaaagguggagaaauagguucuggucagagcaaagcccuuuggagaaagcaugcucagcagaggaacuagaaggccagugugacuggagcacagggggugagaagaaugguauagcaaacaguauagagauagguugaggucagaucuaggaggauccaggagaccuugauaagcucauuuucacacuagaacccuagaaaugcauuaaaguguuuuaauugcuuuagugcuaaucagauuugcauuuuuaagagacggcugcuggcuguagaacagauuggguggggggaaucggagguggagaggagaguugugccuggaggccaguuccagaggcugauacgggaguagaggcaagagcucuuucucagauggcuuuucagucgaaagcuggugcuuuacaagauguuaaaaggcaugcuaaguaaaaaaaaaaaauuaugauauguuugggagaugcuccauuaaacaagguaaaacagauauuuugcuagaauuuuuaagucuuaaaaaaaaaccuuuuauuucagguuucaggguacaugagcagguuuguuauauaguuaaacugcgugucauggggguuugguguacagauuauuuugucacccagguaauaagcuaguacucaaugguauuuuuucugaucuucucccuucucccacccuccacccucagguaggccccagugucuguuguugcccuauuuguauccauguguuuuuguuguuuagcuuccacuuaugagaacaugcaguauuugguuugcuguuccuguguuaguucgcuuaggauaaaaugcacugaagaggagagaggcugaggaaggagcugaagccgagugauagaaauggaaucucaggguguugcgccuggaggguuguugguuuuaggaaauggagaaaaggugucugaaaaaagagugggaggauggauuguagcaagccugaaaguguaaacuuaauucauaaauugugaauuucuaacaguagauuaaaugaacuaagggcuacugcagaaagauuaauuugguaguagggguaaauagguuaggacauggcugcuagcaaccuauuucaguaguucaccguagagauaaaaauaucccuuccauucucucugauuuuguuugaugcuguaaguguucuauuuacugaagaaguuauggggguuuuuuggucagugauuuauauugaucuucagaauucugugcuuaaguuucaagugauuuguguuagaaauuaagaaguuagggcuuuuuacuuuccacuuucccuuuucaaaucaguaauacuaacuuuuuuagccacuagcuauauucuguauuuuaauagcuacauauacuuaacacuaaacuaguaaauuacuaaaugauuugaacuguuaguauucaucuuuguguuaugacuagccuuugaaauuagauguguuuauguguguuuguuuacauauauacaugcauguucgaauaaugcauuaacuuuaaggagugaaaucauaguagaauaaacuagauuuaaaacauuuuaauuuuacauagcucuuauaagauuggaaaaguuuuuuuuuuuaagaauaaagucauggggauuauacuuugaaguauacuuuuuaagguucuauuuauuuauuuauuuauuuauuuauuugacggagucgugcucuguugcccaggcaguggcgccgucucggcucacugcaaccucccaccucccagguucaagcaauucuugugccucagccucccgaguagcugggauuacaagcgccuagcaccaagccccgcuaauuuuuguauuuuuaguggagacaagguuucuccauguuggccaggcugguuucgaaguccugaccucaggugauccucccaccucauccuccuaaagugcugggauuacaggcaugagccacugugccugguuuuaagguucauuuuaauuagauauuguaguuaucccaucccauuauguuugaauuaggucuuuuagacuaauucagauuggcucuuuucucauccaguaaacugcuuucuucuuuauccgcauccaaaugauaaauguuauuuguugucaguuuacaaaaugauuccuccccuuuuuuauuauaaaaauaauaugacaggcugggcgggguggcucaggccuguaaucccagcacuuugggaggcuaaggcgggcggaucaccggaggucaggaguuaaaacagccuggccaagauggugaaacucucucucuacaaaaauacaaaaauuagccggauaugaugccugggcgacagagugagacugugucucaaaacaucgucaacaacaacaacaacaacaacaacaaagcaauaugacauuaagcagaggcuguaguugggaugcauaauuuuuuuuuuuuuuuuuuuaagacggaguucugucaccaggcuggaguacaguagcgugaucucggcucagugcagccuccaccucccggguucaacgauucuccugccucagccuccugaguagcugggacuacaggcacccaccaccacacccagcuaauuuuuguauuuuuaguagagacgggguuucacuguguuggugaggauggucuccaucucuugaccucgagaucugcucaccuuggccucccaaagugcugggauuacagacgugagccaccaugcccagccggggugcagaacuuuuaaguucauacuguaacagauucuaguaacaguugugggaauuaauaucugagucuucagaaggaucuauuugggaauuaacaucuuugagacuucagagggaacuauuugguuggaauaguaaauaguaaacacuuauauaauaguauuuaaggauauaacagacaugccuuaggcgguuacauuaucacauuaaucauaugagguauuauucauuuuauuauuccauuagaccugugaagaaaaugagguacagaugugacuguagggucacaacaaagcuuauaaauuacagggcugggaguugaaccugagaaguuugacugaacaguguucucacaaacgcuaugccauagugccucuggacuacuugaaucaccagguuccauccucaugguauccuuaagaauaccugggucuuaauuauaggacaauugauaggccacaacaaaucugguaggucaguuaucuccuaaagcuaccccaaugggguguuccagaaacuuccuggaugcauccaggguacaccaaggucuuacucuugccagcuaauguguucuguugcuccagggcucacuguugauaaucaugggugguauauaacaagaaauugagaauccuguaggcauaugguuauuuaaucagccuuugauuuuaaauaacuuuaucugaacacuguuaacauauaaugacuaaaaucuaacaccaaacuagcuggucacaggucuucuguuaguauuuuauauuuccauuaacuucuuuaaaauguuccuauaucagaagacauuguguaaaagccuuauuaaaugcuucuguuucauuuucaauuuaacuauauuagauuauauaccugcuuuucuccuagcuucugcuuucauauuaagucauuucuuccauuacugaaaucuuguuuguuuuuauuggauaaucugauuccaaguuuagaacuucuauguuuuaaaggacuguggaugacagggagauaaaaaaugaaaagacuacaagaaaagcaguuccuaguuucagcaaaaaauucaaaggcauuugggucuucuauuauuaacugcucuuuuccuauuuuggaauaaaauuaaagcuagagucuaguuuagguaugguaguuaucauagaugcuuccacuacuacaaacaguguguucuuugaagaucugaaauaauuaaauacagugcuuuggauccucgcccuguuuuaaauagaaaugaauuuucagaaaggauucuacucuuuaauuacuguggaagacacuguaagaguuaacauuguuuaaagaaagccuuauaugggaaagaucaauuguuaguuaguauccuaacuaaacguuuucaaccccagauacccauucuuaugaagaaaucuguucuucagaaauuuaguguauguagcaagccgucugauuuuuccuuaggcuaauaauggaggucacuccauuaaaaguacugugaaccacuauuauauaccacagaauacaguauagcagucuuccaauuuuuaaagaaacauagauacauagauuaauauauagaggcuaggucuugcuuugucucccaaccuggaguacagcagcaggaucauaauucaauauaaucuugaacuccuuggcucaagcaacacuccugccucagccucccgaguagcugggacuacuggcacacacuaccaccccggcuaauuuuuacauuuuuuguagagguggagucuugcuguguugcucaggcaggucuugaacugcuggccucaagugauccuccugccuuggccucccaaagcacugggauuacaggcgugagccaccaugccugaacagauuuauuuuuauaaacaguaauaaaguuagguuaagcccagauagugaaaguaggcaauuguagagugaacuuucaucuuuguaggcacuugcucuguuuaucaaguucuuaauuuucauucccucccaagaaaauaucccacuugaucuuuaauuuuuauuuuguuuaacuuuuauauuuuuuaaccuugaugauauuuuaguauaggcuaaaucucuuaggacacucagaaguuuuucccccccaauuuuuaaagaaguuccagaguuccauuuuaucuuucuaguugucuuuuaaagcuaaaauauguuuauuguaaauugaaaucaugagcagaugaguuuuaguagagcuaaaagaaggacagagucugccuguucuuaauaaucuuagggugauuggaaaauauaucaaaagacauuuuaauuuucuuauaaucuuuuucacagggucuuucuuguagaugacagcuguaccuuucccaccugccucuuucucuuacuaauauaccuaagagaccuuuugagugaggggagauagaguuauuauaaucuguauuuauauauuaaugaaguacauuaaaaaauuuaugcauggauguaaagagauuuacugagauaauuuauguagaaucaguacaauaggcaauuuguaggccggaugcgguggcucacaccuguaauccuagcacuguaauuugccugccucgggaggccgaggcgggcaaaucacuugaggucaggaguucgagaccagccgggucaacauggcgaaauccuuucucuacuaaaaauacaaaaaaguuagcugggcgugguggugggcgccuguagucccagcuacuugggaagcuguagcaggagaauugccugaaccugggaggcggaaguugcagugagccaagaucgugccacugcacuccagccuguccagccuggacaacagagugggacucugucuuaaaaauaaauaaauuuauaaauaaauaaauacauacauacauacauacauaaaugaauaaauaaaccagcacuuuguguacaauaagcaauuuaaagcaagcugcuuuuuuuccugauauuggcuaaauauggauaauauugauguguuuuagcuuuuuaaaaaauauuaaugguaauauaucugccguauagaacauuuagaaaauaagaaauaagagaaaaaauuacugucagcccuuuacucuauguuaauauauugguauacuccuuuugccuaauuuuuauguguuuguguguauuuuuauauacuuuguguguauucuaaauguauuuuguauauuuguggguuaaaaacauucuugugauuguacuauacaguuuuuuuaaucccacuuaucauauagcugauuuuuuaaguuuuuaucauuaauauuaauuuggauguuuguaauuuuauuaaccauuccaauucuguuucuagguuuuuauuauuugcaguucacucauucauucauuugcuuauucauucaaauaguaaauauuuauuguaugcuugcuuuggugcuaauauuuugaugaauauuuugaugcauaagauuuuuuucauuuaaaguaggaugauuuccuuagcugagcaucuccacacugacucuucugggugaaaaugaaggaauguauuaaaccacucauuauaaacauuaccaaauuguuuucaaaguuucgcaccaguuugaccacuaagaaugugagucuguuuuacucuguccucaccugcacuguacacaauaauuuacuucuuucaguuuauuacagcuauggacaguuuuccacauuuaauguauuacagguggauuauauaaauuuuaaaaaugcauguuaguuuguuccacaauucaaugauuucuucuacaggagaugcuugauucaaaaucauaauuaaaaauacauacauggguuaagagugaagcaaagacuaucaaauguacaaauaaaaauaugcguaauuggaaagauaguuaugauaccaaauaaaugacucaaauuuaaggcuauauauauaaguagccuuaaaucagaaaguaucugcagcauccugccuucagcaggaaggcaacugaaaagaacacugguucugugucuuagguuuaaauccuucugugccacuuacuaguucccuguuuuuauuaaccccuuugaguuuguuuacucuuuugugaaaugugaauggcauaagaauguaaaaugauugccagaaaugacagggaaacagauuuggaugccucuccuucaaaaaaaaaggggugggggggggcggcaaaacaaaacauucuagaauaggauauuugaacaacuuuucuuuaugugguucacgcucuaaauuaauuuguuguuaagcucuaguagugcuguuuuuagguuuaaugggcuuuucaauuuuauuuuguuagaauguuuacucagaauuuugcagaauagacuuuacaaaguuguuugaaggcuguuagguauacuaagcaggaaaguaauagcuauaguaaaacaugaauagaauuagugaagaaagguauuuuaauaacauagcagcuggaagaaagauuaaccaagccaugcaugaauugauuacaauauaaaguguuaaaauagauuuucagacacgaauuucacuauuuuagguuuuagaaauguuuuuguauuuauauuugaauuuaccuuugugugguuuugguauucuuuuccgagugaacaugcuucaguguguuuugaauaauugaacaacaguucuuuuccccucuuggucuccacuuuacuucuacaccacacacaccuucacugagaauagaucaccuuuuggccuuuguaagcaccagucaccuagugcuguugccuuucagaguugaauauggagcaagugaaaucugcagaugcuuucacguauauuaagcagccaauugcuuaauaaaacauuauauuguaggguguuauagguucaaagaaauagagagcaagugaaaaauguagagggaagaacuuguaccacuggaaugagcuacuuuaugcuguuuauauaagagucuuuuccucuucagagcuuguuaaaugauaauaauauucugcagcaagguuuucgucauaaggaugaaaugagagggauaugugaaaguaccuagcacagccuuucccauuauagggaaaagggagguaauauuugaguaaccacuccauucaaaauguuuuguuagguaguggggcacauacagaaagugucugccuuugaguuuccagucuguucggggauacagaaugaauggaucugaaaugacuuuagucauuuagaacauuuuuuucuguuuaauuaagcaccacauauaagugccaucauuuuauuccggucaagcagaauugggagaaaaaagggauacacuccuuuuuuuuuuuggagacagagucuuacucugucacccaggcuggagugcagugguaugaucucagcucaccacaaccuccaccucccggguucaagcgauucuccugcuucagccucccgaguagcugggauuacaggugcccaucaccaugccuggcuaauuuuuauauuuuuaguagaaacgagauuucaccauguuggccuugcuggucucgaacuccugaccucaagugaaaaagggauacacuuuuacauaaaaguaaacuuucuugauuguagaugaugucaacaggcagauuuucaaggaagauaucuaauguguugggagggagagguagaguuacugaguagggggaaaaaugggucagcuagacaguaauaguuguauaaugugguuuuacauuuauuuauuuuuuugaagagcugugaguucaugauuguauuuauauuuaccuuuauuuucucaaauaauuaauuguaauaagcaaaauagauaaaagauagcauuuaugcgugaaacuagaaagcgagacauggacacaguaucaagauccagauugugcuauauagaauacagauugagugucccucauccaagauacuugggaccagaagaguuucagauuucaccuuuuuucuaauuuuggaauauuugcauguauuuaaugagguaucuuggggaugggucccaggucuaaauaagaaauuaauuuacgcuucauguguaccucauacacauagccugaagguaauuuuauaugauuuuuuuuuuuuuugagauggaguccugcucuguugcccaggcuggagugcagugcugugaucucagcucacugcaacaucuacuucccggguucaagcaauucuccugccucagccucccgaguagcugggauuacaggcacaugccaccacaccuggcuaauuuuuguauuuuuaguagagaugggguuucacaauguuggccaggcuggucuugaacucuugacuuugugauccacccgccucggccucccaaaauguugggauuuacagacaugagccaccacgcccggccuauaugauguuuuuaauaauuuugugcaugaaacaaaguuuguguaccuugaaccaucagaaagcaaaggugucgcuauuucagucacucguggacaguguguaguuguuuggcaucaccauuacucuugacugaauuuauaugcuacugauaagcagucauuuucuuacacguacacgugugaauuuuuuuuuuuuaaccuuuuguggguaugccugcaugggggaauuggggcaugcacgggaaugauaauugcaucuaaagagaggaggauccuguauaaauuauauguuguguaccuacauuuuaacuuugaucugucacauaaggucagguguggaauuuuccacuuguggcaucauguuggugcucaaaaauuuuuggauuugggaguauuuuuggggauucagauuagugaugcucaaccuguaauauaaaaauguagguuucuccuugauuguuauuuuugguagaauuaguuaaaaaugacuuucugagguaaacagcauggaaacaggaaauuguuuuuaaaaaggagugaguuuaauauauacaccuauguaccuguaaaaauugaaauuaaaaaaauuuuuuuuugaaguuugaaaggccaauauccauuuaaaaaaucucuuugaaaacugguaacuugucuaugagguaaauguuuguugaacugaaucucauuuaauuuuaaaauaaaaauaucacuuuuuuucaauuugaggugucaaagauuucaagacucuagcauaaaauugcuagaaaaauuggaccaauuuauuguggggauuagaugaaauacuguauguauaaaauaauauauaaaacgcaguacuaaugaaagggcuuaagaagaaaugucauauuuucagguuaagcaucgguacugauauuauuaguaacacuugaggcuuagaggaaaugguguuguuuguuagaaacacuuacuauagauuugauacugaaaucugcuuuggaauucuacaucucucuuaaaauaauuggagauauaugaaguaguugacacucuuuaaguugaaccaagcuguuagggaauaagaucucaaaucuuuaacaagacuuaucuggaucugcugacuuuuguagucucuucucuuguuaaucuguauucuagcuacacuucccuucagacccuuaaauauccugagcccauucauaucuccagcucuuauauuuucccuuugcauagaacagucuuuccaucccuuauccucaccuucucuuaacuccuauucguucuuuaaguuuuguaaaagggaaacagggaaaguuuucccugacucugugucuuauucuccagaaaccugucuuuuccuauuagcgcccuguucuuucaugccucuucuccuaggguguaauuacguauuuauuuguuuguuuauuugucuagcagugaacccaagcauuauccuagugccuggcacauagugaguucucaguaaauaauuguugagcaauuaaguuaaaauauugaguaacuucucuuuggaucuuaaucuaauuuuugcuuugcuuuugcuugcuucuucaucuuuuuggggugcauauucaguuaauagcuguuaugauuauugugugguaauauuuaccuuuaaggaagcugugcacuuuucacauacuuuuuuuuuuuguaaugacaccauucacaaacaaggaccaaguuaaguugcaguaagcuuacuuuuuuaccuccagagaaaugaaaacauguucacacaaaaaguuguauguacauuuuuauaguggcuuuauuuauaauaaccaagaacugaaaacaacucagaugcccuucaggugucaugucaacaacccaaauguccuucagcugcccuucaguaaucaaaggagcccuacugaaagggaucaccuggucuggagaaagcugguguuugagugugauuacuacuaaaauuuuccuuuggaauugauccuuacuuugcuggcucauguaaucaggcaucucaaacaguuacuucugccaaaaagcuuauccuaauugguucccgaucuagagcccucuauuguguguucuuacauucuuucauauuucuguaacgguucuguaauuguuuauuuacuuaacuguuccuuccacccaaaauagaaguuucuugauuuugucuuuauagccuucucaccuaacauaguaccugggacauugauugcuagauauucaggaaauguuuaaugguaugaaggauucucuucacaguaaccuguuucaaggacuucaucuucgggccuugaagagaauggacacuuggaaauucuccuccugauuuauuuggugcauggauacccagaugaauaguuaaacugagauuuuuaauagauggacaauccuucuauacuaugguuuaugacaugucauugauugcugcauugauuuugguacaucuggggugacuauuuaggagccuucuccucuuaaaauucguuguguauacaccccaaagucauguaauuacguuacagagaauuaccauucugauggugugaagauacaccuugggaaauacuuuaaaauccuggacagaaacugaaauauauaucugaaagauauguucauggguauuagguuuaaggauguuaaagcuauagccuugaaaagcuuuguucaugauuuaaguucccugccauuuguuucaaaggcacauuuacggaaauguguauuuuguguguauuuauucagcaaauauuugugugccuauuacgugguggacccuagaauccaucaaugaauucacaaagcagacaaaaaucccugcacugguggaguuuacauggagcuuauuugcugccucuguauguuucuauaugcauguguguagauaugacaucauuauaggacaggcagcauaauaaauuguuauaaggauguuuuguauuuuaguagaggacugauaaaauuggagggccauugcuaacucuucauuaucuguuaccuuauuucacagaucugcauuuugaauuuuuuugcccuggcuuauccaaacaggaaaggcaaagaaguuuuauuaaacaauugaaugaaaguuguauuuauuguucuagcaggugcaaagcauucugcuguaaauauugcaggguggaaaggauggcuaacacacaguucauaacuucaggaagcauauaguuuaauagagacaagacaaauauaugaauaauaugcaaaauaacaugaaugguacaaccaaugccuauuguauucaaaaaaggggagauguuacacuaaucagaaaggccaaaaugaaaaaaccuuugauaugagcaucaugaaaugccugcgaugauguggcacaauuggaacucucauuguuggugauguaaauugguacaauugcuuuguaaagauguuugguauuuucuuauaaaagucaguguauaccugcugagaaauuccacuccuuauguuuagccaagagaaaaagaaaacauacguucuaagaagacuuauucauagcaacuucauucuuaguagucaaaaacuagaaauagcccagguguuuaucagugguggaguggaugaucuaugguauagauauauaagggaauauuuaugcagcaauaaaagggaaugaacuacuugauaaccacaacaacaugaaugaaucucauaaacauuuugcuaaaagaagccuuucacaaaauaaagauacguucuaagauuccauuuacaugaaguuuuagaauggccacucauuuauugugguggaaaaaaaaacccagaacaguaguugacucugaaugggagagacagaccagaaagggacaugggaaaauuuucuguaguaaugguauguucugaaucuugauacagguuagguugugugcacugguuuaugcauugauaagacagugaauauauauauauauauauauauauauauauauauauauauauauauauauuuuuaagaucucugcauuucauuguaucuaaauuuugcaucaaaagaaaaugaaauauauugaacucuaauuaaugacaaacaugcugaguuauuuagggagacauguacucuacaguuuuacuuuuuugguacuuucaaaguagcuguauuaauguguaaauaaaugacuguggauagauaagugugcugagcaaguaguagcauauuaauaguagaaucuagauggugauuauauagguguucacuguaaaauucuuucaacuuugcuauauguuugcacauuuucauacaauaaaaugcgaaggaaaagaggaauaguauauauggaagguagcauaaggaaauuuuaaaaauguuuuuauuuaaguagaucuuaggauguagaaggauggaaaagauuuguuuugguugagggagggugugaguugguauagaggcagagaugucggaaaggcauuauaggaggagggaguaguaauaggagaaacagcagguuaagaauuggacuagugauugguuuuguuuggcuaaaguacagggcaaaauauugcaacaugaagauggaaaaguagaaggcauuuguguaagaaaucauuagaaguucaguuugugagugguagacuauuucuucguuugcagcaaaggggaaggaagaugaggagugugaaacuguaaaaacuuauguggaaagaaugaaaucuuuagauaauagccguugaccauuuccauuuucuucauaguguaaggguauagcuauuggauauuuauuuguuuuuugagacagagucucacucugucaucaggcuggagugccguggcaccaucucggcucacugcaaccuccacgucccggguucaagcaguucuucugccucagccucccaaguagcugggacuacaggugcacaccgccacaccuggcuaauuuuuucuuuuuguauuuuaguagagacaggguuucaccauguugcccaggcuggucuugaacuccugagcucaggcaguccgcccaccucggccucccaaagugccaggauuacaggcgugagccaccgcgcccggccagcuauuggauauuuauuauaagugggauuguggaucagugggauuugguacugaugagaucuuaaggcaaaugucagagauuugaggugauaaauagaauguguuaggaauucuggcaguagacauuuaaaaaauaucugcugguagaguauuacacugaguuuagugugaagucauugaggaccaaauccacauaguuucuaaauucuccuagcauuguuugacagcaucugugugggagaacagagcaaauuaaugguauuacucaguccuagagauuggcaaggguuaccaagaauccugaggugcagugaauguguaguugaaguaaagaggaggcaaguaaagccugugaauggugguagacuggaagaguuggaaugagucaagggucaggaauucacaaugaggacaaaagaagauucaguuuaaaaaggguggaggagaugcaggaugugguaccacguucuucucugcugaauuucagaguucuaaggucuucacagugaaacauuuggaaguaacuggcaucauccuccacuugaucacauaaaccuagaacuuaggaggcuuguuguuuuuuuucuuuuguuuuguuuugcuuuuugguaaccugauuuucuuuuuucucuuuuucaacuuuuauuuuagauuuagaggguacaugugcagguuuguuaccuggguauauuaugugauguaucuauuacccagguacugagcaaaguacccaacaguuuuucaacucuucccacucucccuuguucccuccccgacuccccacuguuguugccaucuuuauguccaugaauacaguacccaauauuuagcucacacuuauaaguuagaacauaugguauuugguuuucuguuccugcauuaauucaauuaggauaauggccuucaccugcaccuugcauccauguuacugcagaagacaugauuucguuauuuuuuuauggcucucuagaauuccaugguguguauguuuaauaccacguuuucuuuauccaguccaucauuaaugggcaccuagguugauuccauguuuuugcuguugugcauggcgcagcaauggacaugcaaguacauaugucuuuuugguagaacaauuuguuuucuuugggguauagacccagcaaugggguugcuggaucguucuugggaagucuuuaggaagccuucuugaaacuuauucucuuaaucuccaccucaacgagguuguuuuaauuuuugaauuuuugcugugaggauaaucuaaacuauaugagaauggauaacuagauagaugaacaagaugaauuacuauuuuagaacugauacacuccuucuugauuucaguugcauacaauugcauuuaugcugugaguuggugccaaauagaauagguuuauugucauacacaaaugaggaaagaucaagauggauuuaaaucaucuuugcaauaagugggggccaauucacagugagauggcaucacucaccccuuuacgaacuaaagagaaaauggcaagaaaauguauaaauauauuuugcacuggccucaguggcuuacgccuuaaucucagcacuuugggaggcugagaugggagcaucacuuaagcccaggaguuugagaccagccugggcaauguggcgaacaccugucucuacaaaaaaauacaaaaaucagcugggaaagguggcacgucuguggucgcagcugcuugggaggcugagguggaagaaucaccugagccugggaaguugaggcuacagugagcuauguucgagccacugcacuccagccugggugacgaaagugagaccgugucucaaacaaauaaauaaauaaaauuuauuuugguuuagauaugcacugaaacauauauaaaggccuagguuuauguuauuagcuauuuaaauaacuuuguaacaaaaauaauucuagucaauauuagggauguuuuagaaaggucuuauguuacucauauuugaaaaauucuguuguaccagaauaaauuuagguccuccuagcaugguuuauaaggccagucacaaccccuucuucuuaucucuccuuaauucucucuaaucaccuacuuuuguuucuuguacuuuaugacccuucagcaauauuaaauguucucuauuugauauacuacuccucuuuuaaaaaaaaaaauuguuuuaaccuucaccauuucuuuauccuuaaugacauagaucagguuucuccuagaagccuugcucuuacuuaggcuacucccuaaucucugagcuccuacaaaauacagcauuugcuguauuauuuuguuuucacauugagucuguuaaaaucauauauuuaauaaggcucgguauuagucaugauucauuuuuuuguauucccagcauauaguaccuuacagaugauaguaauuguugacaaaaucugaacagaguagcagugcuggugaagggcauugaugucaaacugugguuuucugaaagcuauucucuggaagaggaaguuuauuacuauaauaaaauagaggcuugggguauaccuuuaugucuuauguauacagucuguucucuuaagaugaaauagcuguaucagaaaauaguguuccauuuggaucagacauaacuauuccauugagcuuuauacauugcuguuuuguaagcugagcugcuucuauuucccuccccuuuuuugguucuauaguacuuaaaaauuacaucauacagugauuuacuaguauauuuuaauuuugaagucaugaguaggcagaauuguaaauaaaauguaaauaauacaaagauaaaguauuagcauauaaucuuucuacauuuucuuagaguuucuccuguuuuuuuuuccaggaacccugaaauuaucugcaggaguugcuucaugugauugcucuuuuuaauuaucuccaugugaagaaaacauugccaauaauguuagcuugcuuuuucucagcaguagucaguuuugacauuacuugccuaugggcuagcccucuacauuuuacagggcauaauuucuuaauaaacuuuuccccccauauuggaaacuuuaugacuuaaaaauaucugggaaauaaucauuacucauagaacugacacagaaguuguagaauccacacacguaagcauaaagacuuuuauuuuacuagggagaaguccucacgugauuuuuuuguacucuuauuuuaggcucuuuaaaaaaaauuuuggcaaauuaagaguugcagauuaguauggaagauaaaaaguugucagauaguuuuaagaggagacagcugaaagcaagacgaaaggcggacaaccugcuaaaagcaaacauaauucccaaaaagcguguuagguguuuuagcugcguaagcuauugguuauaaggacauuguuguguaacagcagaguguaauaacugaugcaauaaugaguuaauagaaaaaaguuaaauuacauuuuuguauuuguuuaaaaugacaaaggagugcgugauagauuuuaggaagauuuccaauaaaagacuuuuuuuuaaggcaauaucaacgauuuauauauauacuccuuuuugugaauuugaucauaauauuuuauaggaacauuuuugggaucuaugacaguauguuuaagugaaacuagaauuuaaaaauaugaauccucggaugauagcuuaguaccuguguguguguauuuuaagauuauuagaugugacuuuuuccuugaucuuucuauccaugggaaucccaaagccuuauauggucaagacuuagcuuuuagauuucuagugaaaugcaaggcaccacuccaaaaaagaaagaaaagaaaaaaaccaacuagcugucuuuuacucugucuucaguucugucuuuuugccugacuuuauuaccacaguaguuaaauuacuaagaaccuucugugcguugguagucugucuuaguagagggaggaauuccuuuuguggcaguaguuuuaugcuacagugcuguuauuuuaacagaacauuauaugcuauugguuauguaauuuuuuaaaggaaacuuaaaagcagucucauuauguuaugucacuauaaagguagagagggguuagaucuucaugugguguaacuaggaaguguagguuucauugaugguaaauacuagggaaggugaaagcaaaauuauuacuuccuuggaaucuuucugccauggaacuccugcuaccugaauagagggcacaggugauaaugaggugaacauucaggagcagcagugauaagugacaaagggaugcuaggauaacuuacuuguacucugguauguucuuauuuagcucuaaguacaguuaucuuuuugccuugaaggauaugauuuuucugaguggucaugaguaucacuuauuuauacauuuaacuccaagaugguuuaauagucuguagaaaauuuuuaguaucaauuacacauuuuucauguaggaaaaaggaaaguguuauuugccuguuuaacaaaagaaaauuggaaaagguuuuuacaauguauccauucuccuguaguaagucagcuaugauacagaaaaauuucucugaucacagugauuuacaggugacaaaguauuggcaaacuauuuccuaguccuacuaaugaagcuaaaucauacuuguagacaagguuucuuuccuucagcauuugauuacugucuaauguguucuagauacuguacauauaguaacaacuaagauggguucuugcuuuugagagccuguuugagagcccguaguguaguggaggcagaagggggagaaaagggaugaauguaaagauaguacauacgaguagauaauuauacaauuuuuaaaguauguuaggacagguauguuauaauaucaccgaaaauagugggaggcaguuauucaaccuuagcuacauuaacauaggcuggagaagacauuggaaauaaaggcuuaagguguaaaagacuaaauugaggagaaaucuguagggucuaacagugugucauccauuacucagggcacccuuuaucuuccuccagagaaguuaaaaguccuaaauuacuguaguuaauuacuuuuuuuuuuuuuuuugagacacagucuugcuuuugucgcccaggcugggaguacaguggcgcaaucuuggcucacggcaacuccaccucccagguucaagcaguucuccugccucagccuccugaauagcugggauuacaggcacucgccaccacucccagcuaauuuuuguauuuuuaguagagacgggguuucaccauguuggccaggcuggucucgaacucuuaaccucaagugauccgcccaccuuggccuuccaaaguacugggauuauagggaugagccaccacgccugaccucaaagagcauuuauuaacauuugccauucaguaguuucauggaaacaguuuggaaauacuaugauaauuuuuuuuuuaaguaacuuuacucucagaagggcuccauacugacaguuguuucaggaggcagauuaaaaauucagguguucuuauuucugcccuauuacuuccccuuuugacaggauagugauaugcuuugaagagguguuaaaacuuuaaauauaaaaguacuagcaucgaagaaaaugauugaaugaaugaauuaugcagcagaaaauuuauauuucccucaaugcaaauguauaaaaguugacauuucuuuuuuaaaaaaauuauugccauuugcccugucuccucaaaaguaaauauuaaacgaauaauaauuuuuauuauuuauuagaauaacucugguuagacuguuguuuuguauaguuuuuacuuguuaaucaugaguacugccacauuaucagacaauuauuauuuuuugguucucaaguuauaauuucggauugggcauguuuaagaaauggaggguggucuaguguuauuagagcuuugaauuugugcaaguggagagagaggacuaaguuuagguaacucuuacuugaugacauuuaagaagggugaaaauacaggagaaaagacagauauuauaaguugcggaagggaacauaauguuuggauacacauaagcuuaagcagugaagacugguaugaauacuuuauacauucaucaaaauccaacaguauggccauuaguuaucacugcauaguagauuacccccaaacuuaaaauaccaaacauuagcucacacuuucugugggucaggaauggauaugacuuagcugggugcuucugacuaaagguuucucaugauauuuuccucgagcuauuggcugggacugccaucucaucugaaggcuuggguaggguaggguggggaucugcuuccaaguucacuuauguuauuggcaggccuugcuuccuugccacaugugucucucaacauggcugccuuccagcaugacauuuggcuuaucccagguugugagugauccaggagagagcaagagaggagggugcaugccaagauggaagccauagucuuuuuauaaccuaaucucagaagugacaucuuauuacuucugucucauuaaguuuguaagaaacaagucacccagucuaggggaggcaguuacacaagugugugacuaccaugagguagugaucauugccaccuuagaggcuaccuacuauaagcaaacuaauauaauauuugugguauuuuacauucuucaauuuacauugccauguacuuagcaguugguuccuauuuauuaugccuuaagagcugcuuguuaucucccuuucucacuauucaacaagauacuugaaucaauuuuaucuuugcuucuuuccccucugcccccaucuaaauguucagugccccucuuauuuugugacuuugaaguauuaacuccuguuuccucaacuccccuuaucaguggucccagaaaugcagaguaacuugguugucuaaaauggaaaauauuauuuaguuaagauaaccauauaagauuuuuucaauccuucaucauccccaggauccagaauuauauauucuuaacuucauuuuuuauuuuuuuaaaaacauaucugaauauagcugaauaauuacuagguucucagucucucuuauacauaucuuugcucuuucuuucugaaaaggauucaggaauguaguuccccccugccuuccaacuuuuuuuuucuuuccaugucaugacaugacaaaaaaaauuucccuucucuuccaaaaccuuuccccuuuuucucaauuggagagagagagaaagagagagagagagugagugaaugugugugugugugugugugugugugugugugugugugggugggugugggugggugguguguguguauucuugagguuucugaaguuaccuauguauacuggaguaaggagaauuugagauuagagaguuaauauuagaaauuuaucuauguguaugcuuaugucugauggccuaugaguuuauugcaggcaagguuuggcucucuuuuaaaacgguuuugagcuaggccuccaugcuuuauguuaaaaaguaaguuguucaauuaauguugauuguccguaacuaaccauuguuuaauuagaaagcaucuuuucagaaucucuuuauacaaauccuuugauauacuuuuguuaaaaaggaugcauauuacauaugcuuauuuuaauuaaaaaauguuagaagacugaaguaacgguucaaauuuggguaaauuuuccuuuacaacuagagagaguauuuucuuaaggauuucuuuaagauuuagaagauaggccugaaaacauuucaguggauauuuuuguguaggauaauuuuuaacuacauuucaauuuuggacuuacucaauuaguugcuuacuggggaagaugaggaagucagcacucauccauuuuaaucuucaucucauuuuguuagccauguuacuauuucuaccuuauuagaguguaugauauuuaaauccuuucuaauuuacuuuguaugaguuuuucaaccgugcuuauuuuguuguuaaauaagauuuaucauccaccuuugaucucuuauuuuauucaauguuauuaaguagccucaaaauguagggcauuuucuuugguuuuucaaguuauguccucuuccacacugcugucucuaucugaaguuuuacaugcuuauauacugcuauggucugaauauuucugucaugccuaaaaauucauaucuuggauuccuuaccccaaggugugaugguauuagaagaugggaccuuugggagaugguuaggucaugagggcagaacccuuuuaaauugaaauuagugcucuuauaaaagaggcccaagggagcugcuugcccuuccaccauaugaggauacguauaugagucaggacgcagaccuucacuggacauggaaucugccagugccuugaucuuggacuucugacuccaaaauuaugaaauaaauguuugcugcuuauaagucccccaguuuaugauauuuuaaaaaugacagcagcucaaacaaaccaagacacauuaaccccaaccccaccauuucuuuuuaauuuuuucuuccuguaguauguguuguucauaguugcugaauuagguuagacuacagagggcugauuuguauucaaggauuggcaagaaaaguuuagaaccagugcagaauuguaucaaaauagcaagugaacaguacaaauguuguaaaccagauaaagauacagggauaugggagauauuauuucccagucagugucucccuaccucauguguugguggucauuguggcucacuuggcaugaggaacccaguggggagcagcucagagccuggauuuuguugucuuuucuaucacuaggcugguggagaaagaagcaaagugagagcccaucagcuuucucuucugcauguuacuauguaggccauuccuugcugugacauucauuuacuagggcucuauuuccuacucccuuauagggccuucaguugaacuggacauguucugucacaauugccauaguguuuauucuguaucuuuuuagagauaauccauaugugaacaaauacacacacacaaaauauaucacauuggucagagacuacucguguuuuacauuuguucuuuucacuuugcaaaauauccaggaauuuguuucauauuaguccauaaauuaguucuuuauugauggacauuuaaauuguuuccaguuuuacacuuaccagaacuuagcaaauaauucuguacaugucauuuugcacaugugauuguaucugcagaauaaauuccuagaaugaaauugcacugucaagggauaugugccuuugaauuuugauagauagaaccaaauuguuuugggguguuauuuuaccuuuugcugcugcuguuuaguuguguagccuauugguuagggguacagaugcugaagccagacugcuggguuaaaauccugaauuuugccaguuaucaucuguuaaaugguaguaauaguucucacuuacuggguuguugugaagauuaaaugaauuaguauauguaaacuaccuggaacaguuccauggcacguauaaaagugcuauguaaguaaggguuaguguuuauuuaggacauggauucuguaaaauguggcuucacucugccauuuuuacuaggaagaacuucuuauaauucuauuuuccauuuuccccuugcuucuauguaacugcauuuuauuucuuucccuccugccucuucaagcuacugcuucucaacccucuguuguuuccccuuucuuaaauacucaugcccucuggguucugauguagcuuucucugaucacuuuuuacacaugcugcuugugccuuguuauuuauuccucuagcuuugguuacuguggguaucagugguucacaaucuaauguauuuuacaaguuagaugggcaacuucuuuaaagaggaaauuucugggcaccaccuucagagauuuugauuucuccucucccccaaauauugguuaaguacuuuaguuaaauccauagcauuuaucauagcucuuuuuguuguuguguguuuaguuacgugucuugugcuggacucuaagcugugugaauucagguaucuggucuguauacuucaccauuguauuccuaccagccagcauagugucuggcuguagcagacacucaguaaauaauuguugaauuauuaaucuguucucuuuauggcccacuuguuuugcugaacacuguuucaucaagaaacaauuaguuaacaacuauguguauuaacuauguuaauguuuuguuuuggaagacuguaacaauuuuauguccuuacuguagagauguuuuugggaaauaacucagugacuuuaagagguuaaugacuuaaaguguuaauuaacgcuuugguguguagucuuccaggcuuuucauuagacauugcaacagcaagaauugugucauauuaugaguauucuuuuguaacuuguuuuuuaaguaaauaguaaguagaagcuuuuguuucccugaaacuaaaauuuucgcauuaguauauuuauugaguguauuuauugauuaaaccccucuagcugaguuugugaaccacaucugauaaacgauagaauucagcaaggaaaccuuucucuguaucugccuuccacccugucuccagagugcagacaguaaugagaccugcauaacauuuauuuucuccaaaaaguuuucuuauaacuuauuuccauucacauauugaguuuuccuuuauuucgcuauaucgcuguuaaauuucauagcauuuuucuacuuacuugcuuaucuuuuuuucuuaauugggcauccuguggacaagauuguuuauuuuaguucaucaacaaaaauuuauugaaauagcacugucaggaauuauggaauguguaaggcaguuucuauucuuaaggaacuauaaucuagccaggagaagaguggaaauacauaaaauacuaauaaagucagcaugucuuacacaguacuuaauacaguuuuauguauacauacacacaguaggucauaaaugccuacuuauuuaagaaauuaguauuuugguucacuacauauguauuauguauuugcuguaugcuaggcauugugcacaaaggaaacaggaaaauaugcccucuaguguuggucuuuguaucuaccaaaaugaaugacuuacugcauuacguuauaugugguaggcagucaguaaaaauuauucaugaaagaaugacccugaaguucaauuuauuuuguaucccuaaugacuaaacuccagaagaaauucugugcccuuacuaaguccccaaauaaaaguguuggcuucuaaaaaucuagguucaauguacuacuuuauagauuuuuaucaguaaaggaaauaacagagcuauguaacaagaauagauaaagagcauauuuuaaucuuuggauauuugugguuucuaguuuuuggcauucucauucaaauauauaguauuuguugaaugaauauuuauacaguaauuaaauuacuuuuucuuuagaaacuuuuguggguuuuuugucuugaauuguuuucgucagauuuuuuuauauccuguauuugcuaugucuaguucauucagucaacaaauauauauugugaucucucuuugucagacacuguucuucuauaauuacucuuagauacuauauauaagccucaacuuuuguuuguccaaaugaagaguucccuauggucuagccauuguguauguuuuggauuucuuguucuagucaucuugucauuugaaucucauuugaauauuuaauuauuguguggauagauuucuguuuuuacaucuagauuuucacaccugagguaguagaaaggugagaaaaggucaauuuaaaugcaaugcuggacucuuuguuuucauaacuaaauauagacggccuccuaaaauuguacuugcuuuucauuugccaguauucuaaugcaagagcuagguuuuucuuuuuuauuauuuaguauaggaguacugcuuggaguuuuucuuugucuuucuuguguaaaccacacccauaauuccuccuuugaaaugucccacuucaguuuucuuuaaaauagaacaaaaacauugcuuggacaguauccaauucaguuccucuuuaaacauacugacauuuaugucgcccugaaugcuuggggcaugaaauauuuucuaguauauacacacaauuucugcuuguaccaguugagcuugucguaagagucauaaagaauuguuucuguuuggcugaaugugguggcucacaccuguaaugccagcacuuugggaggccaaagcaagaggauugcuugaggccaggaguucuagaccagccugggcaacauagugagacacuaucucuaacaaaaaacaaacaaaaaaggaauuguuucugugaagaggaaauugacuaagagaacuucuguauucaaaguaauucaaacuaauuugccuauuaccuaucaauaauuagcuguuccuaaugauuaggcacaaauugcaagcauuucggguaauggacuauaauuucauuuucaccuaaauuguuauaauuacauuuauacaacucuuuucuuuugcuuugcucuucugaaucauauauaaacuuaugaaugaguuugcagaaaaguuuguuugaaggauguuuguaaucccuaagauuuucuuagggcaucuuuuaaaacuuaaccauccucuuagaaacuuuuggcaggugggacucuuaccugccaccugccaccaaaaguggcacuaaaaggaauauuugacaauucuuugccauuuaacuguuucauaauuuauagugggauaaaaaugcauucuagaauaauaauauaaaaaggagaaaauaauuuaaauggggaagaauuagcauggacuauauaaacaauaguguuuaacuuuuugacagguacuacuuuaugcgcuguauauauucauauauuucucauaguaaacuuuugagguaguggguucuauuauuauccucauuuucaggaggagacuguggcacacaagaugggaguuuacccaagaacacccaaccaguaaauggcagaacuggauuaauuccagacagucuggcucuagaguuuguacuuuuaacaaaaauaauuucaagaaaaggaauauaacaauguuagaauuuauuucaaaugcuacuuguuuugugauggcaaguuuacucaauuuaauuauguuuguuuaaacauacuuguucuauuuuaggaaugaaauuuaauguuuuuucaagcuacacaucucaagaucugucuuuaagucauggacucugucugcuuugagcauuguauaaacaccuuguuaacucuuuguuagcaggcuucucaauuuuuuccuuaugaacauguguggaacaauaaaaacuaaaguuuuauguacuugaaucaguuuacaacucaaguugacaaagcugccuguacguggaauuaaaugacaaaacugucuucacacagccauuuauuauugguaauuguucugcauuuacauucaagaaaaacuugaagguaaaccaugucagauaagauuuugaaaguguauuugagccguucugcuucuuuccuuauaugguucaguaaacugaccaaauuuagucagaaauuuaagucagcaagucuuguuuuucuuaaugugcuacauguguuagcuuuugauucuccuagcaacaauauuuuuaugggcaugcuuugccaguuucuuguauguacuuuauaaauguugaggacaacaguuugaacaauuuacaccacuaauuugagauugauauaugauauauauuuugcggcaaugcuuuuagcauuuaauuuauauuaaaauauuucaaaaacauuuauaaacaaaagaacaagcagauuuaacauuaauugcuuuugguauugguauuuuguugguguuucuuaugucgacuuaaaaguauauacauuuaaaaucaaaauuagcaguguuucauuuauuggagaauagcuauuucuguguguuaaugucuuucaaagagccaguguaaucaccuucuucaaauggagaaacuuuaaaaauuaccaauuugucaugaaagucuuuuaucuuaagugucaaaggauuacucaaaagauggcagauaagacccuauucuggaucuugcuuaccucaccguauuuggcuuugcgucuuuauauaccagaccuguuuuucacuuguucuuauguuaaacucaaauauaugaaucaccuccaggaaauauucccugacgaccaccauuccuucuuaguucuccuuuucucagcucucauaaaaaccaguggacgugucugaaauugucuuaccauauuccuuuugauauaaucaucuauuuuuguauuugucuucuguacuagauggugucuugaacuuucuauuucuagcuguuuacugacuaagguaucacaaaugucuguuuuccaagcacaauauccugaucauaauuuaaucuuaccccuuuccuuacuguuuucaaaaucacuucucuacacucuuucccugaaugauuucaagucccauuguuuuauuaccucaaugcagauaauucccaaauugacauuuucuucccacauuuauuuucacagcuccagaucuauaugguuagauagguguacagacaccuauaaauucagcauauccaaaacaaauaaaauugucaucuuucuuuucccagucugcugcuugaaucugugguguuuaucuucaugaaugucuucuuccugcaucuuaacucuucauaucuuucauuaaaccuugaacauuuccuccuaagcuuccuuaauacaguuucaugaguacaggcauaccuuagagauacuguggguuugguuccagacuaccacaaaaaagugagucacacaauuuuuuuugguuucucagugcauauaaaaguuguguuuaugcuauaccguagucuauuaaauguaauguagcauuauaucuuuaaaaaaucauaaugcuguaguacauaccuuaauuuaaaaaugcuuuauugcuaaaaacaaaugcuagugauuauaugagccuucagccagucauagucuuuuugcugguggaggguuuuuuuuguuuuguuuuguuuguuuuuguuuugacggagucuugcucugucgccgaggcuggagugcaguggcacaaucuuggcucacuguaaacuccaccucccagauucaagcaauucuccugccuccaccucccgaguagcugggauuauaggugcgugccaccacacccaacucauuuuuguauuuuuaguagagaugggguuucaccauguuggucaggcuggucccauacuccugaccucaugauccucccgccucggccucccaaagugcuaggauuacaggcaugagccaccgcgccuggccuaguggagggucuugacuugauguuggcugcugauuaaucagggcagugguugcugaagguuggagugacugugacaguuucauaaaauaagacaaguuucccucaucaacugacucuuccucucaugaaagauuucucuguaguauaugaugcuguuugauagcauuuuacccccaguagaacuucuuucagaauuggagucgauccucucagacccugccacuguaucaaccaaguuuaugucauuuucuaaaccuuuuauugcuauuucaacaauguucacagcaucuucaccaggaguagauucccucucaagaaaccacuugcuuugcuuguccaugagaaauaacuccucaucuauucaaguuuuaaucaugagauugcagcaauucagucacauccucaggcuccacuucuaauucuuguucucuugccguuuauaccacaucugcaguuacuuccuucacugaagucuugaaucccucaaaguccaugaggguuggaaucaacuuucaaacucccauuaauguugauauuuugaccuccuuccaugaaucaccaauguucuuaauagcauguagaauagugaauucuuuccaaaagguuuucaauuuacuuugcccagauccaucagaggaaucacuaucuguggcaacuaacuauagcauuacaaaauguauuuuuuaaauacgaagacaugaaaguggagauuacuccuugagcugcagaauggauguuuuguuagcaggcaugaaaacaacauuaauccuguacaucucccaucagaccccuugggugaccagguucauuguuguuagcagcaauauuuugaaaggaaucuuuuuuucugagcaauaggucucaauagugggcuuaaaauacuuaguaaaccaugcuguaaacagaugugcugccauccaggcuuuguuguuccauuuauagagcacuggcagaguagauuuaguguaauucauaagggaccuaggauuuuuggaauggguaaugagcacuggcuucaaacuuaaggucaccagcugcauuagccccugaaaagagauucaaacuguccguggaaacuuugaagccaggcauugauuucuccucucaagcuauaaaagugcuacaugucaucuucuuccaguagaagguugccgugucuacagugaaacgcuauuguuuaguuguagccaccuucaucagugauuuuagcugcaucuggaagaugcagcuucuccaucagcacuugcugcuucaccuugcacuuguaugauauggagauugcuucuuaccuuaaaccucaugaaucaacuuccuguuagcuucagacuuuucuucuccagcuuccucaccucucuugggcuucauagaauugaagagagcuggggccuuacucucuauuaggcuuuggcuuaagggaauguugcagcuaguuugaccuguccaggucacuaacacuuucuccaugucugcaguaaggcugcuuugcuuucuuaccauuuguguguucacuggaguagcacuuuuaauuuccuucaagaacuuuuccuuugcauuaacaacuuggcuguuuggcacaagaggccuagcuuuuggccuaccucagcauaccuuucucaccaagcuuaaucauuucuagcuuuuaauuuaaaaugagagacacaugacucuuccuuucacuugaguacuuagaggugauuguaggguuauucauuggucuaauuuuaauauuguuauuucuaagggaauagggaggccucaggaaagggagagagauggggaacugccgguuuguggaguggucagagcauauauauaacauuuaucaauuaaguucaccaucuucuaugaauaugguucauggcgccccaaaacaauugaaauaguaacaucacagaucacugaucacaaaucaccauaacagaucuaguaauaaugaaaaaauuuaaaauauugugcaaauuaccaaaaugugacacagacaugagguaagcacauguuuagaaaaguggcaccaauacacuugccugacacgggguugccacaaaccuucaaauuuuaaacaaacaaacaaaaaaaugcaguauccaugaggcacaguaaaacuagguaugccgauaucggugguuguuuagcucaggcccuuuccucuucuuauugcuucugugaccuuucugaaauacugaucugaucacgucacccuucuuccuaaaaacucuaaauaagcuuuuucaagcaucaucuugaaauucuaaaguguuuuuuucuacuuucuccuacuacuuacuugagccaccguuacugaugggaacauagcagauucuguucgucuguugagguaaaaagagguugaaaaucaucuguaguacaacuacagucuuugcauuauauucagaucuuuuaccacuuagccuuauccuguuuuauaacuuacagauacugucuaccacugguugacugacuguuuguuuauuccaugaacuuuuaaaaucagcagugucugugcucagugagguucuugccaguugauuugguacuugaacucuuauauaaucuucaaaauuaugcucaaauauguagggacccguauggacccucuuagucacaaaaagaucucuuuauguccuccgugauauuuuaguacuuucuacccacugcuauuauggcccuuaugugaucauuguuauuuauggacuauccaacuauauuuuaaugugaucuuuuucauacgaucuuggcauauauacuuuuuaguauauauaauaugaaaaauagcuaaaggaauuagugauauuuagccguaaacagagaauaugcuagaauucuuggggaaaaaaauguuuucagaguauuuagagguuaucaguuaaaagaaggauugcauuugguauguggagcuugaggaggcaaggcauggaaguuaaaggaauacauauuuuaagugauacauaguagucucaaaugguagccugcuuuuuuuuuuuuaacuuuuuaacuugagguauaauuuacauugguaaaguauacaacucuuaaguauacaauucagugaaauuucacauauguauaucucuauguaaaaaucaccccgacaaagauagggacauuuccaacuguccggaaagcccccuugugucccuccugucauucucccacagauuuaacccugguucugagucuuaucaccagaucuuauuuuaucuggagaccugcaguauguauccuuuuguaccugccuucuuuacucauuuauguauuucauucauguuguugaagauagcaguauuuuguucuuuuuguucaauguucuuuucuuuuuuaaucaguuuauaggauucuguuaugugaauaggaucucccuuucuacaccucaccccacccuguguauuuaugcauuccacauaacuuuaguagaugcuauuagauaguuuucugaagugguugugugaauuucauacuuucaccagcaauuugguuguuuucuuuuuuuuuugagacagucuugcucuguugcucaggcuuggagcucaguagcgugaucuuggcucacugcaaccuccgccucccagguucaagcgauucucaugcuucagccucucaaguagcaugugccaccgugccuggcuaauuuuuguauuuuuaguagagacgggguuuugccguguuggccaggcuggucuugaacuccugaccucaagugaucugccuaccucagccucccaagguguugggauuauaggcaugagcugccacacccagccuugguuguuuuuccacauuaccguuuaaugcuuuuuauguaagaaagaacuucuugaauuuuuuacuugaaacacuauucauuguagacauuuugaaaauaaaggaaaaauuaaggaagaaaauaaaagugggucucacaaccauuauuuuuaaccuucaggaugcauucuuuuagucuugugugaauuuuuuuaguaaaguugauguuuuggcuguguucccacccaacucucaucuugaauuguaguucccauaauccccauguguugugggagggacccagugggagguaauugaaugaaucaugggggcaguuacccccaugcugcuguucucaugauagugagugaguucucacaagaucugaugguuuuauaagggacuuuuccuguuuugcucggcgcuucuccuugccaccgccaugugaaggaggagguguuugcuucuccuuccaccaugaugguaaguuuccugaggccaccccagcuguguggaacugugagucaaaccucuuuccuuuauaaauuacucagucucugguaugucuuuauuagcagcauaagaacggacuaauauaaaacuuuaaaucauauuaggcauuaaaaaauacauuguguguuuucuccuauauucuuuuauccuuuuccauuuccauauuugcauccuuuuuaaaaaaaacuugcuauaccaccuugaaaacaccugaucucaucuaaucuaggaagcuaagcaggguuggaucugguuaguacuugaaugggagacuacuaggaauaccaguugcauuugguauguggaacuucaggaggcaagacauagaaguuaaaggaauagguauuuuaagugauacauaguagucucaaaugguagccuguuuuuuuuuuuuaacuuuuuaacuugagguauaauuuacauugguaaaguauacaacucuuaaguauacaauuaagugaaauuucacuuauguauaucccuaucuaaaaaucaccccagcaaagauuuguaguuuuguaguguuguaggcuuaaaaaacaaaacaaacaaaaaaaaaaccuucuuaauauauugugggcauuuccccauauucuuuuauaaagaaucauuucuuauuugcuuguugauauuuuucgguuuaaaagaauaaucauauuuguauuacauauaauuaucaaguaggguuuuauauucuuauacugaggauaaaauucaggauacaguuuuggagccuaugggauuuaaaagagguugagaaaaaaaggugaacagaauuuaaugaguaucagccgggugugguggcucacaccugugaucccagcacuuugagaagccaaggugaguggaucacuugaggucaggaguuugagaccagccgggccagcauguugaaaccccauuucuacuaaaaauacaagaauuagccaggcaugguggcacacaccuguaguuccagcuaccuaggaggcugaugcaagaggaucgguugaacccgggaggcggagguugcauugagccgagauugugcugcugcacuccagugugggcgacagagcaagacucugucugaaaagagaaagaauuuaaucaguaugauuucucaaggaaagugaaugauuaugcaagucacaguaagucacucucuuaucucagcauucuauaaacuacuuucuaauacaauacacuuuuuauguuucuucgucauuaaauagcugugauucucaaaccucuuucuuuuaaccacugcccugugaaaaauaguuuucuugagcaauaucuguaucaacguugccuauguauucuuuuaucaucuguuauauguaagauauguucuaggcacuuuggaaaacugccgucagcuugcuuauaacuuguucuagagggaagauacauaauaauuuuaaauaugguagggaauuuuuaugauaaauacccccucacacuucuucccuccacuugaaauauaaagacaccaacguccaaaaagauuaaauuacuuguucacagccacaaaauuuguggcagagccagaacuagaaccuaaaaccaaaagcugugauucccucucaaugcuuuuacccuuuuuuuuucugagauggagucuugcucuguugcccaggcuggagugcaguggcaugaucucggcucauugcaaccucugccucccggggucaagcgguucuccugucucagucucccgaguagcugggacuacaggugugugccaccaugcguggcuaguuuuuuguauuuuuaguagagacaggguuucaccauguuucccaggauggucuugaucugcugaucucaugauccaccugccucagccucccgcuuuaaaacuuuuuggguacacuguauagugcuuuucuugauagaaacuuugucauuuucuuccuuagggaaaugcugcuaaaagcauuucuuuuguuucuaugguaguuaaggaaaauuuauuucauguauacaaguaauacuuagccccuagaaugcgugauauccuguugcaggugagaaauguguugauaaacuaggaacaucuguggaaagcaguguguuaaguguagaaaaagcuuaguuucuggaaccugagcaucucugugagauucccagcccuaucauuuccugucugugugacuuauucaagcuacuuaaucucuuugaaucuuagcuuccuccuacauucauuaauucauuuauugagcccaagaacucaagguauuguggaagcagccgaauucugcaugucaagaacugugcaugguauugaggaugcagcagaauuccugcucucaguaaacgcucauucugggaguggguaaacagaugguaaauaaguaagcaaaguauauauaguauguuguaauaaacgguauggagaaaaauaaaguagauacucaggauauaaaaugguagggaggggguuguaauuuuaguaugcuguccaagaaaggcaauaccaaaaaggugagaguugagcaaagacuucauuuaugaaauguggauacagucauaucuuauuuaugcauugcuuguguauaaugcugauccauuaucucucaucagccagccccaaacugcucuuucuuagguugaaguggcauuuaagaagcucuuuuguuuucuccaagaguuacagucugacauuaauauccuuuuuuguuguuguugauguguuuucaguccuagaaaauaguuuuuuuucccaaauaugaacaaacaggaacuuccuuuggugguuaaguacugucuugguguuuaagccucuuuuaaggggauggguagauaaagguaauggucuauguguagcaaaauguauuagaaccacuuuuuaaauggcacaucaauuuuuauuacuuucaacagcuacuucaaauauccuuccggauucuuaauaaacuugggcuuuuuauacauuuaaauggguagcacaugaauuuuccaacaaagaucuuuuggcaauaaaccaaagaugacaguguguaaauuaauaugucuacugaucaguuuauuagaaacacuuuuagaguacagagauaauagucaucagcccacauacuccuaguuguguauuaguuguuuaucauagauaggaaauaggagcuaauuaguucauuuacuggguuuuacccacauuagaaaaaaagaggccacuugcccucugggcaaauaguggcuuugugugaauuaggacggaaaaaaccuuucaccaaguuaaaggcuccuugaguggauuucaucccaccuucccaaucccccaagucaaauacauggcacagacuuuacauucuugggcagggguccugguaauacauggggauugcaucucaggagggacaauaugaugaugauuaugaauagugccaauuccagaaagccuccccaggguaaauggaguguguuuaugaauacaaccuaucucauaggacagguauaaaguacuuauauucacauacagauauaucccuaaucugaaaauuauggaguuuacaaucuaguagagguagaacauagguauaaauaagaaaauuguggcuauugauauuauugauaaugugauagaguacuaggaauuacuugaaaaggaugacuaggagggccuuccugaagaagaaacaucugcauugagauuuguuuaaugagaaggaaucagcaugcuuagaucugggggcagagcauuccugacagugagaacugcaagaacaaaggcucugagguaucuggucaaggaauaguaaggucccuauuguggcuggaacagagugauuuuaggaacaauuguggggaacaaugaguaccuuggaguggguuuuugugagaauaauguauguaaaucauagauaaagcaccuuucauacuaccuggcacaaagcaagcauuugauaaaaguucccuucuuauuuacuuuagggcuguaguucucaaauuuuuuuuuuauuuuaggacuucuuuauauucuuaagaauuacugaagauuccaaugagcuuuuguuucugcagguuauauguauuaauauuuauagucuuagaguuuaaaaccagggauuuaaaauacaauuaauucauuuaaaaauaacaaugauuuaccccuguuaccaaaugacauuuuuuaauuaaaauaacuaauucauuuuuucuugguuguauguauuaauauuuacagucuuagaguuuaaaacugaggauuuaaaacacuauuuaaaaauaauagcgauuuacccauguuaccaaauaacauuuuuuaauuaaaauaacuaauucauuuuuucuugaaaguuuaucauuggcaacaaauauacuguuaauugcuuuucuuuuuuuuuuuuuuggagacggagucuugcucuguugcccaugcuggagggcaauggugcaaucuuggcucacugcaacgucugccuccuggguucaggcaauucuccugccucagccucccgaguagcugggacuaggcgugcuccaccaugccuggcuaauuuuuguacuuuuaauagagaagggguuucaccauguuggccaggauggucucgaacuccugaccucaggugaucugcccgccucggccucccaaagugcugggauuacaggcgugagccaccgcgccuggcguuaauugcuuuucuugaagugacagacucauuuuguucauuugcaagaaaagaucucccaaaaaucaaaguuagacuaacuguaguuugucauuuaaguagacauaauguugcauggaaaaguggcuaagucagcuugcaucucaaugucacaagugcuuuucaucaagacaaccaucauacuuggaagaggugcuuuaacauacacuucccaucuuguuccagagaauauaaaaaagaccuguauacaagggccaagauuuaauauguaccgcuuugucaaagacauauaugagugaaaauugcugcccccuaaccaccacuuuuuuuggagacagggucucacucuguugcccagguuggagugcaguggugugaucauaguucauugcagccuugaacucaaacucaagcgauccuccugccucagccucucaaguagaugggauuacaagcaugagccacugugcuuagcaauguuuuuuuuuuuuuuuuuuuaaauuaugaguacaaagugguugaaacagugacuguuaauagaggugggguuuuuuuggccacugccauuauuugugcuaaaacacaugcaguuuuacagcugguacuuuuauaccaucacguguacaugucaacaaaguaaaaaagggaaaugacaucuuaguuuuuucuugaaaacaguuuugcccuaaucaacucccuaaaggaaucuacucccccuucccccagcagacaacauuuuugggaaccacugcuauagagacuauuguuaguacuuaauuauaaugucuucauuuuaauagguacuuguuauccagauuggguugccauaaagagucuaggcacauacacuacuguuguauguguaccuaagcaaggacccuuaacaauuuagugucauuagcauguuugauggaguauagucaagauagcagcagauuuauuuacagagaauauuuauauuauaaaagcuacaaaguaggaauuuuauucuauugauguauuauuuggaguguuaauucguauuuuuuccaaucuugcuuucuguuuuguuuuuaggcuugcauugaugacaauguugauauggugaaguuucugguagaaaauggagcaaauauuaaucaaccugauaaugaaggcuggauaccacuacaugcagcagcuuccuguggauaucuugauauugcagaguaagccaguucuguguuuucauuuuauucuaauacuguuugacagaccugaauguuuauugaagugauaaagauaaaugagugaacucuuauauuacuuuaauucaugaaaauuauucuuuccaagaaagaaaauaagugguuauugggaauccauauauucucagaaucagaucuucuuuuugucuccccacccucuuuggccuuugguacuucguauuaacauuaguaauuguacacauucucugucuccaucuuuuuucuuuugaguacagcuagagcauuuucaaaugauugaggguuaauacuuagcagucuaacucauuccuuuauaaucauaaauuuggcaacuggguuacauugcuauagggagaauaugauacauaguucuccagugagccuguuuacuuaguuuuucugaagauugucuuuuuuaaaaaauacauuuuuuagaaaauucaaugagaaauagucauuguauucucuacuaccuuuaauguguggguacacacuaagaacaucugauuuuuuaaagcauuuaacaguggaaguauagauaucuugaaaaauaauuuuuucauuaaauuauuuuucuuauuacuaucuauccacacaguaaacaguuuuguugucucucugcucauauaugaaagcuuaucaaugaauaaauauugaauaugggaauucuacucuguaaauaucuuaguaagccuucauaguuuuuugucuacauuuugcuuuuuuuccccauuugugcuggagauacaauaucucaauuucaaggcagaaacuguauggugaaaugaaaagugcuccggccugggaacgauaaggucugaauuacccgaauuuuauuacugacucugccacuaacuauacgacaucuuuccauaauuuguuuccucuuucugagccaugauuucuuuguauauaaacugaggaagucuuuuucccguugcaaaacagcagugguuguucaaaccuaacaauugugauucucaaguucuuuacuuccuuuuuguacuuuucccgcucaaucucgaguucuuuacuuccuuuuuggacuuuuccugcucaacagaagacuuagaucucuucauagaaaaaaaaacccagauaauugugcauuuaucuuuaacuacacuuaaugauuaggcucuggaguuaauugauauggaauaugaaugccuccucagucacuaucaaggaguauaaccuuggcaaguuguuuaacuuuucuaggcuuugguuuucucuucuauaaaguaguauuuccuagguuuguugugaugauuaacugcaguaauucaucaaacguaggaccuggcucauaggaaauaguacauauuaacuuuugaccauuaccuuuuguaucuacacugggaaaauuaaaacucaaccucuuucuucagauguuuaauucuuauguuuccuuuuuguauucauguuucugaguuugaaaagacaauauuaauugucuugaauaauuucuuugcauagacuugauugggucacagaccuauugugucaguuggaaugcuuuuagcugcaagugauagaauacccaauuuaaaaugaccuaaagaauaaugguacuuguuauacaggauaaaauaucauuuagaggaaggacauuuaggcuuauuaagccacucagugaugucagcaaggaccuggaaucuuucaguuuuuucuucugaauuucccaaaaauggacuuuauucuuagccuucuccccucuugguuacaagaugauugccacaacucuagaauuguguuuuacauauccacauccaaaagcaaauaaaaaaaaaauggauugcaaguagaaaauauccucccuguauucuguguacaucaaagaggaaaaccuuucccagagagcccuccaguugcugaagacaucccauaaugggacuucuuuuggccuggucuuggucauuuguccauguuguagcuaggaaaaguaaauaucuuggcauauucagcuuuuacaugcuaguauauaagaaguaugaggaaggguaagcaguuuguugcaguugcuaauguuaucaguagggugacuauuuucaguuuuuggagggugggauauggaauauaugcuuuacaggacuugugcaaacaaaagugaccuuuuuuggccaagguugacuauaguugcuaaucuaauuaguuugaauuuaugacugugcuauaaacuauggaguuuccuugaaccagauuaaaauuagaagaauaaguuuuccuuuuuauucuuucugccacaagauucuuuuuuaaaauaaugacuguuuuuauaaaaggcaguuuaacucuagcauauacuggaugauuuguuaaggugaugauagcccaaaauccuuccgaaugcucauuuuuaucagcauaaucucuuuuagcagguugggcaugguggcucaugccuguaaucccagcaguuugggaggccuugcuugagcucaggaguucgagaccagccugggcaacaugacaaaaccccaugucugcaaaacauacaaaaaaauuagccaguuacaaugaugugucccagcuacucuggaggcuaaggcaggagaauuucuggaggcuaaggcaggagaauugcuugagccugggaggcagagguugcagugagcugagauagcaccauugcacuuaagccuaggugacaagagugaaaccuuguuucaaaaaaagaaaaaaauacauuaaaaacaccucuuucagcaguuaauuucacuaaugauuaagugaaauuaaugaaacccuaguuuucuuggguauagaaaaauaauagucugguggccuaauugauagggugaagauaguccacagaucaguguuuuauaggcaugaaagaaagcacuuauaauaauaauaauaauaauaauaauaauaauagagacaauaguuauaacccaggggguaagaaacuggggcauauggucacugugguaacugaaguauuuuggaguuaaauuuguugcaaauccuaguucugccauucacuagcuuugugugcuugaccaaucuacuuagucucaguaauuuaagauuauuuauaaaauuggaaagaucuaguuucuuccuaagucuuuuuucucauauugcauuccacuucacauuuuucacucugucaauacuggacuacuuuuaguuccccaacauucccuacugguuuacaucagugugccuuucuucguaauaguuuauuugccugcuguugcauuacuugagcagcuucuaccagacucucaagaugcaguuuguauaagggucauuucuuccaggaagaguuucugauguucuuggcaaauucaucaucaucucuaacacaucaguuguuuguguauaugcuucuuuacuaacugcauuuaugcacugaauaguaguaauucaucccuauugauaugugcaguuaagccuagauuaguuuacucugaggauuugaggaugauuaggauacauugaguucuaaauuuuuaaccucuguuggaaauaguagaacaaagaaugucagauuacaguaucauuucuaggcauuuaacaauuuuacauuuggucuguagcguaauagaagccaagugaauagguagaugaaugauggcucuucauacacuggcucaauuaucucaccuuuucaccaaaauaauuacccucaacuuuugcuuauucuuaacaagguagaaguccuaggguaaacuaaaaauagagguuguuuaguaauguccuuucuccagaauggaauggaggacaaauaaaugaagugaguuuguggagccugauuuuaugcucagcauaugcauuguuuuaauaaauacucacugccuugacuuuuucauucuuaagaauguuacuacuuugauuaacauguuuuaaaaauuaugcagucaauaaauauguaagcacuuacuauauauaucaggucagguacuaaaauguaugcauuaacaucauucuuuuccuuuggggugcugaaucaguauuaugggcagaauagugucacccaaaauucuuacuugaaacccuaaccuucaguacuucagaaugugacucuauuuggagaagcggccucuaaagggaugauuaaguuaaaaugaggcugauggaguuguuucucauccagucuggcugguuuucuuauaagaggaagacauugggacaaaaaagagacaccagggccccucucauagacaggaaagaaaccaugugaagaaacaagaaggcagccaucuaccaaccaaggagagaggccuaugaagaaaccaaagcugcuaacacauugaucuuggacuucuaggcaccagaacugugagaaaauaauauuucuauuguuuaagccacccaguguguggcauuuuauuaugguaguccuagcaaacuaauauaagcaguauaaacuuuccacuaucacaucaaggcauacucuuccuuaaaaauuacaguguuaaugucauuggcuauggaucaaaaaugaaauggaacaguaugacuuuggacauacuagaaaaggcaaaugauuuuagagcccaagaacccauguaugcaauuuauuguuccaaucuugaauuaucaauucauuauacaucuguggcauaaauuauaauugaauuacugugugcaaagcauugaaaaccaaguucucugacugaagaaauaauuagaugaaaacauaggaacuauacaaugguaacauuuuaauugucauucuuuuuuauuuauuaguuggaauauuuuuguaaaagaaacuuucucaucucuacuauuugguuacccuuuguauuaguccauucucacgcuguuguaaaaaacugcucaagacuggguaauuuauaaaggaacaagauuuaauugacucacaguuccacagggcuggggaggccucaggaaacuuacaaucaugguggaaggggaagcaaacacauucuucuucacauggcggcaggaagaagugccaagcaaaggggggaaagcccuuuauaaaaucaucagaucucaugagaacucacucacugucacaagaacagaagcauagggguaaccacccccaggauucaauuaccucccucuggguuccuccuacaacacguggcgauuauggaaacuacaauucaagaugagauuuggguaaggacacagccaaaccauauuaccucaguacaauuuuuauaggggagacagaauauauucuuuauuauuucuccuuauguacuggcuuuuuaaauaaugaauuuccuugcuaucuaccuucaguagggacuaauuuuuuuuuuucuaguuuaaguaauauuaggagcucaugcauuugaacauauuuucuauuuuauuuuauuuguauuauacuuuuaaguucuggguuacaugugcagaacguacaguuuuguuacauaggaauacagaugccaugauggugugccacacccaucaacccaucaccuacauuggguauuucuccuaauguuauccuuccccugaccccccaccccccacagacccuggugugugauguucccaucccuguguccauguguucuuauuguucaauucccacuuaugagugagaacaugcgguguuugguuuucugaucuugugauaguuugcugagaaugguaguuuccagcuucauccaugucccugaaaggacaugaacucauccuuuuuuauggcugcacaauauuccaugguguauaugugccacguuugcuuaacccagucugucauugaugggcauuuugguugguugcaaguguuuuucuauugugaauagugcugcaauaaacauauguguaccugugucuuuauugcaggaugauuuauaauccuuuggguaucuacccaguaaugagauugcuggguuaaaugauauuucugguucuagauccuugcggaaucgccacacugucuuccauaaugguugaacuaauuuacacucccaccaacaguguaaaagcauuccuguuuuuccacaaccucuccagcaucuguuguuuccuaacuuuuuaaugaucgccauucuaacuggcgugagaugguaucucauugugguuuugauuugcauuucucuaaugaccagugaugaugagcauuuuuucauaugucuguuggcugcauaaaugucuucuuuugagaaguggcuguucauauccuuugcccauuuuuugaugggguuguuugcuuuuuucuuguaaauuuaaguucuuuguagauucuggguauuagcccuuugucagauggauagauugcaaaaauuuucuccgauucuguagguugucuguuuacucugaugauaguuucuuuugcugugcagaauaucuuuaguugaauuagaucccauuugucaauuuuggcuuuuguugccauugcuuuugguguuuuagucaugaagucuuugcccaugccuauguccugaaugguauugcccagguuuucuucuagaauuuuaaugguuuuuaggucuuacguuuaagucuuugauccaucuugaguugauuuuuguauaaguuguaaagaaguggucuaguuucaguuuucugcauauggcuagccaguuuucccaacaccauuuauuaaauagggaaucuuuuuccccauugcuugugugugucagguuugucaaagaucagauguugauagaugugugguguuauuucugaggccucuguucuguuccauuggucuguauaucuguuuugguaccaguaccaugcuguuuugguuacuguagccuucuaguaaaguuuggaagucagguagugugaugcuuccagcuuuguucuucuugcccaggauugucuuggcuaugccggcucuuuuuugguuccauaugaaguuuaaaguaguuuuuuccaauucugugaagaaacucagugguagcuugauggggguagcauugaaucuauaaguuacuuuggguaguaaggccauuuucacgauauugauucuuucuguccaugagcauggaauguuuuuccauuuguuuguguccucucuuauuuccuugagcagugguuuguaguucuccuugaagagguccuucacaucgcuuauaaguuguauuccuagguguuuuauucucuuaguagcaauugugaaugggaguucacucaugaucuggcucucuguuugucuguuuugguguauagggaugcuugugauuuuuguacauugauuuuguauccugagaauuugcugaaguugcuuaucaguuuaaggagauuuggggcugagacgaugggguuuuguaaauauacaaucuuaucaucuguaaacagagacaauuugacuuccucucuuccuauuugaauacguuuuauugcuuucucuugccugauugcccuggccagaacuuccaauacuauguugaaaaggagugacgagagaggggauccuugucuuguggcgguuuucaaauggaaugcuuccaguuuuugcccauucaauacgauauuggcuguggguuugucauaaauagcuuuuauuauuuugagauacguuccaucgauaccuaguuuauugagaguuuuuagcaugaaaggcuguugaauuuuaucgaaggccuuuucugcaucuguugagauaaucaugugguuuuuguuguugguucuguuuaugugauggauuacguuuauuaauuugcguauguugaaccagccuugcaucccagggcugaagccgacuugaucgugguggauaagcuuuuugacgugcugcugaauucgguuugccaggauuuuauugaggauuuucacaucgauguucaucaggaauauuggccuaaaauucucuuuuuuuguugugucucugccaggcuuugguaucaagaugauucuggccucauaaaaugaguuagggaggauugccucuuuuucuguugaucagaauaguuucagaaggaaugguaccagcucuucuuuguaccucugguagaauucggcugugaauccaucugguccuggacuuuuuuugguugguaggcuauuauugccucaauuucagaaccuguuauuguccuguucagagauuuaacuucuuccuaguuuaaucuuggaaggguguaugugucgaggaauuuauccauuucuucuagauuuucuaguuuauuugcauagaaguguuuauaguauucucugaugguaguuuguauuucuaugggauugguggugaugaccacuucaucauuuuuuauugugucuauuggauucuucucucuuuauuagucuugcuagcugucuaucuauuuuguugaucuuuucaaaaagccauugauuuuuuugaaggguuuuuuuucugucucugucuucuucaguucugcucugaucuuaguuauugcuugucuucugcuagcuuuugaauuuguuugcucuuguuucucuaguucuuuuaauugugauauuagggugucaguuuuagaucacuccugcuuucucuugugggcauuuagugcuauaaauuucccuguauacacugcuuuaaauguguccuagagauucugguacguugugucuuuguuuucauugguuucaaagaacaucuuuaucucugccuucauuucguuauuuacccaguaguuacucaggagcagguuguucaguuuccauguaguugugugguuuugagugaguuucuuaauccugaguucuaauuugauugcacuguggucugagagacaguuuguugugauuucuguucuuuuacauuugcugagaaguguuuuacuuccaauuauguggucaguuuuagaauaagggccauguggugcugagaagaauguauauucugaugauuugggguggagaguucuguagaugucuauucggucuucuugguccagagcugaguucaaguccuggauauccuuguuaauuuucugucucguugauccauuuaauauugacagugggguauuaaagucucccacuauuauuguguggaagucuaagucucuucguaggucucuaagaacuugcuuuauguaucugggugcuccuguauugggugcauacauauuuaagauaguuagcucuucuuguugaauugaucccuuuaccauuauguaauggccuucuuugucucuuuugaucuuuguugguuuaaagucuguuuuaucagagaccaggauugcaaccccugcucuuuuuuuuuuuuuuuuuuuuuuuuuuugcuuucaauuugcuugguagaucuuccuccaucccucuauuuugagccuauaugugucuuugcacaugagaugggucuccugaauacagcacacugauuggucuugagucuuuauccaauuugccagucuguguccuuuaaguggggcauuuagcccauuuacauuuaagguuaauauuguuaggugugaauucgauccugucauuaugaugccagcugguuauuuugcccauuaauugaugcaguuucuucauagugucgaugguauuuacaauuuggcauguuuuugcaguggcugguaccaguuguaccuuuccauguuuagugcuuccuucaggagcucuuguaaggcagacaugguggugacaaaaucucucagcauuugcuugucuguaaaggauuuuauuucuccuucacuuaugaagcuuaguuuggcuggauaugaaauucuggguugaaaauucuuuucuuuaagaauguugaauaucggcccccacucucuucuggcuucuaggguuucugccaagagaucugcuguuagucugaugguuacccuuuguggguaacccagccuuucucucuggcugcccuuaacauuuuuuccuucauuucaacuuuggugaaccugacaauugugugucuugggguugcucuucucgaggaguaucuuugugguguucucuguauuuccugaauuugaauguuggccugccuugcuagguuggggaaguucuccuggauaauauccugcagaguguuuuccaacuugguuccauucuccccgucacuuucagguauaccaaucaaacauugauuucguuuuuucacauagucccauauuucuuggaggcuuuauucauuucuuuuuacuguuuuuucucuaaacuucucuuuuuccuuuauuucauuaauuugaucuuccaucacugauaucauuucuucugccugaucgaauuggcuauugaagcuuguguaugcuucaugaaguucucguacugugguuuucagcuccaucaggucauuuagcucuucucuacacugguuauucuagcuagucauuugucuaaccuuuuuucaagguuuuuagcuuucuugcuauggguuagaacaugcucuuuuagcucggagaaguuuguuauuaccgaccuucugaagcugacuucugucacuuugucgaacucauucucugcccaguuuuguucccuugcuggugaggaguuguguuccuuuggaggaguagaggugcucugguuuuuagaauuuucagccuuucugcucugguuuuuccccaucuuugugguuuuaucuaccuuuggucuuuaacguuggugaccuacagaugggguuuugguguggauguccuuuuuguugauauugauacuauuccuuuuuguuuguuaguuuuccuucuaacaggccccucagaugcaggucuguuggaguuugcuggagguccacuccagacccuguuugccugggcaucaccaauggaggcugcagaacagcaaauauugcugccugauccuuccucuagaagcuuuguccuagaagggcaccccccuguaugaggugucuguuuucuucugcugggaggugucucccagccaggcugcacaggggucggggacccuguugaguaggcagucuguccguuuacagagauugaaugcugugcugggagagccacugcucucuucagagcuguuaggcacagacguuuaagucuggagaagcugucugcugucuuuuguuccaauaugcccugcccccagaguggauucaagagagucaguaggccuugcugagcucugcccaguucuagcuucccugccacuuuguuuacacugugagccuagaaccaccuacucaagcccagcaauggcagaugcccuuuccccccgccaagcucccacauugcagguugaucucagacugcugugcuagcagugagcaagggcgugagacccgccgagccaagcacgggaggggaucuuuuggucugcugguugcaaagaccaugggagaagugcaguauuugggcaggaguauacugcuccuccagguacggucacucacggcuucccuuggcuaggaaagggaaaucccaugaccccuugcgcuucccaggugaggcaacaccccgcccugcuucagcucgcccucugcgggcugcacccacuguccaaccagucccaaugagaugaagcagguaccucaguuggaaaugcagaaaucacccgucuucugcaucgaucuugcugggagcugcagaccagaacuguuccuauuuggacaucuuggaaguaacucccguuugaacauauugauguguuucaguccacugcagcuauuauccuuaucaguuggcaaauugaaccaucuuuggucauugagaggcucuugaaguuggcuuccuaagaccuugggacaugaccaaauaaaguagucuuuaaaaguuuccuuacucuuugguauugcaagauuuuccagacuaaucuuuuauauuccugcccaaggccuggaguccucauuucuccaagaaacccuguuccuuaggauggcuacugagagugcucauuacuauuggguuggucauuguuuccaggucgaaaucagcaccaaaguguuuuuuucuuuaacuucuucuaaccugugucacugucuuuccucucauacauugcugggaagcacaggauuaaaguaacacguaauuacuaauuugcuucaucauguauuacacauacguuacacugaguauaauaaugccgccaccaccaccaccaccaguaugauuacugaaaucauucaaaguuuuguuuuugaggguuuuguuuuguuggcauuucuuuuuguccuuaguauauucaacuuggaauauaccaucagguuacuauguguugaauucacuugaguuuacuuuuuaaaauuuuaauuuuguuuuauaauuuacguaaaauacuaguuccaguggcaauaccuccucuaccaccauauuucaucccauacccuauaaaaaaaguuuaaaaaacuaucuucuaguuugcuaauaaaaguauuauuuuuauugaaguauuaauccccccaucuuuuguaauaaaugauagaauaucacacacguauuucuccacuuugcuuuuuucacuuaacagucuauucuggagaucacuaucuaguggaguguagagauacucgucauuguucuuuucaguuguaguacuccacuguguaguauucauuauaguuuaucauuuauucagugugucccucuuaauugaccaaugaauguugguuaauugaaugacuauaauuuuagucuuagaguugucccuuauuuuuguauuauugcaaguuauaggaauuuuuauguuuauaaaauauuuuguauaugaauaagaaaauggaaugauuaacauuuugguuucugguguaauuauuuggauauaaucuuuucuguuauuuaauuuugccaccacauuuguuuuuuaggcuuccacuacaaauacuuaaggcaugcuuuuaucuugaauagcuuuaguguucaguuuuccaaucuaagagggaaauuagcccuguauuagccuagcauuauauggcuucacaguucauggaguagacuauuaauuggugcacuuaacgcauuuuucuucuuguuuagagugauuuuauagacauugcuguuggagauuucauauccuauuauaaaaugcucauagaauuuuguugguuuguuugagacagcgucuugcucugucgcccaggcuggagugcagugggaugaucauaacacaccgcagccuggacuuccugggcuuaagcaauccuccugccucagcagcgguagcuaggacuguagacuugcaccacugcuucuagcuaauuuuuuuauuuuuauuuuuuauuuuuguagagacagagucucgcuguguuuuccgggguggucucaaacuccugaccucaagugauucuucugcuucggccuccuuaaguguugggauuauaggaaucaaccaugaggccuggcccagugacauuuucagcauagaaaaaaauucauuagcuuugucacuugaucauuaaagaauuagcuauuuaaggauauaacuuugaaauauguguggcgacuuacuuauggcuuggcuuuucuucugcauuauagccuuuauuuuauaaacauccaacagaauccuaagauuucuguuggcucagcuuuaaaauauauccaguaucuauuucucauuaccuuuuuccaucucucuuugauccugagcacuguuguuuuuuuuuuuuuuucuuucuuuuuuuuuuuuaaagacagagucucacccuguugcccaggcuggagugcaguggcacgaucucggcucacugcaggcuccaccugccagguucaugccauucuccugcuucugccucccgaguagcugggacuacaggcacgugccaccaugcccagcugauuuuuuuuguauuuuuaguagaggugggauuucaccauguuagccaggauggucucaaucuccugaccuugugaucugcccgccuuggccucccacuguuguuuuucacuggaauuauugcaguugccuccuuguaggcauaacugucaucuuucccacaccuauuuuuuuucacaguagccgcagugaucguuuuaaauuauuuugcguuguagccauaaugaucauuuuaaauuauuuuguguuggguaacaugacaguuuuauugaaagccuaucaguggauuuaugcugcauucaggguagaagccagaguucugguggccuacagagguaugcuuuggugccuugucaccucucugacuccauccuccacucuuuucuaggcuuugugcuaaaccuacacuggucccuugguugagccuuugaacagacuaggcaucuugccucauggccuuuccaucuauuugcugguucuucugucuggaauucaauaaugcuguuauuuuuggugcuuugaaaacagaaauuucaggaauuucagaaauucuugaaccucaccuccccccagcaagaaauauuauaguauaggaguuaagagcucaggcucaggaguuaggcaacucuguuuaaaucuuaauucuguuaaguaauucucgucaacuuugaaugaauuaccagcuucccuaagccuccauuucuuuauccauaaaauggaaauauuaauacuuguaccuaauuuauaagauugugaagauuaaaugagaucauguguauaagacacuuggcacaauauguggcaaguauuucuauucaguaaauauuaacugaauuaguuguuauuguuuauaauauaauuuuugguuaccacuuuucagugaaaaauagguaagcucuuggguuucccagauuauuuaacaaaggaaacuaucauuuugucucuugguuuuagggcaaacuuaucuagaagagaggagcagaggagaaugaaguaguaauuugucauauuuucauucauauguuguuaugugggccauaggaaaguuggcagauccaugaauuucaauuuuauuauauauuucuugucaagaauacuuuauuaguacaaagcauaucauguauuuugauuagaagucuuagagaaauuaagaucuuaggaaaauauuaaaauuuuauuugggguauuuauauccuuguauacuaauaaugagauacauuugcugaaagcuguagacguucccauauacauucuuacuugguuuuucauggaaauuuaugggaauguucacuguuauuccuauuucacaaucagaacugaacucucauucuugagacguaaauucugaugauuuuuuuccauuauaucauaacugauaguagcauugggcacuaugagauuugaaaaugacugcaacauagauucucaucuucaggcuuauagauagauacaugugaagucaauuaacucuaauacuugguagacuaaauggaccaguauauaaggaacucugaggaagaagugcuuaauucugucuaggccaauuaaagaaagauucuggaggagguaacauucguuuauuuuauuuuauuauuuuuuuauuauuauuuuuuauuauuauuauacuuuaaguucuaggguacaugugcacaaugugcagguuaguuacauauguauacaugcauuaacucuucauuaacuugucauuuagcauuagguauaucuccuaaugcuaucccucccccuuccccccaccccacaacaguccccagagugugauguuccccuuccuguguccauauguucucauuguucaauucccaucuaugagugagaacaugugguguuugguuuuuuguccuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagccuuugcuauugugaauaaugccgcaauaaacauacgugugcaugugucuuuauagcagcaugauuuauaguccuuuggguauauacccaguaaugggauggcuggaaaaggaugagcauaauuuuugccucugcgaguugggagcugccugaggaaagucaugucauucacaaaugagaaauaauauaugauaaaguucuuuuaacuggcuaccacuguauuuauacuuaccauuucuuuguuaaaacuuauugacugauauccauaugccuaaacauugcugcuaauaggccacuucugcuaagcucacgguucuguuuccaacacuugaauugcagaccuaccaaaaguuauuuguauguguuuucuaccuguuaaugccugucauaugcaaaaccagaauauuguugcuaagauaacaaaguugaauacuuuggaaagacucaauggcagugcccuaaaaggaugguuguuuuuuaauuagaugggggugagacaacucaaagacugaaagaaaaaaagaacuagaaggauuguguacucaaauugcuuugcuguugacuucaaguuuuugguucacucuaaagacaguucgaagucuuagauaacacauuacggauaucauuuaugcaagaaagacagcauggauuuauagucaugaagacaucauccaaagaaauagacuagucuucacuaaaggauggauaaauaaauaugcauuuaugucuuguaugauuaaauaaaugcauuauuuaugcauauguguuauauuuuaugauuaccuauuucagucagccuauuugguuaaccaagcaaauacugguucugauugcauuaaacagaagggccuuauuggagccauaauuucuuggagagaaggcauuaguggaauauggagaggguagcagauaagacugggcaagucagcugggguuacaacguaaaggauuuguaugccaggcugaguuuguccuuugauggugaugcaguuuuagggaagugaugaccuuucagacuguuuuuuuggaagauucuugacaaauuagagagguugggcaagaaaacuagggcaguggcagugagauuggaaguagagcagaucugaaagaaauuuggagaauagaauugauaagucuuggugugauuuacuggaucuaaguacuaagguaggaagaaaaaucaaagguggugcuaaugaugauaaauagcuaacguuuaccaagugcuuacuguguuuuuuuuuuuacuguucuaaguccuuuagauaacauaauuucagucauauaaaaauguacuacuucccacagguccuuaugcauaaaccuccaaaacugcaaaaaaugaaaacauaaauuuuaaguuuguuguaggcacauuuggcaacagauaaugaccugcacugaugggaggcuauuuguagucuuuaucucacuuaacuguaaaugugugguuuguuuuuuuuuugcagaaauaauuuuguguuugguuauagagugcuaucccagaccuggugggaguguuacauaauccauaauauuaucuuucuaaaauaugaaaaacuuuuacuuuucuucugcugguggaaauguaaauuagaucagccauuguggaaagcaauuuggugauuucucaaaaccuuaaaacaguuaccauuugacccagcaaucccauuauugguuauauacccacaggaaaauaaauuuguaccauaaagauacaugcacauauauguucaucgcagcacuauucacaguaacaaagacaugaaauuuucuuuguuuguuuuucucagaccucuuagggugaaaaaaauaugagcaauuuugaaauuuggguguaggcgagagauaauagaccuguauuaauaauuauaauuugggggccaggcgcgguggcucacacauguaaucccagcacuuugggaggcugaggcgggcggaucacgaggucaggagaucaaggccauccuggcuaacacggugaaaccccgucuuuacuaaaaauacaaaaaauuagccgggcgugguggcaggcgccuguagucccagcuacucgggaggcugaagcaggagaauggcaugaacccgggaggcggagcuuacagugagcggagauagcgccauugcacuccagccugggcgacagagcaaggguccaucucaaaauaauaauaauaauaauaauaauuguuacuugguugggcacaauggccaacaccuauaaucccaacaccuugagaggccuaggugggaggauugcuugaggccaagaguuauagaccagcuucagcaacauagcuaccccaucucuaccaacaacaacaaaaaaaucagcugggccugguggugcaugccaguaggccuaguuacuugggaggcugaggugggaggaucguuugagcccaggaguuugaggcugcaguaaacuaugauugcaccuguucacuucagccugagccacagaaugagacuccaucucuaaaauuuaaaaaagucaaaaaaaaauaaaaauuauagaugaagagacugagucauagagagaaaucacacaaaauaugugucagaguuaggguuugaaccuacacagucuuaacuuuucaaaugugcauuuuagauacuacacuauucugccucucuuucuagccuuugucauugggaaaaugauaccauuaaacuuauuaagggaucuaaagagcggaauuaggggaagcugaagaagagggagacaguguaguagaauauuaauuuagauuggucuaauuugagcuaucaauggaaaaaguacaguaggaagccagaaauauuuuggauauauuuauaaugcacauacuggauuucaucagaucuaaggugccauuguuguaacaucauaaauaccgauuuuaaaaauuaaauaaaauuauggugcaguauuuguuuuuaucccauaaauuuccccugcccccccgccacacacacacaguaucauucucugugcugcuuagaguauauaacauugcuugcuugggauuuucuucugcgucacugauaggcauucugcaagcuuugauuuuggcacuuucuugaucuuaccauaaaauaucaacauaaaguuuucagacaacauccagaagaaauuuuauguaauaguuaaggucaacagauacgauuccaacaacacacauaacucaacugaagugaaaacaauaugaauagcugugacuggugucacauguggaugauaaugacaacccagucaugucugccaccuggccaacaucaauuauacaaagucauugauuuuaagauucauugauuguaaaagauuucaaugacauuaaaauguguaggaaaugugcaucuuagaauuguuaaacaauaaguaguacuuuugccucugagaauuggaaguugcaguaauaaaguaagaugcuaaggcauguaaauguuuuuaauaaauacaugguuuucaagaguuaauacaugauugaagagguuuagaaucaauucucuagggaaaaauugagagaaagauucugucuugagcauuuccuauguuuaagaguuacuuuaugaagaaaauguaaauacuuccccugauugugaauuuaucuuuuauaaaugacaaucuaggugacccauuucacaaauagauuaauuucucucauaaguguuagcuuggucuuuguuacugguauaauuaauuguacuauaugcugaguacaacuaaaaacucugaauauuauacguaaaacacaagaagacucugaaagguggagagaauaaggcagaggagcuagggaucucaggacccaaauaaugacacugcaguaguucccugccuuuucuuuuagccucauauauuccauaauuagagcuaaagaagcugauaacccagaagugcaauggccacagacaaagaaagcgccagcaaaagcccagucuuuuaaauacuaguagagggacaccauagcaagacagaaaacuuuuugagaauaaccauucuacuucaaccaaacaccacagaaaaaaacauuggucacacucauagcugcaaaggccaaguagggauccuagauuuccauccucaccaagcuguuaugaggcacccuaacaccuccuccacuggaauugugucagauuaggccagguacagaguugggacuuuaauucccauagaaugguuaacuagccuuuccccaacuuguaguguuacuggagaccaugugggaagcuaaaacuucuacguuuauuugggaguaaagaggagcuucuguccuucccugcuaaguggcaucagaggaguccuauuggagaaugaaugcuuucaccacuucuaagcaguaaaaaagccuuucucuaccuaugcaccccaacccccagcacccagggguauuaguagaggcuacaugggagcaguagcuucucagccagagacaugucaguggagguggaguggagagucaggauucccacccagcccaggggaaucaagaagcugccccaucuguaguguaaauggaggacaaguggggaaccugaacaucuacccccaacuugccgaaaugaaauggcaccucacuaucuucaucugcuggagcaaaaucaaacaaagccaacuaacacagaaaauuuaaguaagaucuagagucuuauaauacccaaagugugcagauuuuaauuaaaaauugucuggcugaguguggugacucaagacuguaauccuagcacuuugggaagccaagguggguggaucaccugagucuaggaguuugagaccagccugcgcaacauggcgaaaccucaucucuaccaaaaaaagaaaaaaaaaauuagccaggcgugauggcacaugccuauaaugccagcuacucgggaggcuuaggugggaggaucacuugagcuggggaggucauggcuguagugaacugugaucaugccacugcacuccaaccugggcaacagagugagacccugucucaaaaaaaaaaaaaaagaaagaaaaagaaaaaauugucauacuaggaaccuagaagaucucaaauugagugaaaaaagacaauuaauagagaugaacaccaggauaacagauauuaaaauuaucugacaaagauuauaaagccagcuaucuuaaaaugcuucaacaagcaauuaugaaugagcaugccugaaacaaaugaaaaaauagaaagucuuagcaaagaaauaaauagaagaaccaaauagaaauuuuagagcugaaaaaugcaguaacuaaauuaaaaacuucaauggaugauaggcucaguagcagaauggaggaaauagaagaaugacucaguaaacugauagaacaauacaaauugccaaaucugaacagcagagagaaaauaggcuaaaaaugaacagagccucagggacuguagcaaaagagcaaacaucuaugccaucagaucucucugaagaaguggagaaagagggcauggcuggaaaaguauuaaaagaaaugaucacugaaaacuuuucccaaauuuggcaaaagacauaaaccuacagauuuaagaaaccuagcaaacuccuaacaggguaaaccaaagcaguccacaccaagacauggcauaugcagacuuuugaaaauugaagauuaaaaaaucuugaaagaaauuagaaacuauaccagaggggggauaaauaguuugaaugacagcagauuucucaucagaaaucauggagacuacaugucacauuuguuaaguacugauagaaaagaacuguuauuuuuaagaaaacuuucaaaggucugaggucagaacuuuuguuuggauucauaauguuacacaguaucuuucauugggauacagaacuuucaaaagaaaaugggaaagugcauuucuacuaaugagaaauaaucauaagauuauuuacuauuuugcauuuuguugcucagagacuugcuaaugaaaauagcauuuauuucugaauaguguaauguucugcuuaaucuuugaauaguucagauaguuuaauuuucauaauuucuccuaggauggcuuugaguaauuuuuucagauuuucaagaagcauauaacuauuacaaugcuauuuugcugacuuucugauuuuuaaaacuuuguauauugguuaaaauaacuuuuuaauacuacuuuuucuacaauaauguauuaguccaaucuugcacugcuaugaagaacuaccugagacaggguaauuuaugaagaaaagagguauaauugacucacaguuccauaggcuguacaggaagcauggcaggggaagccucaggaaacuuagaauuauggcagaaggcaaaggggaagugugcacaucuuuguauggccagcaagaagagagaaagagagcaaagagggaggugcuccacacuuucaaacagccauaucucgugagaacucugucagcacuaagacagcacuaagaggauggugcuaaaccauuagaaaccacccucaugauccagucaccucccaccaggccccagcugcaacacuaagaaaugcaauucaguaucagauuuggguggggacauagagccaaaccauaucaacugaauaagaaaauauacauuaaauuuggacacuaaauauauuuagcucuugcugauaauugcuuucuuugucucucuucacuaaguucucauuagcuucugguuuaaagacaaaguuuuucuuaaauuuuuucuuaaaagaugaaaauuuuuaaauagcuauuuccuuuucuuaaauauuugcuucugugguuugguuuuugacaaaacucagaagauaguggagacuaucaaaauuugucuuccaaagucaguuaacccagaaucucaccuguuuaucuaauauaccauauucacauugcaaccaauagcuuuguuaacuuuauaccuuuuguuagauuuuccaguuagcacauaaauaguuuuguaaaaauccuuuuggaucaugucuugauuuggaagcuuacucauuuaucuaucuaaaauuaucaaaucagaguuucuagaguauuauaaaucucaauuaaaucugucagauuaccauuuuucauuucuacaauuuguuaagaauuuaaugguugggcccgguggcucacaccuguaaucccaaggugggaggauugcauaaugccaggaguuugggaccagccugggccacaaagggagaccccaucccuaaauuuuuuuuuuuuuaaauuuagcuggguguuguaguauguucuuguauuccuagcaacuagggaggccgaggcaguuaggauggcuugagccuaagaguucaagguuacaaugaacuaugauugcacugcugcauucuagccugggcaacagaaugagacugucucuucaaaaauaaagauaaaaaagaauuucauccuguacuagguggcaucucuuauguugacuaccuuugauuugcuuaaggaaauuacuaaguauuguuaagaaaauauaggccugauuuucuuuacccugaagcacucaauacgguuguucauuugaaaaguagcccagucaucuaacuuucaguuuggaacaccugugugaaaaucuguuuuuuuguuuguuuguuuguuuguuuucuuuccaaggaaucuuagaauaacuauggcauauuuuuccuaauuaauagccacacaaguagcuucuaauaccccagcuuuuguucugaaggaaaucuagaugucuguuuucaauaucuccagggucuuucaaagugaaauuuucauauuccagauagccuguaguuuguuuaacauuaucuuaaacauugcuuucuuucuuuuuuuuuuccccccuuugaaauggagucuagcccugucacccagacuggaaugcaguggcacaaucucggcucacuacaaccucugccuucuggguucaagugauucuccugucuuagccuccaaguagcugggauuacaggugugcaccaccacacccagcuaauuuuuuuguauuuuuuuaguagaguugggguuuugcuauguuggccaggcuggucucgaacuucugaccucagaugaucugcccaccuuggccuaccaaagugaaacauugcuuccuaaaugugauaauuuugcauaugacaacagauaguacuuuaauuuuauuuuuaacucauuuaaaccacauugcccaguaaaguuauuuuauaaauuagauuuuaguuaaguuuuauauauauauaacuuauaacuaaauaauauauaacuacaauguauuauacucaacuauaucuuugaaugucacacaggugucaacaggcagaggugggaacugaacccgaagucugcagagcauaaaaguuucugcuuuuuucaccccuccaaccuuugaauugcuuuuggagacuauuuaugguagauaagaauuaauccaccauaggauuaaucaguccgugagauuuuguuuauuauuauuuauuauuauuuuuucaaaugugccuuuguaacauuuacauuugcaaguaauaguucuagagugcaggagaaguuugugaauuguguguuugcaugcauaaguacauacauacauauguacauacacacguacguaaucuuuuggcucaaggauugcuuugggcgcugcuuccugccagcaguuuugguacuuuacucuguuaguuucucuuaacauccuuccuguuuauauaaauucuguauuguccguauuuggcuuugaccugguauuuccuugaaacucugcuuucuguacuucaagcugcagcuagucugagauauuccuuuuauucucaaucuuuguauccuuugaaugauuugugauacccaagcagaauagauguauuuuuauguaaauauuccuaauuguuuggaauuuugccuaggagaauaauuacauauucucucagagcauagcacagcaagacuccacuauaucuuaccuuucugcuuuagacucauuuauuuauuuguaguauaugaggaaauauucuuuuuaguuuuauauacauuuucaaaacuaugaaaacaggaaaaauuaccucaagucuaacuucuguuuguagaauuuccauaaagaugauaaaacuuuuacagcauauuuuuaaauuuaaaacaugaaacuacaaaaugauacaguagccauuuuugugaucagauacacauguccagaacaaacuuauuacagaaaacuugguuaacacacaaaacaaccaauacaaaucucucuuccucuaucucuuagagguacccacuguuagagggaggguguguguguguguaaaagauauagagauugaucaguuauuucauuuauucuaaggaaaaugaacugggccuccaucuggcuguauauacuuccuaucacaggacuuuauuuuguuccuucucaccuacagcacauugcccuucuguucucuuuuguuagcaccuacauaaucaucagagaauccuuuucugacuucacuaaauccauuuuuccuauuaauccuagacacuaccuuauucuguuacaggaccuaccacagcuuuacauuuauuuguguauuuaaucugacugucuuacuagacuauaaacuuuuugaagggcaauucuguguuucuuuuuguuuaccuuuauauuccugguauguaacauagugccagaugcauacuagacacuccauaaauauugguugaauuaaugaauacguuugaaauaccagcaaggaauguacauaagcaguucauaaaaggagaaauacaaaugccaguaaauauaucuaaauauuuucagucucauguguaaucaggaaauacaaauuaaagcaaugacaacauguuuuaucuucaugauguugggaaaauuuuuuaaaaauugugaauuucaacugucuauuuaagugcacaucuauuaagagaauaauauuaaaugaagguaugaaccagacauacuauggaauauuuuucagguguuagaagggaagaguuacauuauacuucauuuagaauaaucucauuaauuugugcuuuacaaaaagaaccccaaaagugaugguguauauauguuuacacacauauaaauuuauggcagagguacuggaaagauuuuugcccuacuguugauaguguuuaucucugggggagggaacauaauaguaggagaggaauaaaggaguuccuuuuucccucuguggacguguacuuuuuuuaaaaaacuauuuuauaauuagaauauuuuuauauagucgaaguaugaaggagcuaaauugguuaggaacauaaaggaaaagacccauucuuuauauauggaaaaauaaaaccagggauacccaaaucaaaugguuuaauuuagaacuacaaguaguucuauauuguuggugccuaaagugugaugccggaagaaggaggaggcugaaaaagaagacaaggccagaucagugagggcuguacauuaucuuuucuccuagcaugguagagccaucgaaaaauuuuuuaaguuagaaauugacuuggguaggccaggcgugguggcucacuccuguaaucccagcacuuugggaggccgaggcaggcggaucacgaggucaggagauugagaccacggugaaaccucgucucuacuaagaauacaaaaaaaaaaaaaaaaaaugagccacgcgcaguggcgggugccuguagucccagcuacuggggaggcugaggcaggagaauggcaugaaccugggagguggagcuugcagugagcagagauuacgccgcugcacuccagccugggugacaaagcgagacucugucucaaaaaaaacagagagaaaaaagaaauugacuuggguaauagaugguuaguuacaucguucaguagaugacucugggagaugugcuguugacaugauuaaauagauaaauaaccuuuuuguaucugaauaccuuuggcagguuugaugaagccuauagauacuuucuuagaauuguguuuuggaugcuuaaaauaaaauacagaguacacagaagccaauuauauuggaaugcacuuaucaaaauauuuaaaaaauauauuuguaguauaauuaucugucugcuucuuuaguaaaauauuaaaaagaccuagugguggguuuaauagcuaauuuuaaaauaaugauaagcaauaauuuaauguaucuguguuaauugaauuuuuuaugaaccuucugaauuuuacccaugaaccccagcuuaagaacucuuguuugcgggaugagauugggagcgcagagaccaguaaggaaaccaguccauauggagauaaugagaagucucaguggagguggauccuaugagacuuucuaauuauuauuaaaaauuaacauuuuuguauugguaaagcaacguguguacauuauagaaaaauuaggaaauauaaauuuaaaaaagaaacaugcucuagaugguuuuguuuuuuguuuuuuuggcuugaucucagcucacugcaagcuccaccucccggguucuugccauucuccugccucagccuccugaguagcugggacuacaggcgcccaccaccacgcccggcuaauuuuuuguauuuuuaguagagacaggguuucaccguguuaggauggucuugaucugaccucgugauccgccugccuuggccucccaaagugcugggauuacaggcgugagccacugcgccuggccugauaguuuuuuaaaauuuaaauaauguauauacugcccuuuauugcugcuuuauauaggaacuuuccucauugguuaugcauuuaguuuuauuucaaugauaauaucuuuugcuuaacuauuuuuccuuugguuuuacagguuuuugauuggucaaggagcacauguaggggcugucaacagugaaggagauacaccuuuagauauugcggaggaggaggcaauggaagagcuacuucaaaaugaaguuaaucggcaagguaaaauaaaaagcaaccuaaauggaaaaauguuuuagaaagaaugugauacuuuuccagcaaaaauauuuguugacauugaagggcaaucauaauuucaugaaaaaaaugaauucagcuugcaaaacaauaguacaguauguuucuguuuucuaaaauauucuccacucuaucuuuuaaguauuuuuaaaguuaaaagaaauguuagaagcagcaggaucaggcauaaaauuauguggaaguaaaaguuuuggagcaaaauaaaguaggcaaaggggauagaaagugcacaggguaaguggcacauugcaaaguuaaauaguguggucaagaaggcucacugauaaggggucauuuaagcugagaugugaauacaaugagggaaugagucaugaugaucuggggaaagagcauuccagacaaggggagcaaugaauacaagaaugggagguugucuuguauaugcagagaagcagcuagaggcagagcagaggaagaggcaggaaggagaugaggucacagaaguagcaggaggucauaucaccuuaaggccuugugagccauugggaagacuuuggcuuuuaaccugagugaaauaggaagccaauggagggauugaggcagaggauugacaugauuuguuauacuuuuagaaaggaucucucuggcucuuguguugaaaauagauuguaggaagacaaggacagaaguaggagaaggguuaggaaauaacugacauaauccagacaaaauaaagugauuuauuuuugacugguaguagaugaagugaugagaagagauuggauuauggauauauuuugaagguuuggccaagaggauuauugagucauuagcuagaaggugugaaaaaaagaagauucuaagauuuuugguuugaacaaauggauggaugaaguuccuaucugagaugugaagauuguaagaagaguagguuuuauagggaaauauuagggcuucauuuucaggcauguuaaauuuguuuugcguguuagauauccaaacuguugaauaugcgagucugcaguuacaaaauggauauguaaauuugggagguguucauuuauagauaacagugauugcuaacgggcacagaguuucauuacucaagagugaugaguauucuaaaguugauuguggugaugguuacaccacuccucacauuuacuaaaaaaaaaccauugaauucuacacuuuaaaugcuauguaaaugcugugaauuagaucuuaauaaagcuguguguguguauauauauguauguauauauaaaauaugauccagcuuggcagcaguggcucaugccuguaaucccagcacuuugggaggccaaggcgggcagaucacgaggucaggagcuugagaccagccugaccaacauggugaaacccugucucuacuaaaaauacaaaaauuagcugggcgugguggugggcgccuguaaucccagcuacucagaaggcugagggcaggagaauugcuugaacccgggaggcggaggucgcagugagcugagauugcaccacugcacuccagccuugagaacagagugagacuccgucuaaaaaaaaaaaaaugauccagcaacuccuuuucuagaaauuuaccauauaucuauaucuauaucuauaucuauaucuauaucuauaucuauaucuauaucuauaucuauauuuuuuuuugagacagagucuugcucugucacccaggcuggagugcaguggcgcaaucuggguucgcugcaaccuuugcagucuggguucacugcaaccucugccucucggguucaagugauucuccuugccucagccucccgaguagcugggauuacaggcgccugccaccgugccuggcuaauauuuuuguauuuuuaguagagaugggguuuuaccguguuggccaggcuggucuccaccuccugacuucuggugauccuccugccugggccucccaaaaugcugggauuacaggcaugagccagcacucccagccuacccaaaagaauuuaaaacaacucaacucuuugaaauugaauaauuuguacaaacauggguguacaaauuauucauauuagccaaaagaugaaagcaaaccaagugucauugauggaugaauaaauaaaaugugaaauauauauacagugaaauauuauucagccuuaaggaaggaaaucaaacauacgcuacagcauggaggacuuuaugguaagugacauaagccagugaucaaaaaaaaccaaaaacaaaugauucuacauauaugagguaccuagaauagucaaauucauagagaaaauagaaugauggcugccaggggcuggaaggaggggagaaaagggaguuguuuuuuaauggcagaguuuuucuuuugcaagaugaaaaaagcuguguagauauguuacacaacaaugugaauguacuuaagaacuguacacuuaaaaauaguuaagaccuguaaucccagcuaaggggggaggaucgcuuuagcucguguguuccaggcugcagugaucugaucacaucacugugcuccagccugggugacagagugagacccuuucugaaaacaaaaaaaaaaguuaagaugguaaauuuuauuuuuauguuuauuuuacuacaauuaaaaauuuauguaugugugauuacuucugcaguaccuuugggcaggacucacacacacacacacacacacacacacacacacacacacaaagugccacaugugauuuuuguuauaguccauuaggcagugaucaaacagguauuauuagagcuguguuuuacugaggucaaaugauagaggaaugguaugaaauauugauguagagggccaacuccugcugaaaugugcuucaucagaaaauagaaacuaaggauuagaaaggaauagaagguaaauaaauuccaugaaaggagauuuuuauuccuugggauuaggaaaauuccuaaugacugcggguuuguuuuguuuuguuuucguuuguuuugagacagacuggagugcagugacacaaucauggcucacuauagccucaaccucccagacccuagcgauccucccaccuuagccucuugaggagcugggacuguaggcgcaugccaccucaccuggcuaauuuuuguauuuuaaguagagaugcaguuuuacuguguuggucaggcugaucuugaacucuugaacucaagcaguccaccuaucuuggccucccaaaguucugauauuacaggcaugagcgaccgcaucuagccaacuguggguuuguuuaaaaaaaaaacuaucuuaagcaugaaaacugagaaaauaaauaccuaaaauagaauugagguguuauaaaaagugauuaaauauaacuagagccuaaaaaaaacaagaaaugcaauagaaaagugguuauaaacuggagccugaauaaacacacagaagagcuuucaacagccauguucuagacaaguguuuuagagucauaggaucuucuagaauugaguaaacuaaagaauaaguauaaagcaucacaaccuagcaagaacuucccugcccauuuugcugugaugagugcucagauaacaguuuccugucaaacaaugguaauucuuuaaaguaaacauuuaaggcuccuauuuuuuaucugauauuagcaguuguuaugaacuagaaaaggcauggaguuguacugaaaauuucuugcauuugguuuccuucuguauaagggaaauugcuagcguaacuguaagcggggcugauuuuaguuuuaaugauucauuuagaacugauuaaugugccagcaaauguucuaugugcuggguguuaacaauaaaaaaagcaagacaauccuucuuaaggauuucacagucuagcagaagugucaaacgaagagcuucacaauacagugugcuauguauuaaaauauauaggaacagaauguugugagagaauagaaaaagcuguagugaggaaagguuucagagugaugacauuuagagggaguuggcuuggcaaagaaaggaacugguggacagaaaaggcgggguaucaaaaugugaaagaaaaggaguuggaaggccaagcacaguggcucuugccuauaauuccauugcuuuggggggcugagaugagaggcuugcuugacgccaggaguacaagguuacuguaagcuacgauuguaucacugcacuccagccuggacaacagagugagaccuugucucucucucucucucuuuuuuuuuuuuuuuuuuaaauaaaaaggaauuggagacauacauagcauauguggacuggaagacagacacauucauugggacuggaauugagauucaaagucagggcgggauuuguaggagaugaggccugaaaagauaggucagagccagauagugaaggauaucuauuuuuguagacauuggauagaugcagcaaauaucuccaagcaauaaauuaauuugauuggauuugguuuuuaguauaaagcugauggcaacuuggaggaugaaauagaauguaggauauauggugacacgcauuccuugaagaagauucucaaauuaguccaggugaaagaugauaagagccaaaaccuguuacauuugaaaugaagaacaaggcugucuugaggaaauauugaaguaaaauuagaacaguuugguaaagaauugaaugcagauaugaaggaagaauuaagccuaacuuacuaaaguuuccaguugaagaagugaugauuagaugaguucauguaggaaagugugagauaagacagaaccagacugagggacuucaugaguauauauuggguuuguaguacuaaaggacaucuagaugacagugguuggugcauuguuagaacuuaggauauguaaagaugugaaaaguaaaucuaggagaaccauaaggagggggaguucugggaacuaguagaugagaugacccuggagacgaaaagcuaagugcuaacaaugauaauaguaguaaugacaauagcuaacuguuauuaaaugcuuauuauaugccaggcauugagccaagagcuucacaugcauuucuucauuucauccucauagcaguucugugagguuuauacuacuguuaccccauuuccagaugagaaaauugaggcuuagugauuuacccaagaucauacagguaggaagugguagugcuauaggucuguccuaaacaguaagacagauaucuugagcccacauucuguaccacuguaccauacugcauuuuauuuaaaaugucucccuagaaaauacuucaugauguucauuugauacauauaaugggaaugcauaaauuuauauagcauaucuuaauuccaaagaaacaaaaguauaggggcaucucuaacagauuuuaauaauuauaaaaaagcacccuaaauauaucucuaguuguauuaguccauucucaugaugcuaugaagaaauacccaagacuggguaauuuguaaaggaaagagguuuaauugacuuauaguuccacagggcuggggaggccucaggaaacuuacagucaugcagucaugacagaagagaaagcaaacacaucaggaaacuuacaaucaugcagucaugacagaugggaaggcaaacauauccuucuucacacgguggcaggagagagaagugccaagcaaagacccuuuuaaaaccgucagaucucgugggaacucacucacuaucacaagaacagcagcacuggggguaacugcccccaugauucaguuaccucacacggagucccucccacgacuuguggggauugugggaacuacaauucaagaugagauuugggugggaaacagacaaaucauaucaucccacuccuggccccuuccaaaucucacguccucacauuucauaacacaaucauaccuucccagcagucccccagagucuuaacucauuccaacauuaacccaaaaguccaaguccaaagucucaucugaggcaagguaagucccuucugccugugagccuguaaaauugaaagcaaguuaauuacuuccuagacacagugaggguacaagcauugggugaauauaccuguuccagaugggagaaauuggccaaaacaaagaggcuauaagccccauggaagugugaaauccaguagggcuguuauuaaacauuaaaguuccaaaaugauguccuuugacuucaugucucacauccaggucaugcugauguaagaggugggcucccacagccuuggacagcucugccucuguagcuuugcaggguacagccccacuccuggcuucuuucaugggccaguguugagugucucugucuuuucuaggcacacagugcaaggugucaguggaucugucauucuggggucuggaagacgguggcccucuucucauggcugcgcuaggcaguaccccaguggggauucuguguggggucucugaccucacauuucccuuccacacugcccuagcagaaguucuccaugagggcucuaccucugcagcagacuucugccuggacauccaggccuuuccauacacccucugaaaucuaggcagagcuucccaaaccucaguucuugacuucugcacacccauagucccaacaccacauggaagccacaaaggcuuggggcuugcauccucugaagcgauggccugaguuguacauuggccccuuuuagcuagggcuggaguagcugggacacagggcaccaagucccaaggcugcacacagcaagggggcccuggacccggcccaugaaaccauuuuucccucccaggccuccaggccugugaugggaagggcugccuugaaagucuuugacaugcccuggggaccuuuuccccuuugucuuggcaauuaacauuugguuacucguuacuuaugcaaauuucugcagccagcuuuaauuucuccccagaaaauuggguuuucuuucacauuaucaggcugcaaauuuuucauacuuuuaugcucugcuuccuuuugaacacuuugcugcuuagaaauuucuuucaucagauacccuaaauuaccucccucaaguucagaguuccacagaucucuagggcaggggcagaaugccacuggucucuuugccaaagcauaaaaagagugaccuuugcuuuaguucccaacaaguuucucaucuccaucugagaccaacucagccuagacuucauuguccauaucacuaucagcauuuuggucaaagccauucaguaagucucuaggaaguuccaaacuuuccuacaucuuccugucuuccucugagcccucuaaacuguuccagccucugccuguuacccaguuucaaaauugcuuccacauuuuuuggguaucuuuacaacugugccccacuacccgauaccaaauuacuguauuaguccauucucaugcugcuaugaaaaaguacccgagaguggguaauuuauaaaggaaagagguuugacucacaguuccacauggcuggggguccucaggaaacuuacaaucauaguggaaggggaagcacaaucauaguggaaggagaagcaaacacguccuucuucacauggcggcuggagagagacaugcugaacaaagaggaaaaagccucuuaaaccauaagaucuugugagaacucacucacuaucacaagaacaguagcauggggguaaucguccccaugauuuaguuaccucccacuggguccuucccaccacauguagggauuaugggaacuacaauucaagaugagauuugggugagaacacagccaaaccauaucauuaguagugguaacauuucucaaauuaucuagguaugaaaauuauuguuuaauauuuuuaaguuuuuuaaucauucuuuuggcuuuucuuauuccaguacauuugaucaauaacuaguuaugcuuaaauaaauugccuuugaaaguaguaauaauugaacaguagcuguaauuauuuucuuuauuuaucuagggacacauuaauuuuugaaucuguugcugacuaaauuccaaucuaauuuuauuuauuuuaaucuaagagauuugauuauauuuuaauauuuacugcucuuaaaucauagugacagauguuagucuaaucacuuuguuauacccaauuuaguuuuauuauauauuauuuucauuguuuaaaaaccuugcaauuauaguagguggguuaaggaccaguuaaaugcauuauaagauuuuuuucuuuuaaaacagaaaucaagaaaagagaagcagaaucauagacuuuucaaacugauaaugauaauuaacaccuuaguguuuaucccugaucuaaaacacuuuauauguauuaauuaauuuaguuuucagaacaaccauaugggauagauauuggcaucacucccaucuuacaaaugaaaccagagcauagcauagauugucuacccugagggaguacagcuaguaagugguggaucagagauucaaauccagccagucucgguucaguaucuguuuucuuaaccuaucuuacuaauauccaaagaagcuauggcuuucucaggaucacuggcuaguuagucaaagcacugaacuuagaaagcaagucuccuaauacauaguacaauuagauuuuuuuuucuucaaguuuuugaugagcuaagcacggucuacauacucuaaucgguaguauuuuaaaaauuuaagaacaagagaaagguuuuucuuuucuaauuuaauuuucuuaaacauaaggaauugcccuucacguuaacuuuacacuuggauuguuuuuauaugugaaucagaugugagcacgauuuggaagcuaaagaggguaauugcuuugucauuagauaaagauagcaugaaauuagauaaauauaaaagaaguagguuuuuuuuaacuugaaguucaaaggaaacagaauaguaaaagacaauaaaaaucagaacguuuaagauuguaaugaaaggagggauaaaaauaauaaaaagcuaccuguuuuaaaagacaguaagagaguaacauuaaaaaagcaaaucuaagauaaaucacuuaauagaaagguuacuaacauuaggcauaucuuaaaugggcugauuaucuuuuggugggaaauuuuugauacaaguaaaacugcuuuacuauagaaaugguggcauuugauuuuuauaaaaaucauaauagguuguguucauuccauauauaguuuauacaauuuauuguuuucauaaggucuauuuggaaaaucuuguucaaguuuccuucaaaugcgguaaugagauauuauaaucucuaguuugaagaugacuuuuucuauacauguguaaucuuggaguuuuaaaaauauuucugaauuauugucugcuuuuuaaaagcugagcuucaguugaguaaugagcaguuuaguugucuuggaaaaaaugguaaugugcuaauaagcaggcaaaauaaaaauacaauucagguagaggauaguagcuggcaugacagcagagaccaugauguacuuggggaccuauguggaggucuagaugguuagaacacuagaugaugguaagggagaaagacuauagaugaaguuaaaaaugcacugagaccaagucauaaaaggcuuucucuuguauacuaaagagcuugagcuuugucuuacagaagcagccauugacaaauuuuauauaaagcaaugacaucauguuuuauuuuuuccaguccagcaguagauugagggaugaauuagaagggacuaaagacggaaugaguuaagggcugguagcaguagucaaagugugagacauaagcuaugaacuagcauagugauaggggccauuuagaagacagucuagaaguggcaacuccaaaucugguaacuaauaggaugguguauuagucaggcuucuccauagagacagaaccuguaggauauacggaaggggauuuauuaggagcaacugacacagaaucacugcaaagucccacaauaggucaccugcaaaaugaagaaccagagaagcugguaaucuggcuggcucaaagccaguagcguguuucaguccaaguucaaagcccuagaagcugggaaacugacacugcagugccugucacgccugacagcuccccaaggagccacuggugcaagucccagaguccaaaaguugaagaaccuguagucugauauccaaaagcaggaggaaaaaagguauccuccuccugaagggagagagcaagcagaaagagcaaauccuccuuuuucagcccauuucucccaggugauuggauugugccugugcacauugacgaugggucuuccucucccaggccacugacucccaugucacuuuccucuggaaacacccucaacugcacccagggacagugcuucaccagccaucuaggaaucucucaauccaguuaaguugacacaauuaacaaucacagauggggugagaguaagguaaagggagaaauucagaugacuuucagguugcuagguaauugagggcacuuaguguaggaaaacaagacaggcagcaaauagaaugguuggggaaaaauuugguuaagauuuuagcauugaguuugagaugcccauggcauauuauuuuauuauuucccuaguucucucuccuacaggcuuagauaugcaacugauuacuugauaucucugacuagauauuuguuaggcaucuuaaacuucacauuuccgaaauugaagcuuuaauuuuuucaauugcucagacugaaaaccucugauugauucucgaccucucuuuuucuucuguauccaaacuaacagcaaauucucuugguaagccuugaaaaacccagaauucaaccacuuuacugucugcacugcuaccacccuuguucaaguuaccauaauugcuugccuagauuauugcaguagccuccaaguggguaucucaguaucuacucaacuuuucauccuaagugauccucuuaagucagaucgugucaccacgcucauuguccuuacuacucuguagagacccuguccuucuaaacagaacauuccuagcaggcucccacuucagagccuacugguacuucccucugccuggaauguuuucccaguaguauggcugucacucacuuuauuucuuguaaugucaucaaagaagcuauuuuuuaccaaccuauuuaaaauaacaucccuucucauuacccuuucuguuuccuuuccuugcuuuauuuuucuucacaaaugaaucaucuucugccauauaauaaguucacaucuauaccuguagcaucuaacaauguaccuggcaaaauaguaggugcucaguauauauuaaauguauggauggaugaaugaaaaaucuuguccaaacaguuguauacauggauauggauuauaggagaaucuuagcugaggaaauguguguguguguguucuuguuuuauauuuguucauucauuguucauuuagugaacauuuacugaucucccuguacuuugcuuuuuuuuuuuuuuuuuccuuuucuuugaggcaaagucucacuccguugcccaggcuggagugcaguggcgugaucuuggcuuacugcauccuccaucuccuggacuuaaguaguucuccugacucagccucccaaguagcugggacuacaggcaccugccacuaugccuggcuaauuuuuuuuuuuuuuuuuguauuuuuaguagagacggggugucaccauuuuggccaggcuggucuugaacugcugaccucaaaugaucugcccaucucacccucucaaagugcuugaauuacaagugugagccaacgcaccuggcucugaucucccuuugcuuuguaucagguauucuaccagacaguggggauaaaagauaaaaaggccuauagacuuguggaguaaggcagauuguaaaugcauugcggugugugcuguuuauuaaauagcaaguagucaaagccauaagaccagaugaaaucauucaggaauuucaagaguaucuuucuuuaauuuuuuuuccaagguguugagcucuuugaagguaggaauuagaggguccuauucauuuuuguauucuucccuuuuuuuguuuuuugagacaggguguugcucucacccaggcuguaaugcaguggcaugaucauugcucgcugcagccuugaccuccuggcucaagcgauccuuccacaucagccucccaaguagcugggauuauaggugugagccaccucgccuggccucuuuccacuuuuaucaccucaaccuaggguagugcuuagaguaagugcuuuuaaaugaaugaacauuuauauaacuuacuaaaauuaugaaaauaacuuuaaugguaugaagaauguguacuauguuggaaaaggaaaugaagggaguuugcuagagaaauaaucuauuuuaagguaugauauauuuuagaugaagacaggaccuccaaguugaagcauucaguaaacauuuguaccugcuaggcuagauuucauagaacagaucaaaacaguagauagaaauuugagacuuauucauuauaauuguuaaaaaaaaaauuuagcccaaaggaugcuuauaccuuaggaaauguucaaauuuuuaaaaaacaagaagaauaaucagaaaggaaaaauaagaucaaaauaguauugugaagcaaaaaccaaguaauaaguagaaaaaguuaauacaaggucuacaauauccccacauuuuuuaguuuaaccaacuuguuauaagcagcccauuuuaaaaagacauacuuucacuuuuaauuuuauuuaaacuugacauguuuuggauaguuuuauuucccaacauggaacaauuuuuaagcaaaaauaaaaagaacuauuuuuauuuuaucagggguugauauagaagcagcucgaaaggaagaagaacggaucaugcuuagagaugccaggcaguggcuaaauaguggucauauaaaugauguccggcaugcaaaaucuggagguacagcacuucacguugcagcugcuaaaggcuauacggaaguuuuaaaguaaguauuguuuuuuacagaguuuuucuauuuuaguuugucuucuuuauucauuguuccuuuucuuaaaauaccugcaaacguuauuuugaagcaacauaaaagaguucuuuaaugccuguuuucaggaagaaagagaaaaacuacuuugaauaugauugcuuuuguucuaaaauucuuucaacucucuaauuauuacuauuuuuuaaucaguugugauuuuccaguaaguugaauuuaagugucagucaccuauucucugugaccuuuuggccuaauaaaucacuacagagagucauuuugagguuccagauugauaacugguuugugagucuuaagaacaauguccugugaacauaccaucaguuuugagagcuugauuccugcagaauauuuauuuacauguaacuuaucuuaaauacaguuuucuuuuuuacuacaugaacacuggaacuuaguacuauuagcacacuauaaaauauuaagccauaagcaacuuugacucuacagggcuguauauuguuuagcaaauuugcuuggaacaaagcuucuuuauguugcaauaauauuuuuacuucugcaaugcaaauauuggcaacuauaugaagaaaauuauucuguguauuauucaauauauaaaauuauucuuauauguaugugaaaggaagaccagcacuuagcaaaaucuacugcaccuuuuauuaauauauugcuucuaauucacuugagcuucuaauaucaaucuuucuuauucccacucauuaguaaaagcaguaaagaauauaugagucaccuuucccaaguuuccuccucuugggugacagaggcucaggcaguccucccaccucagccucucuaguagcugggacuacaagcaugugccacuacgcccacuuaauuuucauauuuuuuguagagacaagguuccaccauguuucccaggcuggucuugaacuccugggcucaagugaucugccugccucagccucccaaaguguugggauuacagacuugagccaucaccacccagccuccucuuuucaaucucuauucaacuucaauaauuuaggccuuuuuccuaagaauaguauggcaguguugccuuuuuauuaguuuucuuguccaccuguuucucucuaauccaaaacuuuugugaguugccaacagcauuuuuuuuuuugagaauagaaaguauuaaagaguauuacauaaagguaagaauuguuucuuaaagcacuuguuucuguaaauauguauaugaguacugaguuauauugcaaaauaguuucuggauggcuuccaaaugaucuuuuuaauuagguuauccaagcucccaaaauccuuuauuaguucuuaggggggaucaggauaaauuuuaaacuccuuaacuuaguacauagauucuucauuaucuagacacugucuucccuuuuaagcuaagcuaccaccauugccucuaaaguaugaauugugccaguuacauauaucuauugaaguucugucaugaugucuuaaugccuucccuuguuucugucuggaugcuuuuauucaccaucucuucaacuuggaggcaaauucugcucuauccuuugaaucaguuaaagguccuuaagcauaugaaaaaaagugcucaacuucauucauaauuaagugcaaauaaagcuacaaugaguuacacuuuuacaucugucgaguggcaaagaucaaaacauuugacauccuguugacaggguguaggaaaaggcacucuuacuaguagaaaugacaauugagcaaauucaaucaaaguaacaguuauucuuuaguucccugauucuaccucuaggaauuuguuuuuuuacagauauucccacucacaugggaaguaagauacgugcuagcagcauuguuuauaauaggaauaagagaauguuuuaauaaauuaugguauaugcuuucacuggcauauucugaaacaaaacaagaaugagaaaucuccuuacauacuguuauagaaagaacacuaggguauauuaugaaaugucaaaaucaaggauccaaguauguaucauuuguauuuauuguaaaaaaaauuaaaauuguauuugcuuauauaugcaugaaaucauuguguaaggauccaauaaaaauuaauaguaugguuauuuugagguagggcaagcuaguuggcuaaaagucagcggugagagagugaugucccuauguauccuuucauucuuuuuuuuuuuaacuuugugaacauauuacuuaugaaaguuaaaacauauaugaaauaaaaaucaauagaaaagauguuucaaauguaaccuucuucacauuuucucucccucccaaacacacacaacuccuuucaauuugauuuugaugcuuuucaguuuuguacucccauugcaugucuauucauagaaccuaugcuugagaguugguuguuguuucacuuccaguaaaagcuccuugaauauagauacugucuuuuuuuauguugaaaaaauuuaccucuuuuuuucucgccacacagacuucuaaguacuuaaaaauguugcucagcauauuuaacauuauuauuguucauauuuccuaauggggaacagcguuuuucucuuacauuccaguauuguuucugccucuauuaauaagguuucugauaauauauaucaguggagauauuucuuuggacuuauaucuuucagcuuuucuuuagauaauggcucuuaaauguuggucugcaggcaggugauaggcaaugauaugaaaaucauaugggggacuuauuaagaauauagaucagcagggcccaucucuccauaugcugauugaguaguacuggggugagcugggcaaucuauuuuuaaaaaacaagcccuucagaugguuccguuacggaggcaggauuagaaacagcuguauuagauauuguuaggaaauaccagauuuguucuuaaauaaauaaagggggauuauacauuagcugucacuaccaccuccuguagguaaaaagaagguccuucucaagcucaacaucuuggaaagugagguaaagguuaacuagauuucaugaguuguauuuaguguucguucaccuguuuguguggggcuaugcuaugugcaguuuauagacccauccuugcugucugugagcuuaaugucuaaauaaaauaaagguuguugucaauauguaguuagaagggcauacuaacauaauuuaugcaacucuuugcauuguauuaaaauguguuucuguuuuagcuuguugaugacuggaguaucugcuuucuacugcucagaaaaauagauccgacuccuuggaauauguuuuuugcuuuguuuuguucuuaaaagauugucauuuuccuuugaaaauuuucagcuccuuaauuucaaggcaacagaaauauuacaaaacaaguuucuuugauuccaguguauucuuagaacacauuuagcccgagauuauauauuauauggaaaccugaagaugauaguuccugcaauaaaucaguuuuacauacaaagugauucaucaguuuucgauuuuacauugaaaaauuaugggcuuuucugugaaaauuucacuuacaagucauauuaacaagaauuaaucagugucacaccaaaccauaagacuuagagucauuaggaauuaauuaaaacugcauuauuauggcaaugacucaagauccucuuuuucugaguuuuuucugagaauuacuuuguauuugccauaguuaauucauugagggggaaggauguaaauucugaaaagaaauuaauugaaaauuguaguuaaauugcaugauagauagcuuuugaucaugaucauuuauuucuagauuuuaaugauugucuaauucacuguaauuucuuuagacuuuuaauacaggcaggcuaugauguuaauauuaaagacuaugauggcuggacaccucuucaugcugcagcucauugggguaaagaagaagcaugucgaauuuuaguggacaaucugugugauauggagauggucaacaaagugguaggcguuuuaaacguauuuuaauacuuuaacuuuuagaaauauaguuuuagaaaguauauuuagaaauauagucucaaaagguuauaaggauuacauuauauaauuauauuuuuauuaacuguauaaaacauuuuuucagccaacugacuuacuaauuaaugguuuaagucuuuucagcuaccguaugaggugguucuggccuuguacugcaaagaaagaaguauugcucuuucaguaaucagauugccauacauguagaguagauuuggauacuugcauuaauacuauguucuuaggaauucagaagcuaagaaaacguugcauuccuaugugaauguuuucugccaccccuuugaguuggaacacacguagaagugcguuucuaauucuuuagcugauggucuuuuagcuugcuuauagaauucuuuaagugacaugaauaaugaggucuuacagcaggugaugacaguaaauauaacuauaaaguuuuaugccaaaggggaucauugagaugcaacaucaucuagucuucuaguuuuguagaugagaaaauaguucaguugagugagguaaaugauguacuuaauaccacaauuacguagaaggagggagggagaaaaugucauacaagcguuuuucacaaaaucaugaaaagauucagguuaucaaguuucuuguuaaacuagacuucucuccucuacuccuuuuuagauacacuaucagucaauagccagucaccaguauuccugcuagucucuuccuacucuguguugguagguaauaaguaucauggagaacucaaaacacgucuccucuaguggguuugauuaccuuuccauagaauguuccuuguauauugcauuuuauaggauaauaucauagguuauguagcagagauucauaaaaugaccucaucuuuauucaaaacagggcuaauucuuuugcuguuuuuggaguagaguucuaaauaucuuauuuucauuaacugauuuaaaaauauauuuuauauaagaaaugugcaggcaugaaaaucauaggaauugguaaaagucuuaaggaaaguaaaaaaauuugggggaaugauugguuuguacuuauauacaaauacaaaaaucuuuggguugaauuuuuaguuaaaacuuucaauaauuuacuuucucuguuguuuuucaucauaauaguuguuuuguaaucagcauuagaagacaaauaaauauugauacuauucaaguaaaaggccagcuaauuuuagcuucgcaagucguguuaccucucuuuucauguagaaauuccccuucagaaauuuuuuucugaaaagauuagcagguaccuauuagccucugaacucuggucugcauucuucucucccaaacagugaccuuuuaccacauguccauucauaugggcagugcugauaauugguucauuuaguaacaguagccuccggaugagaacuagaugagagaagcuuauuaauugaaaugguuuccaaaaaggauuauuucacuuacaaguugaaacaugguguguuuccccuacugaaucaguauucuagugaaacauacacaauauauuguaugcaugagaaaaaucauuuuauuggcaucuggccaacaauugucuaauuccuaugcuauacaauuuaucauaauuuugcuaucagagaaggagugcauguaaaauuauuuugccuuauauccuuuuuuaaaaaauuacuauaguagcagcuccuuaugucacucuaaauuuuauuuacuccuuaucugucauucgauauuucaguagaucuuuaugugauaguaaaagaauugugagccaggcuuugugguaugcaccuguaaucccagcuacaugggaggcugagguagaaggaucgcuugaguccaggaguucaaggcugcagugagucaugguuguggcacugcacagcagugggcaacagaaggagacccugcucaaaaaaaaaaaaaaaaaaaaaacccgaaacaauugugccucauauuuacauagaauuuaaagguuuucagccuuuuuuacacauauuaccuaaugcaauucuuuuaacgacccugugaaauuaaguuuuuuggauucaggaacaugaucagagaagucaaguauauuuuccuaaaacccugaaauuguuuuaucuuuuuauucugcuaaguuccucuauaacuucuuuucguuuuaguuuccucaucuuuucuuuuucaagauacuauuaagcuauaaaaauauaaauuuuaaucaaaauauuuuucuuuuaaaaaucaagauuuuaaagacugcuuuuuauagugaggagcuacauaaugucuauagcauucuaaaggacuuugugccauaaauauauccaaauacaaggcuuuuuuuuucauuugagaaguucuauuuuaagaccuugauuuuuaaaauuuuaauuucauaacuuugcauguaugaauuagacuguuuuuauugucugcauuuuaaauugucauacaucauguucagucaaaauaaauuacuuugucuuaauuauguaagccugccuaugugaauuuauauugucauuggauaccuuccuuaguacuuacagauugaagauuauuacuaaauuguuuuaaaaaugauauuaaagaugugcacuuaagguacuaccagaguuuagaugaauuauuuaguacuagaaaacaugauuugggaaaauaauguauaauauaguaaguguaacaaauauauagaaaaucugaaacuuucuacauggaagugggagaaauggucuaaaaauauuuagagauuucaguuucauuucuuuaaauuauuugcaaacuguaauacauauuuacugucauuuuaauucauuauuauaaauuaugugauacagaccuuaaauacaaagguuuuuauuugcuuucuuaauuuauuaaaauaauugcuuuacuagaauguaucuaauauuguucuuucuuuaaauauugacuagaaugcuuuucugguuggaauuucucuuaccaaauuaauacaaugguuagcagacaaguuuuuagauuaauauaacugucauuauaaagauuuaaaugaauaacaaagcuauuucugcuauuaauggacacaagaauuuuuuuuacccuaauuccaucugaauuuauuuuuauuuuugauaaagacaaaaugacacacuaguagagaccuagauuguauucccacuuucucuuaaugaccuguaugaccuugggcaaauaccaugcacgcagacugaguuucuucaucuguacagugagaaucauucugauacuugucccagcuacauuauucguuguugugaagaugaagagguuguaccuaaaaaaaaauuugguuagaauaagugaguaaagaaaaaugaagaaacuaugaaguuagacuuauaaugucucuaguguguuugugacucuuaauagacguauuggacugauuuuuuuuuaagcaguuacuuuuaagauaguucucuugauaaaguuuucauguucucauaccucagcauuguguccucauuuguugccugguugcuuugagugacacugcuuauauacuauaaauguguuuauacucuaucaaugaagcauaauagccuuauaguaguuaagaaccaaauaauguuuauaacuucaugacuguuagcuuuauaacugugcugcagauuguuuaaagagcauguuuaaguugaugaguuaaguugaugagugugcuuuuuuugaaauuagaaauucuuauagcccacauuuuacucuaauuugauuguguaucagcugcuguuugcaaaguagauucauuuaucaagggagaaagugaaaauaaagguuaguagagugauccaauuucuuauucuuaaagaggagaguuccuugauuauuaaagugacuccauugcauuuaacugcuagaaaaauuuaauuacaguucaaacauuuucaaggugggguaguucauucaugagaaggguugauaaugcuuaaaaugauauuuaaaaagaagucacugaauuauuuccacauaacauaaucuuaaacacacuuuacauuaaauaaauagcauuauuaacauuuuagaacugauuauguaaagcauaugauauagcaaaacuagaauuaacauguauuucuaauuuaaagggcaccuuaaguuuugagccaguuauuugauuucagaacuauuuauucuucaggaauuuaaauuuuggcuucuauuucccaagauugaaaugggaggaaaguuuguuaaaacuaaaacuuuuuaucuuggacugagugggaaaggauagauugucucuuaaauuccuacugguaagacuuucuagcaagaaaaggcaaguaugauaaguauuuucgaaucuuguaaauuuauauacauacucaccuauuuugaaaaagcaguauuuuauauacuuugaagauauucuucauagggcugggcacaguggcccauaccuauaaucccagcacuuugggagguggaggugggccugagcccuggaguucaaaaccagccugggcaacauggugaaacuccaucucuacaaaaaaauacaaaaacuagucaggcguggaggugugcaccuguggucccagcuacucaggaggcugaagugggaggaucaccugagucccaggagguugaggcugcagugagccacgaucgugccagugcacuccaaccuugguaacagagcaagauccuaucuuuaaaaaaaaaaaaaaaaaagauaccuuucauagacaauggcuuuuuauuuuauuaacagacaaugggaaaacuagcucagauauuggcuagcuuauaguuuguuuuguaguguuuggaaauuagcuccuuucugaauacauguuaacauccugauguugguauagaaacgagguuuguuguuuguuucuaaacggaaaaauuaaugugauuuuagaagccauuauuucuuauccauucugaucuuguuguggauauaggaauacuauuaagaaauuuuaacuuucuuucagaauuauauuuuuuguugcuaaaaacuuuuuuuuuucugugaaaggaucauauacuggauaacauacaaagaagacuguauucuaaauaaugaacuuguaagcauccuggaaacuuguacaguagggcuauuauaaggacuaaugcaggcagcaggaaauauucuuacuauguuuagucagcagcucuuugaaauuuuucucuuucacagugaauuaaaauggauugacauauguucauguggacuaauuuuaaaaauuaagccauaccuguggcuggcugaauguuaaacagcuuaaacauauauauauuuuuaguuuuauuacucuaccaagaaguuaauuaaguuuuaggaagucaucaaaaagaaaaagucucaaaagguuaaauuacccaguaauuuugcccuuaacuguauguugaagaaaaugaaaacagguguccacacaaaaaguuguauaugaaugcucauagcagcauuauucaucauaggcaaaaaaaaaaaaaaaaaugcagauguccaccugaugacuagauuagcaaacuguauauaucaugcaauggaauauuauucaucaaaagaaaugaagugauacaugcuauaacaugaaugaaccuugaaaacauguagagugaaagaagccagucacaaagaaccauauauucuaugauuccauuuauaggaaaugccuagcauagguagaccuauagagacagaaaguagauuagugguugccuugggcuggaugcagacagugacuacuaaaggguauguuccuacuucuuagggugauaaaaauauuugaaauugauuauuuugauaguuguacaacucugaauauccauaaaaccauugaauuguacacuuuaaaugagugauuuguaugguauaugaauuauaucucaauaaagcuguuaccaaaaaaauaaggggagauauucucagcuucugucucacauaaauuucacauacauugccuuagaguuguauguuuuuacaguaguuauuguaucauaaccacuguaaaaaauguuauccaacgucuuuauauaaaauuauacagaauuacugaaggcauuuuaugauuuauugacuuuugaccaucaccauccccccuuguuuccuacguagggccaaacagccuuugauguagcagaugaagacauuuuaggauauuuagaagaguugcaaaagaaacaaaaucugguauguuugaugacuaauaauugccuauauuacuuaccuuaauaauuuugaauuugagacaauuacaaaaguauucuugugauguuuuguacuuuuugguuuuaaguuauccuuaaguuucacuaaaugauagugaaagagaauaaaggauggugauauuuagccuuuuguguugcuuauccccauuucuauuuccuccccuucucaaaaugaauacucauauauguccucaagaauaacguuuuuauaauuucauuagaguguuuuacuuaaaagauggaaucuauaaaaucucauauauccaauagcagguccuagauaagcaaggaguuauaucacuagaaaacaguuuuuuuuuuuuuuuggagauggggucucacucugucccaggcuagaguacaguggcgcgaucucaacucacugcagccuccaccuccugggucugagccauucuccugccucagccuccugaguagcucggacuacagguacacgccaccaugccuggcuaauuuuuuguguuuuaguagagaugggguuucaccauguugcccaggcuggucuugaacuccugagcucaggcaguccucccgccuuggccucccaaagugcuaggauuacaggugugagccacugcgcccagccagaaacaguucuuuaaguaaaauauccucagccagccuaagugguuaguggaucucgacuuuuucaguaaaguuggagggauguaaaaaauccaucuuagcccugcauggagcuuuuuaauugucuagucuauuucauucuuuauucaagcucuuuccuuuucagguaaaacuuaauuuauuuauuucuuuguuuugucuuauuuaaugucugaaaaacuacuuuguuauuauuuuaaacucugcaucuuaguaauaguaucuuaauaguuuucuuauuuuccuuugcauaacuuuguacaaagcuccauagugaaaaacgggacaagaaaucuccacuaauugaaucaacagcaaauauggacaauaaucagucacagaagaccuuuaaaaagugaguaaaauauucaaguacauuuguuauuuuuguuaaugaguuggcauaguggccacaggcaugauuauuguggaucugggaagaaugaauauauuuuaaccuuuuguauuucuaaucauuugaacacuguuuuccuuuaacagcaaagagacguugauuauugaaccagagaaaaaugcaucccguauugaaucucuggaacaagaaaagguugaugaagaagaagaaggaaagaaggaugagucuagcugcucuagugaagaagaugaggaagaugacucggaaucagaagcugaaacagguaaaauuaaaagauaaaugcauuuucguugaauuuuguggcaguguaaaauaagacaagaugagacguaauuuuuaaauuuuucagacugauuugcuacuuguuuagauaccugccacacuacuaaauuaucuuucagugaaugcuagaaacuuacauauaguugugaauuuauuauuauuuaauuaucuggaggcuguuguucaccucugcauuuugccgaccuauauuuaaagaaguugcagaggcuucuaagacuccuuagguacagauagguugugaguggguucucagcaauugagaaaugcuccuguuccuucugagguccaaacguccaggaugccggucccaacagcaucccaaauuuucccuaagaaauaguaaaguaggaauggaguaaaaacucuuuccugugagggugugggggaauuugcuuuguuuugagaaauuuuaaagauacagaaaaguauaauaaacaaacauucauauuccaacaaccucgacuuaagacuuuaacuacugugacauuuaaucauauuuacuucaauuucuuaaaugaaguuaaaacauuauagaugucuuuuuuggucacccacccuagucugcuucccuuuccuuccuucaaaggcaaucacugucaugaguuuuuuucuguaaucuucuaguucauuuuuauagucuuacauauguguauucauauguaacauauaacaauuauaauauuguuuuguguuuuuuucauaugguaggaauuguuauacaucuuuuuucacucaaaaguuauguuuuuuauauuuguccauaaaucuauuucuauaacuugaucugcauuuuuuuuuuuuagcuauuguauaguauucuauuaaauaugucuguuuccauucugaugaacauuuaccuuauucucaaacuccuggguucaagugauccuccucagcuucuccaguagcugggacaacaagcacauguuaccaugcacaucuaauuuuauuuuuguuuuuuguaggguuaacuauuuugcugaggcuagucuugaacuccuguccucaagcaauucucccaccucagccucccaaagugcugggauuacaggcaugagccauugugcucaaccuauagccuaaaguuauuuuuaugcaguuaaucuccucccugggagacauuacuuagcucucagucuguagucaaguauaucauuacaaauuaaacuaugugcacaagagagccaagacuugcacccagaucuccuaacuuguauuuuaagucuuuuacuacuuauguaguauaauucaagaacuagaaguccaggcaucucuuucaaagauuucuagguuuuuguucacuaaauuuuuucuucauuagcccuuguuuguauacaagucacuguucaauguuagacaccaaggaacuauuuaaaacaaacaagagaccuuaggccaguuuuaccacuaaccagcaaaucuucugcuaucuuuugguugaauuuccuugauuauaaaaugagaaaaaucgggcuauaugaccuggaugguucuuaaaacucuaguauucuauuaaauauaacuaauuaccaucaaauugcauuguauuuguucccgguuuggaauugaaacguacuaauugcucucuacucaguuucucacugagcuaacuuuaaauguuccuuugaagcauuguacuaugauaauuuuguucuuccuguugcuaguggcaguugugccaggaaaauuugacucugucucaagaauuaacccauuguaaacgcugugugguuccuuuccucucacucucuuaauaucagcuaggcuuuaucauacuuuauuuggaaagcuugagaaagcagccauuucccuguagagcuacagcuuaauuugacaauuuguaaaccauuuguucuuucuacuuuuuguaagguuauuuccuugggaaacuauuugacauaaaauaacuauuuugcugaauuuuguaaaauaaauuauuugccaaaacaguuuuucuucaguguucuuucucuucucauaaagcagauaaaaaugagagugcaaccauaaguuuuaguuaccuuucaaacaauuuacaaaugugaaaguuaguugagaaaaugagaaagaagaguacauuuuugcuuuuaggguucuuucuucuaggacuuuuuuguucuuuguugaaaucaaauggauagaaagacuacagcaauauuaauaacauuuacaaaguaaguuggaugguggggcugggugcuguggaucaugcuaguaaucucaguaguuugggaguccaagucuggaggauugcuuaagcucacgaguucaagaccagccugggcaacauggggaagcccugucuuuacaaaaaaaacacaacaauuaguaggugugguagcgcacaccuguagucccagcuacucaagaggcugaggugggaagaucgcuugagccuggguaacaggcuucagugagccaagaucaugccacuguaccccaaccugggcaacagaacaagacccugucucaaaguaaauaaauaaguuggauggugguacaugggguuuaucuuauuuguuauuuauaucuccuacuagacugcaagugaagguauuuugucuuuucauuggcugauauaucccuaguaccuagggcacuacuugaagaauggggacacuuauuauuuguugauugauucucuacacaguuagguggauuauuuuccaagaagaugauauugugcccauuuaacuuuagacuuuuuaggagugggaaaacaugcucuuugggacauuuaaccauacuguuugacaggaauguaagguaauuauugacaaaagcacuuuuagauuuccuugauuaaagaggaaccaucaguuuuagaucaguaauaauaguuguuuauccauuagaaaauugcauagcuacuguuaagguuuuaguuacauugcauucaugcauucaaguuuuaaaucuuaaauuucuuuuuauuuucuucauuuuaaaaguacagaagucagauucuauuugugcauuuuauugucagaagcuuuguuguguaucuuuauuaucuuaacuauuuauuucagcauauauauagagacaagucuagaagcucccugaaaaacugacuugcgaaaaggaaucacaguggggaaagacuuuuaguuaacaaaaccuuaaacaaaaauggaauauaaaaugauuuuuucccagccauugagaccaaauauauauggaaucuugacucuuaauuguuugucuuuaauagauaagacaaaaccccuggcuucuguaacuaaugccaacacuucuaguacacaagcagcuccuguagcuguuacaacaccuacugugucaucaggucaagcaacaccuacaucaccuauuaaaaagguaagccaaaauuguauuugcugaaaauacauguauucuauuuauguaccacuuggacuaacucauuaaaguaauucugaauuuuuauagucuguuccaaaaauauguaagauuucagaauauaaauauguauuuauguuucucaguugaaugagauuucuucugaaucauguuuuuuuauccuuuuugcaauugauauuacuguugauauuacaguugguaguuaacaaauauuacauacaguugauaguuaauaaauggcagaaagauaaaaauuuuuguaauauuaaaaucagugauuguauuaguuuuuuuuuucuauugaacuuuuauuuugagaagcucagguuuuauauccuuuaucucuauuaaguagaggugugcauguugauaauuucacacacggguaaauuacaaauacuacuaccacaagucaaugagagaacuaaaaucuaaauuuuuuaaacucauaguacaaagcacuaggcaggcaacuuugguaugucaguaggagcaugaucucugaggucagauaaaccagagaugagcuccugacucuaccuuauuaguuguuaugaccuugagcaaguuacuuacuaucuuccuuuuguauaacaaaauaaagagaaauacaguuaauauuguaaggauugguugagauagccuggccaguaaacugaguguguuuucaaaauguuaguuucauuucuuucucuucuuucuguucucugucuguucuccaucccucucaucucuucucuccaccgaagcaguguuuuccaguuaguguguuaaucuuuuuaagacuuuacguuuuccugcuucucuggaaccuaucuuucuuuuaacccaaauuaacgauuaagaguuuuuguuuguuuauguuugaccuacuagucucuuuucaaagauuucucuucacccguccuuuuuuuuaucuuuuuuuaucauuucccucucuguccacacauaccuuuuuuuuuaaccaaacccuugaaaaauugauugcaguaaucauaacacuucaugccuaaauaugucaguauguaucuccuaguacaaggcuauucuucauucucaaaauaaucacacuuaggaaauuuaacuuugguauaauacuauuauguuauuaauaacuaauauacccagauuuucccaauuguccuuugaguauuucuguuuguuuuuuaaaaucagggguccacuuggauuguacauuguguuuaguugccuuugaacuucuuauuuuguugcucguuugacauuaugugcaugaguuuaaggacugauugguuuuuaaauccucacagcauuucuguuguguugucagucuugccaauauuuggauuuggcuuuagguggucaaaauauagaucuuuuugaaaucauaaacugcagaauaaaaaaaaaaaucccugcuguuaguaauaauccuucucucaaacuucccaaggaaggcaguaauguaaauuauuagugguagaaacguguugguuucauugguacauaguuugaauauugagaaacuaugaaugacuuaucuuaccuuauauauuccaaaacugagggcuucuugaauucaguuagaacucauguucauaugauaauaauuauguaugcuucaguuaagaaauucucuaaaagcaguuugucugcaaaauuuugaagacuguuaaucauccuauaacuagcgucacuauaaacugcuuuaauuaaaguuuauuuuacuucuaagacccccauguacuucuucagugaauacuaaauucauuccugcaucuuuugaucuguuuagacuauaauguuaucagaaauuccaucucccuggaauaccuaggcaagaaacuggcuaucuuuuuuuuuuuuuuucuuuuugaggcagucuugcucugucacccaggcuggagugcaauggcacgaucuuggcucauugcaacaucugccucccggguuuaagcgauucuccugucucagccuacugaguaacagggaucacaggcaccuccaccacaccugacuaauuauauuuuuaguagagauggguuuucaccauguuaggguauucucgaacuccugaccuugugauccgcccacccaaaguacugggguuacaggcgugagccacugcacccagcacuggcucucuaucuuuuggguauuuggcuaaguaaucccuuuccuacuacagucaaaugauuacgguaaacuuccuguguucaauuuucuuuuucuuuuucucacauauagccaacauuuauggcaauguaguucucaauuuauaccuaaugcccuaacugaaaagaaauacuuuauaaccucuguuaguauagugggccaguaaucucuuugcuguaaaaguucuuauucaaaaucacucuugauucuguaauuaagcuaauauaauaacaucugcuucuaaauuugcauauuuagaaacuauuuuauucucaguuucaagcaccauaacuuacuuugaagauuauauuguuucuuuguucuuaaaguuuuguaaccaaauuuuauucaaaacgaucauguguaaaaauuuugaauuuuuuuuuuuuuuuuuuuuuuuuuugagacagaguuucacucuugucacccaggcuggggugcaguggcgcaaucucggcucacugcaaccuccaccucccagauucaagugauucuccugccucagccucccgaguagcugaauuacagacaccugccaccacacccagcuaauuuuuguauuuuuaguagagacgggguuucaucauguuggcuggguuggucucaaacuccugaccucaggugauccacccgucucggccuugcaaagugcuaggauuacaggcaugagccaccgugccuggccugaaauuuuuuuuuuaaugaagagggggaguccuuuuuuuuuuuuuuuuuuuuuuuugagauggagucuugcucuguugcccaggcuggagugcaguagcacgaucucggcucacugcaagcuccgccucccaaguucacgccauucuccugccucagccucccaaguagccgggacuacaggcauccaccaccacaccuggcuaauuuuuuguauuuuuaguagagacgggguuucaccguguuagccaggauggucucgaucuccugaccucgugauccacccgccucagccuuccaaggugcugggauuacaggcgugagccaccaugcccagccgaagagggagucuucuuaucaauacuguaugacuuuuaaaaccuguuauuuucagugauucuuauacuccuguaucuaauuuagcauauuaguauuuuuuaaaauuuuuucaaguuuaucuguaacuuuagugaccuaacauuaaauuuccuuaaacagguuguuaauuucuaauugcaucuuaaaagguuuugcaauuaucuguuuuuagguucccagucaugacuccacuucuaauauuuagauaaaguuaucaaguucuccagcuuccuaccccaguacauaaacuauguaugugugcacuuguguucauggcaagacagaucacaaaaauggaagcacacgaaacaguuuuacaugcuuauuuucuuuuaauaacuugggguaacuauggugaaagauagauguguuuacuuuaauuccuuaacccuuccgcugaaauuaaagaacuguuucuguagcaauaucaagcugaugauuuguggagauguuaucuauaaaaccaucaguuugauuuugugcuuaaaauuguuaacuaacaaguuuauauaagccucucuggucaaaauaaauuuuguugggaucucuaaagcagauuaucuauucuucuauauggguguacauuccaauaaaauguaaauggcauuuucuuuacuugaugguaaaaauucagaauuuuuauggaauuaaguguucugguuaauugaauucaauguaauagcuaauaauuuaacaaaagacugcuaugugcuguggguauauaaaguaguccaaucgaaacguacagauguagcaugauuuaaaaggagaagaaauuauauuugacuuaagguaguagaaucaggacauuuuagauaaaucuuaaaguagguaguacuccaccugagagaagaagggcuuguaaaccuuguugaaagggagagaagaaaaacaauaugagcaaguggggauaauauggaauacuuucgcaggaaaaaugaauuguuccauuugauugauuuauagggugcauauauacaaaguaaacaggaaaaguagagcuauauugcaggaugucuucaacuguaggauaacacuuuuauaauuuauuugauaaguaguagucguggaagauguuugaacaaugccaugagaggauuauucuuuauagaauauuauucugacagcaguguacagauuugaagaugagaggcuuauugagaaaagguuuauuagaaagucauugaaguugcccacaaugauaagaauaugaacuagagaagugacucugggcuuauaaaggagaggagauuuagagacuugaccucuaauuuauggauggaggaaaaugacagagaaggucuaacauaauugugaaguuugaaacauaggagauugaagagauauacuuagugccauuaacagaauuagggaacugaagaagagaugguuuggaaguaaagguguuuuauuuuagacauacugaguuucaaguuuucaguuauaguucuagauuguccacucuagaauagugugguagaauuuuaccuagaauagacagguaaaauuaggacuggaaauuuaggagacuggacuggagaauaacacauuugagaauaagcugacuacaauuaauauuuagccugaggaaguaaagacccuccuccuaaccccccaggagaagaaaguagaaagagaauaugagagauccaagagcaggcucuggaagggcuagcacaaggaaaguuguacacacacacacacacaaacacacacagccuguauaaggaacguuacacacacacacacacacacacacacacacgcacacacagagucagucaagaaaaggaauggucagaguaaaaagaaaaagaaggugaagauaguguccaguaaaaaaagccaaagaagagaguuuaauggaggaggagguauaguuaaguauuucaggaaggguuuauuuauauaucaaguaaaauuaaaaggugcuuuuagacauauaaagcaguacuuaaauccaaguucauguugggcagaguggagguauaucagccauuacaguguaacaaaugcccauuucaaaauugauagauaguacugccucguuuuucucaacucuaaaauaacaguaauaguaguauuucauuggguaauuauaagguugaaacaggauaacccaugugaagcacuuagcugagggucacacacuaguaaauauuuguuaaauguuagcuucauuuauaacaauaaauguuagcuucauuuauaacaauaaauguuaucugacugacugacucuggcuguuuuauaaugggggaaaaaacguuuguuuccagguuuuuuguuuguuuuuuuguuucuguuuuuugaggaggugggagaccuaauguggguguuggcaaacuauggcuggugggccaaaccuagcccauuaccuguuuuuguauagcaaacugguuggagaaaaaaaauaaaaaaaagucauugucccuaaaguuuuauugguuacagccacacucaaucauuuguguauuaauauuaucuguguuccacaaagccuagcauuuacaguguagcccuguaaacucaccaaucaauaagcagcugucucaguaccuaucauauugcacagaauauuagaguucgcaaacuuucuuggucauuggagccccuaguguuugguaggauuuuuucacagugccacuggcaaaaggaauugccuguuugucucauuaaguaguuugauggaaaugugaucaaaauggcaguuugugcagugucuaugagaugucacugugcuucucucaaaacuuuaaaauauucuacagagcccccgugauuuuguugugacacucuggagcacuuuggugcacauuuuaggaacugaggaaugcuuagacacuauugauagcaauucauuacuggaaguaccagagguauaucuuuauaacaguuuuguccaugaaguggcccucaagcaucaucaugggggcuuuaacaagcccuguuaaccugcuaauuauagcaaauguuggcaauagauaugaaagaaaugauuuuuaaaaaauuauuaauacccuaugcuuguggcaacuaguuaguugcuguauucaccaaucuauauaguuaacugugguugaguauagaauuucuagaagugaaguugaugaagugaucuaaagauaacagagguugcauuuuuaggguuguuggaaagcccuuaaaauagcauaaauauuuguacauaaaauuaguuuuuauuauaguugaaauaguuaauguuugguggggaaaucaguaaauuuaaggcugugauguuaaaaaaaaaaguauuauaauuggaaaaauaucaguuacuaguuuuuguugauuauauuggacacaaaauuuuuuaaccagaguauauacauggauuaaaaacaaaauucaugugcaguaguuuguucagucacaugcuauauuaucuacucuguaugccuuuuaauugcuuuagaaguuuauuagauuuuuuucagauuaucucaugcuaaaauuagaacuuguucccagugacuuuuaaagauuggaucauuacccaauuauugggguuaauuauaaaauuauuuucaaaugaagaaaauauuuuuuguucauaacuucccuuuucuguuuucaugcuuucaaucuuugucucuuuaccugucuuauuuuaauuggcuuuaguaugauuucauugcuccuaucaugccugugguggaaucaguagauccugcaucauggaggcagggcuugcgcaaaacuggcauuguucuugugcccaguaagggugaaaaaucuauggugaggcauuucuaugugcaagaauuuauauuagguuacaacauaacaaguuuaauauaaauugguuccaaagaugcaugguuuuaaguccuuauggugugcucauuucuguuuucuguauuugcaucauaauuuuucugugugauauaaaguguguaguguguuuucuuaagucuaaccccuaggaagguagucuauuucuuuaaaauuuuuagaucuuuacauuuuuuacuaagacauuaaccuauguaguaaaaguguuuuauccugaaacuguaaaccauaauuuuaaauauauuaucuguaaacuuauuguuuccaauuuaaggacugaucagcuuuacaaauucuuuuuucuuuuccuaaaaaauaaaauaaacacaguuuccaaccacagcuacaaaaauuucucccaaagaagaagagagaaaagaugagucuccugcaacuuggagguuaggacuuagaaagacgggcagcuauggugcacuugcugaaaucacagcaucuaaagagggucagaaagaaaaagauacugcagguguuacacguucagcuucaagucccagacuuuccuccucuuuggauaauaaagaaaagguaaucuauuucacagucugguuucuaugaaaacuguuaugauuucuuuuccaggaacaucaaaucugguagauuuucugcuaguuaucuuuagaucuagguaucaaguuaauuaaccuuaaugaauuacauaagacaaauguaauuuauacagaauuauaaauacuggaaagaucagauguauuugccuaaaacauaaauuaugggacuauacuccguuaaaggaaucuauuaccuuacuugagaauuuauaauagaacuguauuaaggagcaggcuuauuuuguuuauuaugauucaagaaacuuucugaaguuuaaaaaacauaggaacacauuuauucuagaauguuaguauacucauaaguuacauuuauucaguaucugaaaaaaaauaccagauuuuucaucuaccauauuacaagcaacuuugucuuaaugaguaaauuuaauaacuauuuugagaggugguauuaauacugcauuauauaggauguaccacaguuuauucaauacuaguauuuauuucuacagcauauucagugcuugaacuauuuuuuuugcccauacaguuuucuuucuauacuuagaaauguuuccuuauaucagaaauucagaugaaauuucucaucaaguaauucuaauauuuuugcuuuuuuaucaguuuacugugcaguugguuuccagguauuuuaugccagcuuacuaggaauguaucagagugucauugucacuacacacucuuagccauauuuggauaaauauaauuuaaauaauauuuguuuugacuauuuugauguauuugagagcauugauuaucaagguucuaaauagcuuauauaauauaaaugcuugagaccucucagugaacaauauuugaaaguuuauuucucuggaagaaauaaagauauuucagcuuaugacacaguauuaaucuguuagagaaguuuuagaaaaagucauuaaaaucuggagaaauuuuuuuccuuucuuaguaaaauauuaucugauuccaggcuaaaagagaaagaaaacuaauuugaacaggcugauuauugauugacauuaauuuuagaguucagcuaggaauuguugaaauacuguaaacuaugauagcuauguaauuauaauuauugaauaaccuuuucuuaauacuuuuagcauugccuauagucaguacccaaauuaauuuuuacuuauuuuuuucccuguuguguaggagaaagauaguaaaggaacuaggcuugcauauguugcaccuacaauaccaagacgacuagccaguacaucugacauugaagagaaagaaaacaggugaguuuauuuugauuugcuuuaugcauucacuauaaaaucuuuauuaucuagcauuagaguuaauacaugagcauuguaauuaugugcggauauguauugugggaagagauggaggauauuccugaaggagaaaauaccagguacauaguccugaggaggugcaggcuugguauguucaugaaauaauagcaaagaagauguggcuggaacagaguaaggggaaagugggaggagauaaggucaugaacuaguaugaguucucuaaauauuuggaacauuuaggaaaggggaaagaagaaggaaagcccuuacuuaaucauuuuaguuuguuuuaaauauuuuuguuuaaauauuguuuaaauauuuuaguuucuuccuguuuuucagcuuauagaauuuuauuuuuuuaauuuaauuauuuuuauuuuuauuuuuauuuuuuuugagacagagucucgcucugucacccacgcuggagugcaguggcgcaaucucggcucacugcaaccuccaccucucagguucaaguaguucucugccucagccucucaaguggcugggauuacaggcaccugccacccugcucagcuaauuuuuuuauuuuuaguagagacaggguuucaccaucuuggccaggcuggucuugaacucuugaccuugugauccaccugucucggccucucaaagugcuggguuacaggugugaaccacugcacccggccaauaacuuuuuaauauacuuuuaaucauguuauaauaucuaauuuuuuuauuuuuuuccccuaagaucucauaagcagucuucuauguuaauauauauuuuuaauaagcauuuuuuuugucggcacauaacauacuauaaaguagaucuucugcgguuaaaguaagcaucuccccuacuuuauauuuugugaucaaaaagcauauuucuauaaauaucugaauuuucccccauacuuaggggaaaaauuauaccuuaggguauauaaucuuaguacugaaauuacuuuaucuucuugauuaguauuccuaaguguccucccaaagguuuuuacuaguuucagcuuauacuaauauuuacuaguguaccgcuuucuuaauccuauuuuaaaauuauguaccagaaucugaaggguguucuuuuaacagagauucuucaaguuugcgaacaaguaguucauauacaaggagaaaaugggaagaugaucuuaaaaaaaauagcucaguuaaugaaggaucaacguaucauaaaagguaauaauacuauucuuaagcgguuuuuauguauucauuuauaaaaauaugaggcaauuuguuuggagcccucaguuuaacaucauuuuaaacaaauauguguuuuuauuaaauacgaguuuuuguuguuuaaaacuuacucuaaacacaggauauauauuuaaagauaggugauaauuuguuaugccuauuauauaauuaagcuucaaauauuaugaaauguuuuuuggauuguuacauauuuaaaaggaacuccuuuagaaggaacuccuugacuagaacaacuuaaacaggccagugucuuaauggaucuaguugucauuguugaucuggaaagauuuggcuugcccuagaacucagagcuauggaaaugccuucaguuggaauguugguaguaucauauugaagaggaaaaaaaagcccuauaaacaauuucuuuacuaaaagcaaccaaaaagaauaagaugugaacaaguaucauguaggcauugguuacuuccgagguaucugacccauugcugaaauaauuuccuucaaaaaaaugucaacgucuuguuuucccuggguaauacaaaaccaaaguguguuuuucaggcucagccuggcaugaccauaugguguggaauaguuucaaaaauaugaaauaucagaucaucuuugucuuguugagaaaguugggaggaggcacuaaaaugauacacuaccgaauuaagugaaaucuucuaaacucuagcaaguuguagaugcaacucuuggugcuggagcuggugguguauuuaggaacacaguuuuuaaauuuuuuuucuagccuuguaauuuauauaauguauagacauuaacuauagaauacacauacaaacacauccuauauagauaugacucuuuuguuuaguugcuccuuugguagaagacaagaugauuugauuaguucuaguguuccaagcaccacaucaacaccaacaguuaccucugcagcugggcuucagaaaagccugcuuuccagcacaagcacuacuacaaagauuacaacggguucuuccucagcaggcacacaaagcagguaagucacagauacauuuugugcucaggucuacugugugcuuauguaugugcaugcguuuuuguuuagaagauuguggggcucuggauuuuuucauuuaucuuguuaaauuuauuugcagacaaaaauugguuccaaaaugaggcaauuaugcaugucugggggaaauuuuaaguuccugaacuaugaacuuuccuugaauuagacugcuuaaaauguaaauuucucucuuugacaacucugggugagcuuuuugguucauaauuuaaggaugucucaccuugcguuuuaaaaaaauccaucccuguagucauguguuuucagcugcuagaaagugcuuucauuguuuagcuguuuuccuuuucucuuuuuuguguugcugcuuaugaugcuauaguaccucaaaucguuugugggcugaggauaguacugagaaagaaaaggacaguguuccuacggcagugaccauuccuguugcuccaacuguuguaaaugcugcagcuucuaccacaacccugacuacaacuacugcuggcacugucuccuccacaacagaggucagggagagacgcagguguguaaaggucauaacaguacugcugauauaucuugcccagugaugaaaguuguuuuuuguuuuaaaaaagaucuugugagguugauggccaucucuccaguagacuaauaaaugaaauacccugucagcucagaacuauguaaauuuauacaacuagcaauuauuuauauuuaggcuuugcgacucaccucugacagaauuaauguuuuuuuguuuaaagucagugagcaagacaguuguuuucuuaaacauuuuaguuucuaaggugguuuauuucaaaaaaaauuuuuugaugaagaacugaaaacaccacacacuuagggaaaauuagaugcaacaugacaaaaacagguuuuaucauucuucucauuguuuccucccauuauuaagaaauuugaaggauguugaacuguuuuguuccuguugauuuggagaauuucuucucuugguaaggaaagacuucugugcauaaguguaagccaaauaauuuugaguauguugaauacauucauuuaauuuuaucucugauacauagaaagcacuuauucagauuuuuucaaagagucugaauuuauuuugugugcuuaaauauuuuuaaaagauugcucacuucuuucuguugcugccuacuggcauggaaucauagauguacaaaggagcuuacuaacuaucuuuugggauuuccuugcuuuaccgaaggaaacugagacccagagauaauaugugacuauuuuacuuuuguaugcuuuauuggugugagggcugaggcuagccccaagauugcaggaaaaguaguucaguucuuucugcuauauuaugcauagucccuagcuuuuuuuuuccucuugaaaaaaaauaaaaccuuaggaaaccaaaugugagcuuuauuuuuauauuuuauucuugcaaaauuaaaugaacuauguaacuaauuuuuuuuuuuacuaaaauacugaccagauuaacuuuguuuuauuucugucacguaguacuuacauacagaguucuuuuucucuguugccuacugaagugccuggccuguaguaguaauggccucacaguaauauuuguguuugaauauaugaaaaguaauaaguuaguguuaacuuuuuuuucuaucauugcaucuuuaguuuuugccuauauuuagguuuuguuucuauuucuauggugaaauuuagugguacuuuuauaaugccacugcaagugguuaguauuuugugauuugaguaccaguauaggucauauuauauuuuaauuaucuuccccuuuuuccuauaaacuuaagucaguuuuagguuguuguagugcuucucaguaagaccacagagccaacagaaauuaguauccaucauuuaaucaaacuuaaauaaguuugagggcuuugcuuuuuuugguggugggguugggagggguuauugaaaggaagaaggaucagaaguucuugguuucuuacuccuuacucugccuugauucuuaagguuagaauuaucuuugagucagaaacucuucuguuaaaugagguguuugauuuauauuauuuuuaacuucuagaaucuuuucuaucucuagcauagagauucagugcuuuugaaaauuucuccagugacaaaaccuaauaaaugucuccccagaaucaucaguuguuucagaacaaauuaugauucuuaacccacagauuguuuauucugcuaaagagaauugaguuuugacuuuuagaauuaguccuaauuaguuuuaauggaagacauugaagauugaaaauuaaacgcuuggauauauuuuuaaacaaacagauucuaauugcauaagaaaaaaauguggcaacauuuuuucucgucuauauuauagagguuuuuuguuugucuuaaccuuguuucaaugauguuugcagugauauuguuuguguuuuguuccaugugaaauaauuguuugcaaucuugaauacauuguuggccucuucucuuugucuuuuauuuaaauuucgucagugguucugaaauguauaugauuuaaaauuugccuaaaaaauguauauauguugauuugagaauauacuguggcuaaaacaaaaaaagucaacacagguauacccuuuggguugcucagaaaaugguaagcaucuaaggaauaaaauuauauacccuauauaguucuaagaaagagaugcaguaggucagugugauacagcaaugauaaaggcaacuaugggguuugguggguauauucuaccaucuuuuaaugaucagcucuuugcaauuaaaaguacauaaaauauauaaauuauuuuucuucucuaugucguauucuuagaggucuccucuagauagguaccccaaaggaggagaaaggaacugaauauuaggugguaauuaucaaauaaaggaaauguguuuauauuacaaauugauaagcuauauuuuuaugcuaauuugggaugaaugucauauggaaaauuaaaauuaucugcaggugcagauuuuauguauuucaguuaguaacuuuuaucccccuaaccuucauaugugaaaccagguaugauagauuuauugacuuucauggcaauuugaaacuauugaaaaggaauccaggcucauagggagagaguguagugguugauaguacuauuugccaugguacuaaaaaagagccaagugucaaugcaaguuucucuguuauacacuaaauaugaaacauuucacuguagucaaauuugacaguaguucacguucauauuuaguuucagagcagcucaugaaaugcuaaagugauagcaugcacccuaucugucuugcuaugaacuuuuuuuuuccaagacaggaucucugucacccaggcuguagugugguggugugaugauagcuucugcagccaugaccuccugggcucaagcgauccucucaccucagccuccugaguagcuaggacuacaggugugccaucacacccagcuaauuuuuuaaauuuuuguagagauggagucuugcuauguugccuaggcuggucucaaacuccuggccacaagcagucuucccaccuugaccucccagcgugcuggaauacaggcaugagcaacuguacccagccugcuauaagcuuuguuuaaccagauuaacgaucacauuuagguuucaucuccuuuuauuuuuucuucucuuccuuugguagaaguccaaaaaguaauaacuugcauagggccaguagguacauaaauuaaaugaaugaauggaaaaaauagccauuggacauuuuccaggcugauguucuuaggagcacuuuucuauauuuacugaauaugccacaaaaugggucagggguggaggauucucuauuuaaauggucuugggaaguacugaguuaagccaaguuaauauagguuauaucucugauuguaucacagaccuuucaauauuuuauugugauuuuccuagagaagguuagaauguauagcauuucccuaauuuaugcaaucauuuucuauaacaagccccucuuauaucccagaauuaauguuucuuaaauuuuaauaacaagauuauuaguuauucucuuauuccuuuugaauuacuugucccaggaaacucacuauaauaauuauaaaaacauaguaucuguuauaucuaaauaaaauuaaagucaaaguauaauagugauggaauuuucaucuuaauauaaguauguuggaugucccauucaaguaaaacucccucuuguaaauuucuugacuuagcuacaaauguaauuauguggaaacagcaagaagaaccaguuuucugaacuaauuuuaagcaauaaguaagaguuaauugaugaaauugaggcaacuaagaucuugcgugagaaauuaccuggucaucuuaggguuaauugucuaaggaggugaaugcuaagaauagugucauauauucuaguuuuagagaaacagauuccaaaaauuucaggguuguagaaagaaauaugauuuccuuauauauauaaaaagaaugagggcucucuaaaaggaguuuugaaaaaaugguagaugauucuaaggauguuugaagauacgcuauacucgcugaacugagagcuuuaaaggacacagagaaaaggcauaaaacugacaguaaauucagagguuuguuaugauuguaugaauaguguuaggcuaaaaaaaugaauuacaaauugagaagaauguuaaagcuaacaaaagaaagaggcuuuuuuuuuuuuuuuuuuuuuuuuuuuuuuuuuuuuuuuugagacagaguuuugcucuaguugcccaggcuggagugcaauggcgcaaucucagcucacugcaaucuccaccucccagguucaagcaguucuccugccucagccuccugaguagcuaggauuacaggcaugcgccaccacgcccggcuaauuuuguauuuuuaauagagaugggguuucuccauguuggucaggcuggucucaaacuccugaccucaggugauccgccugccucggccucccaaacuacugggauuacaggcaugagccaccgcgcccagccaagaaagagccuuuuuuaaaaguagcauuugagcugggcacaguggcucaugccuguaaucccagcacuuugggaggcugaggugggcggaucacgaggucagaagaucaagaccauccuggcuaacagggugaaaccccgucucuacuaaaaauacaaaaaauuagccaggcgugguggcagacgccuguagucucaacuacucgggaggcugaggcaggagaauggugugaacccaggaggcaaagcuugcagugagccaagaucgcgccacugcacucuagccugggcgacagagcgagacuccguuucaaaaaaaaaaaaaaaaaaguagcauuugaauaaagaaaacucacuagaucauugccugggguuuugagagggagauacauggaguaaacuuaauaaauuuaaacagcauagaagauagagauacaguugacccuugaacaaugcaaggguuaggggugcugacucccugugcagucaaaaauuugcguaaaacuuuugagucccccuaaucuaaauuaauagccuaccauugacugccagccuuaccaauaacauaagcaguugauuagcacauauauuguauguuacauauauuauguacuguauucuuacuauaaagcuagcuagagaaaagaauguuauuaagauaaucauaaggaagaaaauuguauuuacuacucauuaaguggaagugggccaucauaaaggucagaauucucuucgucuucacacugaggaggaagaggagggauuggucuugcuaucucagaggugguggagguggaaggaggcagaagaggcaggcacacuugguguaacuuucauauaaguggaccugcacaguucaaacuuguguuguucagcagucaacuguacucugguucuauaaguguucucugagaaaugugagcuaggugguguaauuugaugaagcguuaaugauugaacuucccaagaaauauugauuaucagaggaaagucuuuauguuguguugcagggcucugucauaucuuugcuuguuugacucuuuaauuauuuaacuuuuuuuuuugagucucaauucugucacccacgcugcggggugguacaaucucagcucacugcagccuugaucuccaggcucaggugauccucucaucucagccucccgaguaacugggaguacaggcaugugccacaugccuggcuaauuuuucuauuuuuuuguagcgacagguuuccucauguuucccaggcugggcucgaauuccugggcucaagcaaucagccugcuucagccuuccaaugugcuggaauuacaggcaugacccaccacacccagcccuacuuaacuuuugacacagauuacuugcuauugaaaaggugcauaccccgugacaagaggaaacauaggcuuaaauuuauaagaagaaauuuagugaggauaaaugccaaguccuguucuuuauaucagaaaaucaguuacuuagaaguaacaugcugauuuaaaagcuguuuauauauaaaaaaacacuggaauuuuuuagagcacucaaaaguaugaacaauaauauguugucugacgugucauuaguaagagcacacugacaagaaugcagggagaccgggcgcgguggcccacgccuuuaaucccaacacccucugaggucgagacaggcagaucacuugaggucaggaguucgagaccagccuggccaacauggaugaaaccccaucuccacuaaaaauaaaaaaauuagucgggcguggugguaugugcagguagucccagcuacucaggaggcugaggugagagaaucacuugaacccgggaggcagagguuacagugagcugagaucgcgccacugcacuccagccugggcgacagagcgagacuuugucucaaaaaaaaacaaaacaaacaaaaaaaagauuuagaaaggaauuugauaccugucuuccaauauuugaaaauacuguagguagagaauaauuuaaaaccccuuuuaguaggucauuaaguaagaugcuuagauuaucacuuuugggggauguuuucagggcuggagaagaggaccuuccucaguuaaaaacagacaaaaaauuuacuccuuauccauucugcuuaauugggcuaaaugaaauccuucuauuuuuuucaauagagcuaaaauuuuuaaucuucaguucucuaaauccuuuuuaaaaaugugguuccaucuuaaaauuaaauuacauuauuuuaaaaaauguaguuaggaaguuaaaaugugauguuaaaauauaauuauuaaaauauaacuaguuccaaucuaaaaagaaauuauaagauugcauuauugaauuucaaagaccauuuucugaagacuuuuccuuaaaacuuacuaagauauuaaaccuguauguuuuauucauaugcauugauagauauuuacauucacagguauuguauuuacaacuaacgauuuuucaauuuacuacuguagaucauaccucacuccuguuagggaugaagagucugaaucccaaagaaaagcaagaucuagacaagcaagacaaucuagaagaucaacacagguauaguuaauguaauuaauauauaaaacuuacauaaguagcauauaaaauauauauacacacacugacauaaaacaaguuaccuuucucuuuuucacuuuguugugaaaauauugaugucaguauauagugugaguaaauccuuaaaagguaaagguugcuguaguuauucuaguaauucuagugugaauaaauccuuaaaagguaaagguugcucauagccuuuuguaugguuacacugcuacuauuguauuucaucuaauuagcauaugccuuugugucuuuuugaguauuuuuuaaauccuuauuccuaauacagugucuggcccagaguauuugguuagaauaaauuaaucauaugaugucuaauaaguauuuaaaaguucuaugaauauuuggaaaucgggggcagagaauaggcucguauauuagguauaaacaacuaauaugcaaguaugaagaaaaugucauucaggcuggcgaucuccuuaccuccguuuugccauucugauuaugcuguauaugauguauacuuuugugucuuucugcuuucccacaguuaagaagcuccacaguccagauucagcugucuauccuuaccauuacuuagcuuucaagcugaacuauuugcuagggccuuaauauacuuuuucugucuuuauacuuuucacuucuugaaaucuaaccuguucuucaaggucaaaucuugaaaaauuuaucgaaaucucuuuuaagccuuaacaaucaucaugcauguguauauagauacauauacacacauauauauacacacacacagacauauauauaaacauaaauauuuauaauauacaaacaguacagauacuggcuauucuucucuaguuugaacuuguggggaacauuuauaugcauagaguauccaguaccuaucguugugcuugcuaauggugauucuucauagaaugaauguaacuugcuguuuccauuugcaaaccaauuuuaaacaugcauauuugacuuuuaaugcauuuguauguaauauaucuauuucuaaaauauuccuugaaacaagcuuuaaugcaucucauaauuauauugaucuuuuugugugugcagggagugacauuaacugaucuucaagaagcugagaaaacaauaggaagaagucguucuacccgaaccagagaacaagaaaaugaagaaaaagaaaaagaggaaaaagagaaacaagauaaagagaaacaagaagaaaagaaggagucagaaacaucuagagaagaugaauauaaacaaaaguacuccagaacguaugaugagguaacaguauaucaaaagcacauuuaagucaaaugguaugaauaguccuuaugauccuuaacauacaagagauuuauauaccaacaaaccauaugcaaaauacuguaaaggauuuuagcuggaaauuugaauuacuuuggcgugauuaguauacuacuuuuucuuugaaaugaauuuuuaaguauuuuuauguuuuuaauuguguuuaauguuucaaauggguuuugaucuuaauguuucacagacuuaccagcguuauaggccaguaucaacuucaaguucaaccacuccauccucuucacuuucuacuaugagcaguucacuguaugcuucaagucaacuaaacaggccaaauagucuuguaggcauaacuucugcuuacuccagaggaauaacaaaagaaaaugaaagagguaagaauaccaaauuuugaaaacacuuugcuuucuucauauaauccuuuggauuaggguuuccuaaauaauaauucaacaguaaaggaacagcauccuaacuugugauucaucgaaccuaaacagaaagaauaugaagguugagaaugagaaaaguagaaaacagaaauagaauauggccugcuguugauacuaauauuuuuauaaccuaauacuucacaaaaaucuucauguccaccuacaacgaaaaguuaauaucgaacuggugggugacuauuucuagaagcaguuuacuaguguaguacuucucagaugcuuuaagcuauuucuugccuacuguguagaucauaucauuuaaauguuuuuuugugaaauuguuguaaacuaaaauuacuaacuacauguaaugcucucacuaaaacacauuuuuaugcuuauuucuuaaaaaauacauuucuuucucaacuauauauuggcauauugauacucauuaccauuuccuauuauuuuauauaaacuuucuauuuaaauucugaguaauuccuacuuuaaaucagauauaaguacuaaauauaggcauuucauauuuuaaagccuaaaucuuacaguauuagucaugauaauaucaguaguaauguagaauaaacagcagaaaauaaaguuuuuucccaauuuccagcuauauauuuucucauguugaucauugagauguuucaguucuuuaaacuucuaugugugaggccugcauuguguuuguaaaaauguugaaccaacauuuaaaauuagagauacucacuucaaacuucagauuuuugccauuucuugaaaaguuggcugaccuggcaacacuggaucugaauucucacauaccaacaauuggcuggagcuaaguaguagcagcugccuaccuuccaucccccuagauaguccccuggcccauuuuacccauuguuuuuacaauuaccuugcaaaauauugucaagauauauugcuauauugugguucauugcaauccuuaacagagggagaaaaaagagaagaggagaaagaaggagaagauaaaucacaaccuaaaucaaucagagaacgacgacgaccaagagagaaaagaagaucuacaggaguuucauuuuggacacaagaugugagaaccuauuaaaauacauuauuugauaguauucuugauaguauucuuaauguguccaaaaauacauacuaauaauuucuuauaugccuuagauuucauauuccuuaaaucaucacuguguuuucugaguuguuaaauaagaaaaauuauuuuuaaggauaguuaacuacuuagauuguugguacuacuuaaaaggagugguucugaccuaauuauggaauagaaauaauaaugucugaagcucagagugcauguauugauuauuuuauaauagguaaacugcuucuuguaaaaacaucuuuuaagaauuucuaaggagucuauuuaauuucauuuucauaaauaucauuauaagaucuacauuacagauuacuuccaucucaaagcaugcuaaauagacacagugcuuugcuuaucaaauuacaacagucuuguaaaaauuaguguuuuccugguccuugauuguaggccugacauugcuauucauugauuuuguuuccauuuucuaaaaaauaaaccuuuuauugaaguauggcauguuuagaaacauaauucauacauguauagcuuaauggauuagcacaauaggagcauaucuauguaaucaccacucagaaugaugaauaaaaacagcaguguagauugcccccauguucucccucucaaucccuaucauccucauuuucaaagucagcuaguauccugauuucuaacaccguaguuaacuaugccuguuuuugaagagcauaugacuagaacuauaaauuuuauaacuguuauguuuauaagauauaucuaugcuauuuuauguagcaguacauuuacuucuauuguuauaaaaauauuuuuuaaagaaaauuucuaacuauucuuucacugaaagaacauggaaucaucugucuuccuguuaaacugacccaucucucacuauauguuccucuuuaucucuaauauuauaucugaccuuaaauucugcuuuuuugaaaagcuuccuuuugauuaucuuuguauaauauaucuuuucuguuauuuucaauuuauuuguguuuuuuuuaauaaacaacauauuuaggucaacuuuuuucugaacuuuuuuuuaauugcaguguuucaguccauuuuaauuuuacuuaauuacuaauuacuuaauuacaugaaacaaauaacauugucauuugcaguuuaaaauauauaaagagcuaaggcauaugaaaacaauagcacaaaaauaugggaaaguauuaaauggaguugaagaguuuuaguaucuucgcauuguccaugcuguggacaaaauauauauucaacuugaugaaucaagagugcauaugucuauuuaaaaaaguuuaaaaagagagggaaaaucauacauaaaugacaaagaagggaagaacagauggggaaaucggaaaauaguuuucuauuuuucuuuugauuuuuaauauagaaaaguuaaacauauacuuuauagaaguaacauaauaguauaaugagcccuacccccaguauucauuuuuucagcuaaauucccacuccaucucccaacucccauauuauuuagaagaaaauccuagacaucucauucuaucuacaaaugucucaauguauauucugagagagaaggacucccaaaaauaauuuuaaaaaauaaauuuugaaauuauuacuaaaauuuccuaaaauauaaauuggcaaucuguuuuuagagugaugaaaaugaacaagaacaacaaucagacacagaagagggauccaauaagaaagaaacucagguaaauaccauuacuuuuuguauugagaaguauucauauuuuuuaauaauuacuuuuaaauugcguuuuauuauguuuauucaugcaaagcaguuauugcauacucuaccuacaugcuggguaugcaauaucaguguuugccuggggaucaggauuaaaaggacugggaagggucacaaaauaauguuuuggaggugaugaaaauguucugagucuugauccuagcagugguuuuauggauauacagaacugccaaaacucaccaaauuguacacucuaaguggauguaauuuaauguaugucauuuaaccuucggaguuaaaagaaaaagcaaaaaaagaaauaguacccuuggccaaaggaaaauaucuaaaggauaaucagaaguaguggaaauccagaaguaguaggcucagauuuuauuucuguagauuuuauuucaaaguuauguucuggagaauauaggcaucuuuuaacuuucuuuuacauauauuuagaaauuuagagucuccaacagauuuuuauguugagaaucuaaaagacauuuuuuuccucucaguacugaugaaggaccuaaagcaaguuugaaugacaaggcugcacagccagcaaggguugaaaguucccccgacccccuuccugauuguuuggcuguguagaaagcuaaaaaauauucaaaauauuucuguucauaugaggauagagcugaacaacacgagucuaaaccuggcacugucuagcaugaaauagcauucuggucauauuaauauuauuuucuucauuuugaguugaaguuccuuaauagagcuauuacauuucuuuuuagucagcaaggaucuacaguaaugugaacaaaaguugguuaccugugcuaggugacggugaacauuauuuuagggccaaguuugccuauuuugaccccacaauuuuauuuuaucuuuagguggccagacaaugaggagugaauugguucugagguuaaauuauuugcaggccuaaagcuuuaacuguuaccuaaauuuuuugguuaucaguuaucagaacuccccaauuuaccuaugucccuucuuuauuaaacaagaggggaggaaauuaguaaaccauccccaucugacaccucucauugccuuaucacgcagacuccagcccccaccaggcuggaguggaagggagauugucuggcuuuuaaaguuguaauuuugaagcauauugauguauacuguauuuuaaguuuuacuguuaaaaucauaugagauacguuaagaugaagaggaacauuguuucuaagacgaaaaguuuuuuuauuuucaauuuaaguaguuuuuguuuacuuuagauuguuuagaguucuuuuaaaguaaugaauaacauauaaauaaauauaacaaauauaaauaacaauaugaaaccuaagucaaacuggauuaaacaaagaaaauguauuguacuccaguuauauucugcaguccuuugugucagcuucauccucaggcugauguaccucauagggauaggauuauaguuggcuuaggauagacagggccuaucacugaacuguugcagccauuuugcuaccaacaugggccaugugucaucucaccuaaaccuaguaacugcuauaccaugagaaaaaggaagaauggauguagauaaauaaauaaggugcaauguaugugcauagaucaauauuuucuauauucacauagauauuauguguccagaaaagguugguuagauaacagugguuaucuagagaauggagggaugaggaauuacacaggaacuuuguauaccauuaugugaacuuuacaauaccauagucagaaagauauuucugaauaucuuucuauauauuuuaaucuuuuuuaucuuuaaaaagauauuuuuacuuuggaaaauuaaucuuaaaauuuggggaacaagggcguuaugcuaaaugaaauaagcaaguuacaaaaagacaagaacugugugauuccacuuauuuuauuuggguaucauagaaacagaaaguagaaccuuuguugccagagcuaggaagaggaggacaaaggaaguuguucauuggauauagaguuuuauuuuugcaagaugaaaaaguucuagcgaucuuuugcacaacaauaugaauauaauuaaaaauacugaacuauauacucuaaaaaaugguuuacaugguaaauuuuauauuacgugguuuuuaccacaauucuuaaaaguuuuuaaauaaugcuaggccgggcaugguggcucacaccuauaagcccaacacucugggaggcugaggugggaggacugcuugagcccaggaguucaagaccaaccugggcaacauagggagacacugucuccacaguaaauuuaagaaauuagucggaugugauggugcaugccuguagucccagcuaacuaggaggcugaggcagaaggaucaguugggccaggaggucgaggcuguagugagcugugaucauaucacugcacuccagccugggaaacagagcgacaccucaucucaaaaauaguaauaauaaucagugauaacaccaugauuuuuaaagauaauggaauuugagugauuucucacuagacuuuuuauuguuaaaauuuaaaucagugaauguaagugcagacuauaagguaagauguauuauuuuuguuugauauguagacauuuuaguucaggaauggccauuuuacugaauuugauuaucuugaaaauugaaauuuauucuuuaaaauuguuaguuguuguuaaaccaaagaauaaaucaauaaaagaaaacauuaccuuaaaaaacaauguaaggagcaaaguuaaaauugguuuugcagaggaaauuuacagacuuuaguaaaacauuuuuaguccaaaauagacuuuaaacaaucccaaaaguaaccuaguaauuuuacaguaucuccaaagauaaauauaaugggaaaucacuaauauuuaaauuaagaaguuuaacaaaccauucugaauaaauuauagaaucagugaguauuucaauagaaaaagaaaaggcuaaauuugacuacugaaaaagacuacuuuggcccccaguaagacuguuuuaccuuauuaaucauuucacgauuuagauaagacuuucuggaacuucaguguagcauaccacuugcuugagaaaauuaaauuuccugucaccuaauugcugaccuuaaagguauauagcuagauuucgagaaaguaaauuuuaaacaaaauauguauauacuguuaugcauaaagaaccuuagguguucauucguuugcuucuauugauacuacauuaaauuuacuuauaaucauagguuaauaguuuaaugaaagcauaaaaauuuaguaugccuauguuuuucucuuucuuuccagacggauuccauuucuagguauguuuuauuuauuuuuuaacugacauuuuuuucuuauuuuuaucuuuguuaaaaauguguugcuaggaauuuauggauuuuguaaguuuauagaauuauuugauaauaaaaaacaaauuuugauggccuuaucauuguuacuagcuuucuuuguuaaaggcuuuacuucaagaucacuagucagagcaaguaagauuuuuccccaaaucucuacaacaaagguauuccaaaguuucuuaaguuaguucaacuaucucauuauuaacaucagggacugauaaaacccacacuuggccagaaauguauuugauuaaguauucagaaucuucucuuguagcccugcuuuagacaaaagagaaccagugaagacacuuuuaaaaaagugucaucuagcucaacccuuaauccuagcacuuggggaggcugaggcaggagcaucacuugaguccaggaguugaagaccagcauggacaacaucaagacuccaucucuaccaaaaaaaaaaaaaauuucuuaauuauccaggcauaacuguaugcuccucuauuucuagcugcuggggaggcugagucagaaggaucacuugagcucccaggagcucaagguuauagugagcuaugguugugccacugcacuccucacuggauacagugagacccugugucuuuaaaaaaaaaaaaaaaaagugucaccuaauucaaaauuauccaucuuuucagagaaccuccacuauauccuugauuuugaucuccauuccauuucucuuaucauuguuaaccacagcccuguaagaccaguaauaaauuucugucuacugaugauucuauugaauugaaaugcagagccaauggcaucuuucagaaaagguaaccugaauuucagaaccagauaauaagagaauucuccuuuaccaguaagauauguuuuuccugcuuaggacaaacccauuacuugucacuuuggauauacuuuauuucaucaaaucuaagacauuacucauuuuaaaacaccauuguguuaccuacuacugaaaaaaaggaaaggugcuaccaauuaaacuauaaugcaucaucaauuguaagccauuuucugguuuuggaaauauuaaaaugugggaggaaguguacaauuuaaaauauuaaucauuauaugaaaccaguuuuggcuuuuaaacauggaaauuuugacucucuuccucaauuaauggaaauuaguaguauuaaaaaaauaggcugggugcaguggcucauuccuguagucucccagcacuuugggaggcugaggcaugugaauugcuugagcccaggaguucaagaccagccugggcaacauggugaaaccccaucccuaccaaaaguacagaauuaggcaugguggcauaugccuguagucccagcaacccaggaggcugagguagaagaaucacuugagcccgagaagucgagucugcagugaccugagaucaugccacugcacuccaagcugggcagcagagugagacccuaucuaaaaaaauaaaauaacuucccacuuauuauauaucacaaaaauuaaucagauaacagagggagacugugaccuacucuuuugaacugucaaguuauauguguacuaggauguauguuguuauaauuguaaaagccuauaacaagguuuuuuauuuaaauuaaucuuuugaagauaugaaaccaguucuacaucagcuggugaucgauaugauuccuugcugggucgcucuggaucauacaguuacuuagaagaaagaaaaccuuacagcagcaggcuagaaaaggaugacucaacugacuuuaaaaagguacuuggguuauuuaguuauauuuaauaaaaaguuaucuuuuauguugagauacucauucaaauauuauuuuaaaaacucauaaugaaaugaguauuuugaaauaacuuauuuucaguuuucggcaagugaugguuaaguagaauguaaauagcuguuuguuuauuaaagggaagagaaagucauccaagaugauuuuacauuuaaguaucucaagucauugcuaugauugagcuggaaaggagcguucaauaaaugggugcacacaaauguauacacacuuuguuucuuguuacuaggaagcagccaaacagagaagauggcuuuuccuaagauaauauauugguaguuuuucauagguaacugaaaaacuuggggcagcucaagugcuauuaaggauugaaguaauuaaugaauaaaucgcagaaacuauaucuucuuauuuugugcuuauaguaaacauaaagucuguuggagaaggagaaagcuuauggcauuuguacauguccccaguuaucuggcagcuauuugaauuacauacuuuuuuaaaagccaaguuaggggaacgggugagggagagaaucauuuuacauuaugaguaagauucaucauuuauucaauaaagaacugaacuaugcuaaguagagagauucuacucauggguaaauggagaugaagauacuaucuugcucuugugggcauuuuccauguaguggagagagaccuuauuacacagucauacuaaugacuguauaauaaauaauggagacaguuaacuugaaguagaaaagcaauuuuauaaaaguauauaacaaaagaaaguagauugauuuccuuggcugggugcaguggcucacgccuguaaucccagcacuuugggaggcuguggcaggccaucaccugaggucgggaguucgagaccagccugaccaacaugaagaaaccucgucucuaccaaaaauacaaaauuaccccaggugugguggcgcaugccuauaaucccagcuacucgggaggcugaggcaggagaaucacaugaacccaggaggcagagguugcagugagcugagaacacgccauugcacuccagccugggcaacaagaggaaaacuguuaucucaaaaaaaaagaaaguggauugauuuccaaaggaagugugguuucagccaaaaacggaaggauuacuaauaguuaacgggcaaaaaugggugagaaaauuauuccaaauagaguggaauuacaagcacauagaccugguggggggagaauacaugaugcauuggaauaaauaaauuuuaauuauagcuaguagaguggaagaaauauucauuugaggcagcaguuguauaggcugagaccagaucaugcagugccuuauaggccauuguaagauuuuucguaugcuaagaacacugggaagccauucaagaguuuuuaauuuguggguggaaauggaaugguuggccuaugaaaauuaugagauuuucauuuugaaaaguuaauuuuagcuccuauauauaaaacagauuagagggugaucagggaauuagaauaguuuagauaagagaugaucauagccagaauuaugguggaaguaguaaagcagggauaaggaagaaggaguguuaagaaagacgaaaagcauuagaaaaggggaaggucuuggauuuuauccuggauuugaaauauuucaggaaauacgucauuugccuuuuaacuuuacuauaagcaauguagaaguauaaugauaaauacagcugguacuccgucucauuuuugggaaugcaagagagagugaugggcagaaaaucucacggacuccaaauaaagaucacagugacuccuuagcccuagcugcaguugcugugcagguauguggucccucuuuaucagauaacugaaucuuuuuuaagauaaccugaaaaguccaauuuuucugugaagucuugauuuuugaauacuggaacuaauuuuaagacuuuauaugggacaaacacacuugcauaacgaacagucucugcuuugcaaccaugaaggauuuuuuaaauguauccuuuauagcucauaugcuacauuaagcuguuuuaauauugcaaaguaaucaaugagaaauuuuaaaguaauaggagagcagaaaaguaauuuguucuuuuacccuaauuuuuauagcuuuaugaacaaauucuagcugaaaaugaaaagcugaaggcacagcuacaugauacaaauauggaacuaacagaucuuaaauuacaguuggaaaaggccacccagguuuguacccuuuucuuuuuguuacucucaagguaaugguugugauuuaucccaucuaaaaaugguauuaaaauuuuuucuaauacucuaaauagaaguuugauaauugguaauagaagauaaugcuguuuauggaugauuuacuuuuucuggaguaaauuuaaaaaauagucauagucaaaagucaacuuauaaaaagccuuuuaauaccaauguugugguaugucaagguuuuaaauguuuauuuccagaauaccaaauguagcaagucauuaaaacauuaaaagcaucuauacagaaucaucuuauagccauauaaaaaauuuuauaauaguuuuuguuuacuacaaauauuuuauguuuguucaaguaaagguuauuuuauauuauagugcuggaagaagauaauuuuaaucauaacuccuuuuguaaguuccuucuaugcagcagucuagagaagauaaauuuggacaauaaaauugggauggccaagcaaaacucacaaccuuguacauaugaucuagcaauuguuucccaagccacuuuuccauuuccauggaacauuaguucugggagacaggaauagguacaucuucuccucauuucccuccuuucaaaaaacaaaaaaaaagcuuugugaucaaagaaacuagggaaauacuacauauuuuacauguuaaagacuuuacagggucuauuuauaugcuaaaggcucuaaggcauccuguaauuuuuaagaaaacaaauguguucaauuuuaaccugggacuuucuagcauaaacguauuucugcagcacaacucuuagaauccagcugaaagcauggaucuaaaaacagcauauccagaucugugaaugggacuauguacuuuuuuuggucagucuuuacacucaucuuuuucuuaauuuuuaaaaauuaauucuaaaaaaacaacaacaaaacaaaaaccaaaaaaguucauucuguuuguugaacuuaaacuuguuaccagauccuuuuuuuaaccauuguuguguuguaaagcgauugucugugcacgguagcuacuaugccaaacuucuaggguucaggcuaaccucaccacuccucaaauuccuucauguuaauggagguuuuuguaaagauaaacagaaaaguaaaacagaacaagaauagguuucauagugagaugucauaaaaacuuacagugucauacacauuaaaacuacuacuuauauuuaggcuucaugguaaacuggaauguuuagcagaaaaguuaacaguaaaaauaccuaaacugauguugcuguuuuuuaaucagugaacuugucaucauccuucagguugcauuaguaucuuagugagccuguauacauaaaaauauaaugaguucucugagcauagcuucagcucuagggauuucauuauaauguucuaaguaaagauguccacugcagccaggcgcgguggcucacgccuguaauuccagcacuuugggaguccaaggugggcggaucaccugaggucacgagcucgagaccagccuggccaacauagugaaaccucaucucuacuaaaaauacagaaaaaauagcugggugugguggugggcgccuguagucccagcuacuugggagcugaggcaggagaauugcuugaacccgggagguggagguugcaguaagccaagaucgugccacugcaacuccagccugggugacagagcaagacuccaucucaaauaaauaaauaaauaaauauccacugcucccuacuauaguguucugucauggugacucagcucaucugugucuccgcuacuuaaugccuucucuguguucugcucugcugccuacuucauugucauguaauucuuccuguaugucucucagucaaacccugcaagagaggggaauugauagaauuagccuguuacuacccaguauggagcagccuguuuuguuagugaccauuucauaggucacuggacagaaaguugccugugggucagguaccaauuucuguuaccuggcaagagaaguaggauuaaaaaauaucccagcuucugccuuggcagguacucugaguaucgcauccaguaugcugaguuaauaaugagaaguauaauucauaaaaguaaaacugauaagcauuaaaguaacuuuaaucagggguucaacuuucagguauuuauccugaaucuacugugaacuuuuccaccuuuuuuuuuuggcauugauugacuucauaacuauucacaaauacacaaauauuugcgucagauauuugccacaaauagcaguggcaguuuugauaguugcaugaaauuaaucuugaaguuuaggucuguuugauacuauuuagccaagagacucuggaauccuugacucuugcccuagcccagguacccuccuucccauaucaucuccaaggaagggaaaaaauaugccagcuuaccagaaccaguuugcugaauaccacuuugccaaaugaccauuucaccagauuuaaccauugugauuuuaacagcuuuaacuggaauguuuaacaagaaaguuaacuaaguaaaaauacuaucuaaacugauguuaauguuuucuaaucaaugaaauuggcaaaccacauauaauugcuaaaaucuucccauaugaaaaaaucuccagugaaaugcuauuuuuccauguuuuguuaauuuacauguguuguuauuauuuuggcuauuugauuuuuuucaggugcuuuugaauguuauuuaaaauuuuuuuggucuuguaaagaguuucuaugauuuauuuuuaaauccucacgugguguaucagccuuuguuuuauauuucuagcaauuaaauguuuaaauucaaaaccaaaaauaaaugagaauuaacuaagcagucuuauucauauuugaauuauuauuuuuuuuaauggauacagcaucucgcugugucacucaagcuggagugcagugguacagucagggcucacugcagccucaauaucccuggcucaagcaaucaucccaccuuagccucccagguaguuaggacuacaggcaaugccaccacaccuguuuaauuuuccuuuuuuuuuuuuuuuuuugguagagacgggguuucaccguguugcccaggcuggucuugaacuccugggcucaagugaucugcccaucucagccucacaaaguguuagaauuacagguguaagccacuacacccagccucauauuugaaauucugaacugaauuucucacaagaaccaauuggaauauugacuuuuauguuuccagaaagaguaagcacaaaagcuugaagccauuuuaaaauaagagaaaaaguaagaaaaccuagccaugauuaguucuuuaaauguuacacaccauaaccguaaaaauugugaaagagggaucaaaaagugacuugguuauaaguccuagagauacuaaaacaugaauacugaaaggguuggcauaaaagaaaauuauguaaagaaauauuuuuaaaauuaccacauuuaacagugaaauuguguuuaaucaauauguuuuuaaagcauauuuugugguuagcacucauaaagcauucuuguuaaaguggucaaaaaccauuuuugguaaauuaguaaaauugguuauucagcaaguuggcuuuugaggaauucauuuucagcaaauugaccaggaauuccaagggagauguuuguacagagaucaauguaaauaaaaucuaagaugccacuguuuuuuucuuuuuuuuucuuuuuuuguuuuguucuuaaacugugccugugcuuaauguccagagcucuccaguacaggauacaacagguaggcuaaaacccaaggugcuuuuccaucccuuaaagccaagcuuauauaucaggauuucaucagcuuugagcuggucagauaguacaggaaguggaaaaaaugaaaggccugagcucaccagcagaagaaagcuguacagcuagaauuucuuauaagugaaaguggaugugaaccaauuguggagcauggaugauuggaaaagaaaccuagagugugagccaagaccaagauagcugugggagaagauaaaaaggccaguuuacuggucuggcugcauggauacagagucauucaaccugcugaugaauauauuucaaucaagguccuggaaucugaccauucugauuagccacuccugaugguguaggaaaggaaagaauuugagcuucagaaggaaagcuacaguuuuuuuuuguuuuucuuccacauacucacucacccucacgcccaacuaaacuaugaaaguuccuggggaaaagugauagagaacauaaaaugagagcucugguuaccauucuauuucuaaacauucauugcacucuuuauuauuuuaauacaaauccuguuuucucuuugcuuuacucacgaaccuguguuuuacuccacuugaauauugugauuuaauaccuauuaaaagagaauuacuguggucaccccugaacuuuuuugcacuuaucucuuuuauaauuucuuacuuuguugcagagacaagaaagauuugcugauagaucacuguuggaaauggaaaaaaggguaagugucccacuuauuaaauaauuauuuuuuucuuucuuguuuuagguaaacaaugguagguuuuuuguuuuuauuuuguuauuauggaugacaguuuuaauuaguuuaaauauuuauugaguuaauguauuuugcagcaacuucuuuauagaauucuaugggguuucucuagguaugaaaugaccuuguuaaauaaaauuuaauuuaccacauaauucuuuuaaugaauuuaaaaaaacugucuugccuugauucugaaauguacuauacacauuuugauagugaauuugauauuuuugaaaugccguuuaucucuuauggccuguaccuaaaacguuuuaaucauaaauacauuuauuuuaauucuuuauaaaccuaaaauacuuucguucuugaaauaaaguuucuaaaucuggaacaucaaauuuucaaauucuuuuuaaaguuaauuuaauaauuuuuuaaaauuuugaguuuaaauauuuaacuuaaguaggcuauuuuaaacaaaaaaaagauuacaagaaaauccuuaugccacuugaugucuuucugcaaguuuuuauugauuguaauacauucacuuguauuucucuucacuuauuguugcucaaaggucuaggaguagucauaggaauaacuguacaaguuuagccucaucaguugaaaauguauaaaugauccaaaaguuaaaggaaaagugcccaaagauuguuuguaguguagcugagcaguagcuagacuugguaggguuucgaccagagaagaaaugacaugcugguagcuaugaucaaagaguaaauacuuaggagcuauugauauaaaaacauuuuucuuccauucuauuuuaaaauaaccaauuugcccuuuucaccaaaaaaaagagaaaugguuaaaaaaaaagaauauaaaaauaguguuauaaugucugucauuugcuaguuguaccuugcaauagcuaccauuuuauuaugcuuucugcaaguuuuaaaaauuaguguucugagucauguuuucaaaauggacauaauaauugcuaaaauauuguuuuaauaaauuuaauauuauuauauccuguuagaauauuuaacuguuacugaauuuuaucuccaggauaggcagaaauaauaaaaucaguucucuguuauacuaacgguugagaugaaaggcauggauaacaaacuguacuuaaaguaguauuuauuuuucaaauacaaucacaauuuuaaauauuuaauuuuucuuaugaaaguaauauguuuauuacagaaacuuuaacaaaagaagacaauauuaaauuaucuguaaucugucaugcagagauagcugauauuuugauacuuuuuuuuucuaacauacacaugaugcagacacauucauacucugacaagcucaccuaaccuccuuuuucugcuugucaaaugcagauaaauuacaaaguagcuaauccacucucuauaaucaugguauuaauaguaacugcuaacauuuauucaucauucucuguauaucaagcaggcacaaaauuaaacacuuuacaugcauuuucucuaaaccauauuuuuuuuccuuguguuuuuuuuuuguuuguuugucuguuuuuuuaaagagacagaauauugcucugucacccaggcuggaguacaguggcacagucaccgaucacugcauccuccaguuccuggguucaagcaauccuccugcaucagccuccagaauagcuggcacuacaggugcaugucuccacacccaacuauuuuuuuaauuucuuuuuggagacaaggucucacuuuguugccaaggcuggucuugaacucuuggcuuuaugcauccuuucaccuaggccucccaaagugcugggauuacaggcuugagccauugugccuggccaguuauauuuuuuaauguuaauauguuugucaaacauaagaaauuucauaucauuuuacagaugucaauuucauugagcuaauagaaucaggcaguuggguguaguuuucuugucuuacuuuaccacuaauuuaaaaucuugaagacaccuaauaaaauugaggcucauagggagauuaccucucagaagaaauauucuauuucugauauuuugcaaagugguaaagaucaaauaugacacuuuaugugcuaguauuuugagaagugugaugauuuguaugaauuugucaugacuguauuauuuaguagaagaaagaucuauguauugaaaauaauguuucugucuauacaauaauguuuaggcaugccgauguuggaauaacaugguacuuaaaagacgaucaguaggauucugucuacuuuuuaaaaucacauacccuaaaaacauuaacauuuacaguaaauguacugcuugacuaaauaucagcauuauuuauuaaucugggaaagagugucuuggaaauaguuucagugugauuaaacuaaauuuaaaugguuuguaucugaaaggugaccggcaagagucaguaucuucugggcgguaugaccuaaccaguuuuacagcucaucaauuacugcugcuugcuuuuugcauaacaccccagaaugcuuaucauuuaagggagaauaaaacaguacacugcaauaauguguuguguguuggcuuugccugucacucuuugaaacaaguuuaaaauaaacgcugcaguugcuuuucuauuacauucacugcauuaaugcuacacauaaugucaaccuaaauacaaagcuauaaagucaguuggauaaauaauggcuaguacacauugugaguggaggaaaugagcuucucuuacauuccucugaaauugcaaaguacacauauuuuaggcauguuugcuucuugcuuuucugcuucugucacuguaauaugauugcaucuuugugugaguuuuguuuuucuucucuguacagucuucagucuugaguauugauucacucuaaguuuuacaugaacucaaaaaguaguuugaauauguuauguagcaucuucccagaaagucaaagcuuuaaauuaagagcuuguacucuaaggauaaagaucuucauauuuauuuuugucaaauuuuggaaagcucuuuacauaucacuggcaucacaucuuuucuacacugcuccugauuggaccuuuaauucugaaguaucacuauuucacaguauagaagaagacuuaagaauauaauaauuauauaacuaacauugguaccuuaaaucgaucuaggaacgaagagcucuagaaagaagaauaucugaaauggaagaagagcucaaaguaaguaaacuauguuacuuaugagagagagugcuguuuauguauuaauguuuaaaauacuauuauagauaugguuuacauuaauuguucucaaagcugauuacccaauuugugaacugucuauaucuggugcuucucuuucuuccugaauccagguuuuagugagccagaagagggucuaaaacccaaaucuuaacaccuaugaaaagaaggagcaaaaauaaaauaaaaaauaaaacccgaauuauuuugauaauuaauuuguguagcacuuuugcuguucagguauagaaaaaguuagacaauaauaauaagauguaggauuuauuauuuauucuuuauguuucuauauacuuucauguuuuuuggcgaguaaguaguggaggggguuacuauaaaauguucuccuuugaaaguaaaggacauuaggggagugaacaggcagagcuguauuuuaucaaacuccauauuaccuauagaaauaauuauguuuugaaugucuucacaaguagcauaguuaauugauuaccucuuaccacacuguccuucauaaaaucuuuaucacauugugaauuaaugaaccagugcauaguaaguauauuguacccacagaauuagaaguucaagauuuagauauuucauuauuaaauuguuugguuuguuauuagaccauuauugaauggcuuugaagauuggagacaaaucuuuuguauuuuguuugcuuauguauuacuuaguuugaaauagaauuuuaggaauacaguguuuaccuuucugaaucucuuguuccuuuaagacguaauauuuuuaaaaaauuaccugugauuacauucuuauuauacucuuuuccauuuucuuauuuuuuauuccuauuucuuuauguucugauuccugcagaaccugcaccaaauaaagcaaauucaaucucugagggaguuaaaugagcgacugcugacugagaauagggccuugacaagagugguagccaagcgcucaggguucuauaggcaacugcagucugugaaccuauaauuuuuaguuucaucauuucuucuugguagagccaggcagguguuuuuauauuaguaggcguguuuuguaagagcucacuuuuacaaauuaaugccauugugucuggagcauaucauauaacuaauuaugcauggcuucuuagaauguuagaaauugucacuaauuguauauugcaauugaugagcuacauuaaaauuagggaugauuuuggaauuuaaguuaaagacuuaucuguacuuuuguaaagcuuuugcacauuuuuuagcuauacagauauuuuaggacuuaaaauaugacuauuauuuacaguucuuuacuagagagaaaaccaacaguauauaacauuuuacauauaauuaauauauuuugaagcugaagauuaagcaugcauuauguuuuucaaaauaaugucauuugaagucagaaccacauuaguuuauauuuaaguuuauauuacaaauauucaaaugaauaaacuuaauauuacuauauuuuauaucuuaaagauucugaacacagauaagaacauauugguuccacguaaaauuaaaucuucuuaaagauuuugcuuuaccuaguuuugcaaauagaaguuuuacuuuuaucaaguuagauaaacuaauacauuuugaaaacugaggaaagaggacuauuuuggaaaguaugguuuagggaccaaaaauaugagcuauuucauuuccuagugaaacuggcaaagaacauacaguuuuaaucauccuuaguagaguauucaguuaacuuguaauauuuucaccccuucaucaauuugucuguaaaacaacagaaaauugagauguguuguuugaagauaugaggcuauuugcuucaaaauugguuauuuuuguaauaguuggaucauagauacagacuuucuacuuuagcuuaaacaugaugcacuauucuaauaauaguaauugcuuguuaccauuuaauaagcaucuaucugggaucggacauuguuuaggcauuuuaaacugagcuacuguaggugaaucguuuaaggaauuuuaauaauuuagaacaagucuaauuuccucaauguuuuccuagguaguuugacuuucuuguggaacaauauuaaguauuaugauuuuaggucugacauacauaaaagcaaaagucuuugguuuaggugcugacaggaaccucuuuuaagagccuauccuaacaaaaacaggcuugucuuggcugcuggaauguggugugcuugugagucauaaaaucaagugauuuaguaaauuucaauggaaaauuuggagagaauaaaccuuucauuccagcauuuaugaaacuaauuagcuuuacaaauccaggugugguuuuuuuccuucuuccugauacauguuuuagauacuagaaauauauauaacugacaaagcuugaucauguguuuuguggugaaaauauaacauuuauuaagaauaauguuuuaucuuuuaauauugaagguaaaacuugaucuucaauuuuucucuuuauagauguuaccagaccuaaaagcagacaaccagaggcuaaaggaugaaaauggggccuugaucagaguuauaagcaaacuuuccaaauaaaaaaaaaaaaagcagcaaguaauggaauugcacauauuaguaacccaguggaccauaauuggcagucacuggaagucugggaagaauccuuggagacugucauuuucggauauccugccaaaugcccucuuaucuagaauuuuuguuucauuuuguuuaauuuucugggguguuuuuguuguuguugguuuguuuuuuguuuuuuuuuuuuaaucaagaccauuguuucauguuaaugcagcugcugagaagauuuuuuuuuaaugacugagaaaacuuguuuacagcuccagcauauaaggaaaguguucaaggccagauaugccucagauauuuaaccaguaagccuuaguuguacauaaauacuuuugugucaacaaaaacuuucagcucucacagaagacaguuacucaacauuuuuugaugugccacaguuucgaguuuuucgauauuuaaauuuuuuggcuuuucaucuaaguuuggguuuguauuuuuuccuucuaaacucuucauguggcagagucuucuauguuuucacagcuuuuucauuacagaaaagaacacuugcucuucugugauuauugucauguauuaggcuaaugcuguguugucucccaccuggaacugaauugcuugguggaacauaugcuuucacuguuugugcaauaugcauuuauuucuuauaugaaugcuuuaaagucauuugagguuagaucuuuuaauuccuauuuucugcuucauuggucacuuuuuuuuuauuguaguauaagauguuagauucuguaaucuucacauucauuuuagcagguacugagugaugcuguauauacaaauaaguguauuguuuugauuuuuagaccaccacauggcaugcuugacuauuucuuauuucaaaugucugcuaaugcagaguaggcuacuccaugauaguguuaaaaaacaaaauuugcuaacaaugugauauaaagacuuuaaaaguuacacauuauguggagcccuaucuuuacaaaaguuuccuacuguaaagugcuuuuauuuucaguuuucacuugauaguacucaaccauaauuaaaguugcauaagauaauugcuuuacauuucacauaccuauauuuaucugagugcugucuaaaacuguugugcuagccaaaguaaugcuaugaaaucauuugcagaauuaacccgugaguuaauguuaaaugcacuguuauugccaugugaagaggcaucgacuuugauaccaccaucauguucagaccauuuuauacauuucaguggccuuuuuuuuuuuuuaaggaaaaaaaagcgcaaaaccaaguacauagugacgauggcuuuuauuuggacaaauagcuuuuauauuuucauuaaaccaugcaaaaaauacuacaucuuucuggcacauaacugucuccuuaaccacugaacaguucagccauuugaauaaauuguacauuguaaagcuuauaguagcugauuguauuauugauuguauuguauacuauauuaaaugugaauuuguaccccuucauuuuaaaaggucauuguguucuacugccuauuuuagauuacuuugggguuggggaaggguguuuugguaagcaggauuuuaaguccucucucucucgauugguuuuaugaagauauaagguuaugcucuuacuaccaagcucaggauucuugauuuuaaagguacaaggauaguugugggaguuuuauuuuugguuauauuugaacuguaugaaugguaggucugaauauugagaauuuccauggucuuauguggagguaaaauauacagauaacugaucaguuugagugacugcaacauguucugguugcacaacaguuaggcaugcuaugguuuauauuugugaaguuuggaugccugugaagaaugauuaaauacauguuucuaauauuuuaguguuuuguauuuagguuauuuauucuuuguaucuaaaacugaacagcuacugugcuauauugauuuuauugguaguauugagcagaccuuguuucugcaugaaacuaguugcaaaacccacuauuuuggaaauaaaaauguauuuugacauauacaaauaaaaugaauaaaacuauuuuaaaugugugaacuuuuaaugaagacauuuuaaauuuuguucugagauauuuaaauucugcauggguauuuuuucacuaauugcuuuacuuggauaccaauuugaauaauuucugaaauuguaauauugugauaauuugcacagcauuguacaugcacaucuguaaaugcaaucuuaauugccauauuuaugcaaucuguguaccaauuuggacaaauguuuauauauuuuacauaaagcugucuguaugcagaaucugagaacuaguuuuuuuaugauaauaaguggguaaaaauuaauaacagugaguuucaggguaguugcuuuguagcacaagauuucgcuuccauaaacauuguuuuuuuuuuuuuucuuaaaguaaaccugugcuuuuucuuaucugcaaacauaggcuuagcgauacauauaaagguaauauuccauugaaacauacaguuuacuuuaauauuagaucauuuuccaauuuagauuuguccaagguucgaccugcuaacacaucuauaaauaagaggcacuuuuagccaggcaugguugggaggcccaggcgggaggaucaccugaggucagggguuugagaccagccuggccaacagggcgaaaccccguuucuacuaaaaauaaaaaaugagccagguaugauggugcaaucgccuguagucccagcuacucaggaggcugagacaggagaaucacuugaaccagggaggcagagguuguagugagccaagauugugccacugcacuucagccugggcaacagagugagacuccgucucaaaaaaaaaaaaaaaaaaaggcacuuuugauuuuggaacuuugauagaggacugguaguaagccuaaauuaauacuauugacuaaauuaauauugacuaaauuaauacaacaaggauugaauucuauuauuucuauuuccaguacuucaccuauucaugcucagaaugguagguuuuacuguuauuuguccuccauaaaaaaaacaagcauuuuacaugcaaauacuugaaagccaaauaaaagcuacuauagaacucuagaggaguauucauauaaaaaaguaaaguagauauuuucuaauccauuaggcuaacuuuauucuuuugcuuaaaaguauauuacuacuuaaucuucccuggcuaaucugagacagucaugacucccaaucccaacacauuucccauagggcauaauaaauggcuuuguagauuauccuucacuuugacauuauaagcagaacacagagcaaacuccacuaaaaauuauuaacuauucauuagcucuaucuuguuaaugauaaccuuuguuugcaaagacaaaagcuggcugauggagucugcuuugauguuccauguuuacacuguauguguguggucucuguaucugaauaugauauucagcagggauaauguacauaugagaacucuaaaaguauuggguuuagagugaaauauugauuauuuucauauuuuauuaaucucugucuaacugaauccauuucuugacuuugauuuuggaaagguucucuggcguuaauugccauacaaacgagugcucuuucucuuagguaagugauguggagaguauuauauugcuguuccuugccuauaaaauaaccagauuacaaaaguauuaaauauaaaauaaaauuacaggagucagaagugugagacuuauuucuauaauguaacaaauaauggauucuaccuuauuacuguaacuucaaaguuuuauuaaaaguugucuaaagguuauuagaaguaagaucuuuugagccaagcuaucccaacacguccccgcuuaaauuccaguaaaugucugggucucauaaaccaacugcauuuucauuuuuaaaaagcugaaggaaaaggggaaaagugugaagaaaugaaggauauuagcagauucuguccucaaaaauauauaacuaauagaacauguacuuggugguuguaggccuggaagagugacaguggaaaagaagagauuuguuuucuuccccccuuucucacucucaguuuuucuuacaggucuguuucaacagcauaucucauuugauccuuaaagugcuccauuuuacaggugagaaagcugagguuuacggauuauuuguucagcauccaaagccugguacaacacaaaacucuuaaccgauacuuugugguggugguuuuucccaacugaauccaggacuuuuuuuucauauaccaguuaguugcauagauuauuuucauguaauugcguaaguuucuugagucuauauacuuaggcuuaaaauauuugauuaucuuggagaauggcauuucuugauuuuuuuuuuuuuuuuuuuuuuuuuugagacggagucucacucugucgcccaggcuggaguccagugaucucggcucacugcaagcuccgccucccagguucacgccauucuccugccucagccucccgaguagcugggacuacagaugcccaccaccacauccggcuaauuuuuuguauuuuuaguaaagacgggguuucaccguguuagccaggauggccucgauuuccugaccucgugauccgcccgccucagccuccuaaaguguugggauuacaggcgugagcuaccgcgcccggccucuugauuuuuuuuuuuuuucuccucauucucuaaucucacauccucaccccuacaccugcuauauuuuuccuucuuagggcuuacuuaauaccacuuugcccuauaauuuguuuuuguuuuuguuuuagacagaggaaugcuguaaugcucaagcaguuaguugauuuucuggugcaaauucuaaugauggccaguaguccauuaagauuuaacauaccugcaugaaaaauuuccuuugcauucuucaaaaauagauuuuuaaaaauuggugcucagagcuuaauuccuuuuuuauucccuaguaagauaagcaacguuauuagugcuacaguuuuaacagacuuuuccagugaaaaauguguggaauaccaaauauguaaaacauaaaaauugaauuuauagaaacucauagauaugaacuuccccaccucccaaaacaguagccaaaaugggccucuauaaaacaguuuuaugacagcagcuugacuccuucacuuguuacugcacaauucuuagguugugaccacagcauugcuaagcagaugcaucugacuuaaacuuuuauaauauauauacuauacacaugcucuaguaguauacuaguuuaugugagugaguaugcuauuacuuuccucaacagugaaaaacaaauagagguacagaguaggagaagccucacacaaagauaaccuggcaguacaaguuagugcacuaguauucaauauuguccaaauuuugccuauaucuaaacauuauuuuuacaauuucuaaaaauuaaagcauuuuagcaaaauuugaauuuaaauuugguaaaauccauuaaauaacuuugcaaacccuacggggacacugaucuguaaaccuuugacaugguccuuuggauucaaucacaucuagauaauaaaucucagcuucauuugauaaaagucaauuacauauauccaaagcaucuuguuuuaaaaaacauguuauuguuucuucuuaaaauaccuuaaagcaaaauuuuggaauaauuuacuugguuaccauaaacaccuaauuuuuuacucagaccaguaagggagaaagguuuaagagguggauuucagaggacuuccuugucccauuggaaagagcaaaguaaaccucuguaacuaugcugccacaucuguccuaaaggacuccagggacacugaccugcuacucauaugaaucugcuuuguuuaugaacccuaguugcuguuaccagagaaggaaagauagggaaaaguggcaggauguuuauaggcgucauaugcaaaauguguuugccauagaaaagacagguggugugggcuagaaaauguuguaaucaauacuugauaauagcuaauaauuauuaagaaaauauuauaauuuguuggaaugucaggauuaucacuaacuguggauacuuaaaguuuacguaaugcuucucaaaauaucaugaggucaucugggccauuugucagccuucggggucagacuaaccuuguuacauaaugcucuucugcauaagaauguuauaaucugugauuuguccuuuuggcugaagcuuuaguccugcguaucucauucuuucuuugugcuuuacugucccucuagugucuaguauuugcuuuacugagacuaguaguagaaaaaccagaggggaaaggaccuaaauuuuaguauuuucuguguacaaacgccuacacauaucuuguauuuguguuuuuuuaaaaaaaguuguuuccuuuauuuuacuaugagcuccaggaaacaucagaaucucauucaucuuuguucucaacacuuagcacagugccuggcacguaguagguguuuacuaaauguuuuggaggaaagaguaaaucugaauaguugugguauguguuguggaagaaaaaaucucagcuagcaucuagauuuuuaaaaaagcuuuuuaaagcuauuaaauauaaacacucagauucuugcauacuuugucugucauucacaagcuccuguuagcucuuauaugccaagcacugcuguaggugaugggcauacauccaaaagcaaaacaggcaaaaauaaagucccugccuuguggaggcuacuuucaaauagcagaaagacugaaaauaauccauuacauguuaccuuacaugauaauagcuaacuagggaaaaaugggcugggcgugguggcucacgccuguaaucccagcacuuugggaggccaaggcagguggaucacgaggucaagagaugagaccaucuggccaacauggugaaaccccgucucuacuaaaaauacaaaaauuagcugggcaugguggugcgugccuguagucccaucuacucaagaggcugaagcaggagaaucacuugaacccgggaggcagagguugcagugagcugagaucgugcaaaaacuaggccaggaaaagaauucaggagcgaagggagaacuaauuagagaaagccucacugagaauguaguaccugagccaaaacugcaagaaacguuggaca

SEQ ID NO: 16389 - RNA, 3517 nt, Homo sapiens
ccguucccaccccuguuuucggucggcccggguguucugcaagcuggucaaaaaggggaagcggcccagauauguuaaguucuauggccgcugcagggucugugaaggcggcguugcagguggccgaggugcuggaagccaucgugagcugcugcguggggcccgagggacggcaaguuuuguguacgaagcccacuggcgaggugcuucucagccggaauggaggccgccuccuggaggcgcuacacuuagagcaucccauagccagguacccgcgucccacacgcuaacccguagccgggcaccccaggcagccucuguggagcucuugucccauccugaggcgaugcguacuuagaaagacugaccucgggugaaaccgcuguaugcucggaauuagagcccugcccaagggaacacuccugcaccccaaaucuuaccaauucucaagaccacuucuccccacuccacccaacgguggaaucuuggaauagagcagaguuuuuuccaagaaaggaaaaaacuaaggauguauccaaggaacaauauucucauuuuaugcuuauggcuguguaaacaugguuuuaagaugugggaagccagccuucugaaaaugaguugcuuuauuucuuuuuuguacaggaugauaguggacuguguuuccagucaucucaaaaaaacaggagauggugcaaaaacauuuauuaucuuucuuugccauuugcuuagaggacuucaugcaaucacagacagagaaaaggauccuuugaugugugaaaacauucaaacccauggaaggcauuggaaaaauuguucucgguggaaauuuauuucccaggcucuccuaacguuucagacacaaauauuagacgguauuauggaccaguaccuaaguagacacuuuuugucuaucuuuucgucugcuaaagagagaacauuguguaggagcucuuuagaguugcucuuagaagcauacuuuuguggaagagugggaagaaauaaucauaaauuuauuucacaguugaugugugacuacuuuuucaaguguaugacuuguaaaagugggauugguguauuugaguuaguggaugaccauuuuguagaguugaauguuggugucacuggccuuccuguuucagauuccaggaucauagcuggucuugugcuucagaaagauuuuucuguguaccgcccagcagauggugacaugcgaauggugauaguaacagaaaccauucagccucuuuuuuccacuucuggaucagaguuuauucuaaauucagaagcacaguuucagacaucucaauuuuggauuauggaaaagacaaaagcaauaaugaaacaucuacauagucagaauguaaaauugcucauaucuagugugaaacaaccagauuuaguuaguuauuaugcaggggugaauggcauaucagugguugaguguuuaucaucagaagaaguuucucuuauccggaggaucauuggucuuucuccauuuguaccaccacaggccuuuucgcagugugaaauaccuaacacugcuuuggugaaauuuuguaaaccucuuauccuuagauccaaaagauauguucaucuaggcuugauaagcacaugugcauuuauaccacacucuauaguucuuuguggaccagugcauggucucauugaacaacaugaggaugcuuuacauggagcacuuaaaaugcuucggcaauuauuuaaagaccuugaucuaaauuacaugacacaaaccaaugaccaaaauggcacuucaagucuuuuuauuuauaagaacaguggagaaaguuaucaagcaccagauccugguaauggcucaauacaaaggccuuaucaggacacaguugcagagaacaaagaugcauuggaaaaaacucaaacauauuuaaaaguacauucuaauuugguaauuccagauguagaauuagaaacauauauuccguauucaacccccacacugacaccaacagauacauuccaaacaguugaaacgcugacauguuugucuuuggaaagaaacaggcuaacugauuauuaugaaccauuacucaagaacaauuccacugcuuauucaacaaggggaaauagaauagaaauuucuuacgaaaauuuacaggucacaaauauuacuagaaagggaagcauguuaccagugagcuguaaguuaccgaauauggguacuucccagaguuaccuuuccucaucuaugccagcugguuguguuuugccaguaggugguaauuuugagaucuuguuacauuacuaucuucucaauuaugccaaaaaaugccaucaaucagaagaaaccaugguuaguaugauaauagcuaaugcacuuuuaggcauucccaaaguccuuuauaaaucuaaaacaggaaaguacagcuuuccacauacauauauaagagcuguccaugcacugcaaaccaaucaacccuugguaagcagucagacagguuuggaaucaguaauggguaaauaccagcuacuaacuucaguucuucaguguuugacaaaaauauuaaccauugacaugguaaucacuguuaagagacacccucagaaaguucacaaucaagauucagaagaugaacuauaacaucagaaguuuuuaauuaaccaaacuuuucaucuaacucaagccaaguaaagcagucaugugaccacugguucuaaagucaguucagucuacuuaggaaaauagcguaacuuuaaaagucuuuagaagaagcacacuaaggucaccagaccagauacaaauauuaaauuacuuuauggaacaaaucuagaggggaagccaagauuuggcuaagugugucuguuuuuucccuauuuuaugccucugugucucagcucuguguuagccuauguguuuaggggaggguuuuucuuuauagcuccuuuuuacucuccuguaucuuuuucacuccagcccuccuucaucguuacauguuuaguucauagaaucauuuaaucucugauuugggugggcuuauucuaauuguuuuuaauauugaauacauuauuugcauuaauuuucccuacucauacuuuguaaagcugaguaaaaggcucaaauuauuuuuuucaaaaagcauaaaauuaaauuagcagugaguaaaaggcucaaauuuuuuuucaaaaagcauaaaauuaauuuuuacuuuuauguggucauugguuuacugccacuucauuuggaaaacuuggauagauuuucaccuuugauauaccuuugaauauauguuaccugaaauauaacugugcauuguuaacucuuucauuucuguaguaaaagguuaauacuagaaaggauaugcaauuaauacuuugauuuucuccugaccccaagagcuuguaaggauaugucauguauuuacugguuuuucuuguaucuggugcauagccagaguuccacaguaacaaauaauuugacaauuuuuauuucuaauguuuauuucuguuuuauuuuuaauuuuuauuucuaauuuauuucauu

SEQ ID NO: 16390 - RNA, 2293 nt, Homo sapiens
aaaaaaguaauaucagaguuuuaauuucaaccagcuggcacaacaaugaaagugucagacuuucugaaaguacucgagaaauaaugaauaaauucuuaauguuuuccccuccaccgcccuuuuuuauucuccaagauuaggaauuacuacggauuagguuuuugaaaauaaaguuuccuuuuuggaaaauggucuacauucagaaaugucuuagaacaagcauuuaaaaaaaaacuaauaaauaaucauaaaucaaaauacauuaaaauaaaauuacaguacaucaucgcuccuagaaaauucaccauacaagacgauccuuucaaagguucauaaauaaaagucuucuugacucgaaaucguuuccugcaucgugaugaaaaguaugcagaaaacuaagaagaaucgcaaguuuucaguagggugauguccaaacuacuugaucuggugcggggcggagagacuguuuugcuuuugauccaagugaagacaauagaaaugugcucgucccacuuccucaaguccucaaaaccuggaaagaaaugacaccgagugaaguagguggcuaagaacccuccgagaccaguucuguucgggccaguccgccugacaaagcgggcucagaaagacaccgugguguuucccucaacugcccaaacauauagucaaguggggcugggggacgcaccacgggacaaggacggucgugaugggcgcgggcgcgggcgcgguccgcgaggcccccugccuggcccggaucuccccagccuccccucucugcccagcucuccuggccccagcuuguuucuguuucuuccauugccccagaaacuugguaugaguuuugauuucuccauacaggagccgaaccugugaacaagcuuccuacuccucccaacucacuacccccgagacccacuccucgggagcgcgagugccgggaccuuaccuugucuugcccgggagcugccccuuucaggcagaguuggaggugcugcggagaagccggugcccgugcggcugcgagugcggcugugggugugggugcgguauuuggugcggaugcgggugcgggugagggugugggugcgagugaggaugagaguguggauguggauguggaugcggauacggguggagcugcuggggcugaggcuuggguuggggcugaggcugggguugugauuggggcugggguugcggcugaggcugaggcugggguuggggcuggagcugcggcugcggcugcggcugcgaggggggcugcugcuggaccaggugcugcugcuucugccgcguggauuugaccgccaggauggccugacgauucuuguacugcaccaucugcagcgugaucucggcguuccagcccuggucuugcgggcaccgaaagucgaucuccuugcccucugccaucaccacagugaaguacauguacuugcccuugcgcuccacacaguccacggucuucauguuggagaagugcaguuccuugagcuugaccggcggcucgaggcuggcgacagcggggccacuggguugggacggcucggccggccccugcccgggcuguuguugcugcugcugcugcugcuguugcugcugcugcugcugguguugcagcugcuugggcgggauaagcagcagcccuuccucggugaggaugcaacacuuuuucuuccagagcugcaacaacccgucgcugcgcuucuccagcacgcccuccuucagcgcuuugcagccgcuacucuccagcauccucccagcauaagaggggccgccgcuuggcucggccucuccguuuccagccgcgcgggccgggggcagcagcagcagccucgcgccguccucgccccagcggcucccacggccgccugcccggagcgcgcagaggaggcuaacacgcaggaggcagagcggcggcggcggcucugggucccggcagagggacagccgcguccugaugcgccacaaggucccggagcuccgagcugccgggccucugccguccucuugcgagcgcucacugaagggcacuggccgggcccccucgcggcgcuuuugaaugggccaucuuccccacccccgagugacacccagcggaaaaggcggcuccuggcgcccgcaccgcgggggaaagcccagcuccaagaggcgcucggcagccggcgcacgccucauuaacuuggggccuuuccaaagcccgcugcguccacgcccuccagcgucucuugcuccgccucucgccgcccacuugcuuccgcgcucguuccccuggaaggcgacccggacc

SEQ ID NO: 16391 - RNA, 1237 nt, Homo sapiens
cuucucacauacuuuuaguguaaacacuguaaacuuaacaucuguauuaaugcugucuuuuuaggauuaaugaauaacgagguagaagauacuucauuuaaauucucagacacauaauuaaguguguauuaaccuuuuugaaaggcauuuucaacggaacuggugguuuuucaggaaauugcugaauacccacgcauaaaugcagauauugaugaaguaggauauuuguauauuugcuuuuuuucaaucauucaauuuuaugaacauggggucuaagcagauuucaaaacaaagaccauuuauaaaacuggaccauuuuaauguuuacaauguaauaaaucucuugauugcagacauauauggcuguuugguagaaacauuacaguaauggcaguuuuuucaguugguguguaguccccaauaauuauauaugaaauugcugucaaaccaguaagacugcauuuaugcagccaucauuuucaggacuguugguaaccugagcauauuuucuccaaauaacuuugccuccuugugucacaaggcccaauucgcucacauuuaccucaaugacaauaucuuugguaauaacacccacaguuguauacgguggggaugagggauucuucuuuacaccaaguauuggugggcaaaagguggcuuucaguucaagauguaauacaugggcuuucuugaaaugcauauuggccugaucagucuuucuuauuuaggugguuuucuuguaaagccaucuccgacaaagcagaguuuaguaaccacccucuuccaugccuucuucuuucucuuuccuguucaaacaacuuuuaauacgucuguuucucccugggcauguacuuuagucagagggacuucccguuuucccaccuucucuuuucauuucuguuuaaucauauuggaaaguacuuuggcucgagauugucccucucuguccagcagauaagcagguacugcucccuguggagucuuuucauccuucuuuuguuugguguuucucuuuucaugcaucuugauagucuuuuucauuuguauuuucucagcaugacacuguuuaagguaaagcuuagccuucagaccaaucauuugcuuugccuucuuugaacguucaugagccucucguucauaagccucucagcuuuccuucuuucuuuucuucucaugguaauccaaacgguauccauaguguuuaugguguaauucaauauauucguucuguggcaug

SEQ ID NO: 16392 - RNA, 5671 nt, Homo sapiens
cggaagcggagaggcggggcuaggcccgacaggggagcggaagaggcccaggaggcugggugaggcgcugagacgguuuggcggugaguccugggccaggcgcagcugaaaggcccgcaacccgggaaacgucaaaacaaacagaaggacuugggauuccggagcagucgccccuaucgcugcuccugcaguugcggacgccaccgaccccgccgccggaggacugggcacugaaaggccucuaggccuaggcgcggcccgcggagccagacguguugcugccgugaguaaaacgagcgcccucuccgcacucguuuacaaauuaaaauggaggaaauuucguuggccaaccuggauacuaacaagcuagaggccaucgcucaggagauuuacguagaccugauagaggauucuuguuugggauucugcuuugaggugcaccgggcagucaaguguggcuacuucuaccuggaguucgcagagacugguagcgugaaggauuuuggcauucagccaguggaagacaaaggagcgugccgccucccgcuuugcucccuucccggagaaccugggaaugggccugaucagcagcugcagcgcucaccuccggaauuccaguagcugcaaaaugagagucugaaaguggccaggacaauaacauagacugguccuguggcuucgaggaguaagcuaaguagaaaaaaguagaaaaaucagacaaaaguuuuaauucccccuugaagauccuagcauuuaaaaacccaaaguggauaauuuaggaauccuuuuuuuaaaguguauuaccuggagcaagcucugaagcccugggcaggaggagcugcacagccugcgggccaugcagugccuguugaucucuaaacacaccaggaugugcgcaagauccuguagugcccccagugcacaggugagcaguugugugcccagcauauaaaauuuuugguuccucagccuuucugucugccugaugucaagggcuucuuggacaguuuggacguuacaguucgucaggccgugaucaguggccugcagugggacugcuccuuugauaucugaaccucuguuaugggcuucucugagacaaguaaaugucaggugcaagaucuggauacuaacaguuucaguuugggaaauccaagaaaaagaauuaucaaguuugauagggaagcucuguagccuugacuccagcaagaagaaaaggucaaaaccacguguuucccaaaaguccagacuacaaugauucagcugacuugaggacaaggccuagcauuuggcugagcagagcccucuuccuugcccuccaaccugguggcauaggcuuggcaaauggacaacuugguuguccagacagguugaggauucgguuaugauccccuggggagguagcagggaccucugcaacuaugcaugauuucucaaacuucaagauucaugucuggauguauuaugcuguggauauaaguuuaguagggcggucauuuccuacucugaguuacugguuaccuagccaguccaugggugugacuugguccuuaagucaggucacuaucugccucccacccugggggcaggacugaaguauggaagagcaucauggcugugcaggaggcugugguuugaaaacugagcccagagggcacuuucagcugcccucaauaaugugaauggauuagugcuaggagccaaggagcaggacuggauuaucucaucugacugugugcagaauccuguugaaugucccuguuuucuuugguugggcagucagagcucugcuauggugaacauccagacugucaccacuuucugucugccgcucgaaagggauaguccuuuccacucgguccccuuuggaucuucuugacaacaggagcaguccuuuuauuguuagaagucagagaaagaccuccagaaucuccugacuuuagggaaugguauaggggaagaugggaaguaagagucacauaucaaaacuacccuccacuuuauucccugagcgaggguuuaugaaguauaaaggggugggagccccgaggugagcgggaacggugcugcuuuauuugaaauguuuucuuaccucauucugugccccaguaggggguccagccucaucugucuggcuuggcccuguguuccuccuguccccugcuccacugccuaucuggugccccaggugcugcuugccacuccagcugucacauugaacaguuucaauucagcucuuaaugcuccugcuuccgaagccugcccaauuucuuuuuucuuggccucuguuuuuuuuuuuucuuucuuuuucccuuguuuuuguagaagacucagaggagaaucuuucuuauggcucccucuguugagauuggaauuggaagagaacuuaauuuuuuguauuuaaaaugcagugucaugccuauaagcauuucuccuauauaggacugcuuugcuagugugcccucuugcugugucuuacuucauaaggaguuguaucuucccaccuccauuucaauacugccgguuaggaccuaaguagaagagcaguaaaggcugauugacacacagggggauggaguugguccuuguccauucucucacccuugcugugcauguaucaauccuuaucccagaagguacuauuuagacuguauagacugauuuagauuacauacuuuagaggauuaaggaaaccauagaguuugggccuuggaacuguuacugccuuguccuagaguuguccugaucaggcuuggggccuaguuacagauuagucuuaaagaauugcauuaacuuaaaaaaaaucaaaccuuggcaagagcuaaaauaauuuggagauaucuuugcccuugacuuguagacgacaucuaagaggaugaagaaaggagagucuaagugagacucuggccuacuuccuaacaaugucuuggaagugggaugaugguaaaggagaaaggccacaguccaaucccucugccuucagauagggaacucaaauccugaaauuacuguuuucuuucuggccuuuucuccugguuagaggaggaagcggaaaguaguuuugaguaguauuuuguucauauuaccccccuuuuguuuuuuguuucuggccccucuaccaauagggcaguagccuccugcccuggauggguauaaggugggcuugguccaacaggugcccagaggguacauacuccuuucuggggagagaaugcucccuaccauauaguugacagugguuaggaacucucccuuucccuaccuaccuuccuuuuaauagcagaauuccuauuuuucccuugauuauguguauugaucacccugcaauccuauuauguaucugaguguguguguguguguauguguguguuaugggggaagggggggguucuuuaaaauuucugugguuuguggcuuuuucuuccauacauuaguucccaccaucgcaugcccagggaccacugccuggcauuaucgcaugcugggaucaucgggggaggguagugaagcucaccacuguccuuuguuuuggagauuuuuauuuuugcauaaguaguccauccuauacagauagcugauuaacuguauuccccuuuccccuauggcugcugguguaaauaaacugcaucuccccauugguaaacaguaauaaaauuuuaaaaaaugacuacuugguccuuggacucuguauauucaucuuuuaaagcuguauguuuucaggcauugacauaaugagauaaacguugaaaugcuauugaaccuuaauacuuccucccuaacaggaguuuuaucagaacagagaaacuguccaaccuuguuucucaauuuggccugcaaauuuaacugucuguagcauccagugaaagagccaaaccguauacaaucaucccuuuuccauaugagguaagaaggugguaagauaaauccaguccugucacuaaaagcccacugugacagauaguuccauuugaauugaacucaauauaucuuaguaaguacauuuuaccaucauuuuaagcuaauauccuuguucucaaaagguaaagugauucacagcagacgaugguucugccuaauuuuuuucucaauacuuaaaaaauuaccucaacacuuuagaucuuucauuucauuuuuaauaguaauucugagguuuuucaucccauuccuaacccagaguuugagcacuuccccuagaaacuacuuagugauccuguguccuaaucagucucuugcuauguguucuaauuuauuaaaguuucguauuggacauaauacugagauuaauaaaaauuacagaaaugaguccagagaagaaucugacucaauaggauaccucagggaagcuuauagauguguaacaugguauugagucuucucuucuaggagcacucgauguacuugucacuguccaguuuaaauaggccagggccaacguggugauuugagaaaacuuaaaaauuugacgugugaaacccaugauguaaccauagcaggagaaauucuucaaaugaaauuucaccaagauuggguauuuugccuuaaguaagauuucuacuacuuuuauuaaaauucacuguagggaucuacuaucaauuagcuuucaaauacaucugcagcaaauacuuuugguuccuguuuuguagguuuggaguuuaauauauuuagugcuaagcuaauuaguuuucuaaaaagauaauugcaagaccccugcuuuaccaaauacuugacaaugggacuuugaagguuauuucuuauguuuucugacuaguaugaucuuuaaagaaaaaaaaaaacacauugcauaccuuuuaacuaccaauguuuaaccuccuagauuuagcauuuaacuacagcauguaccaucaggucaagaaucugauaaaugauugcuugauguugacaaagugaaagacaaaaugaaguguacugaaguaacuaaaaauucaggaagaacuuucuugugcacacauuaauaaguaacauugccuucucuuaagaccuaucugaaguguugugaaguuuuucuuacaauuuuuuaaaagagauuuaugaagaaacuaugugcuaaaagcacaacaauuauuaaauuuauuuucauguuguuguuuaauuaugguuaacgaauugccaguuuucaagucagccagagauaauaccagauuucagaaguuuuacucugcugugaaggauuacgagcucucugauuuucauuuauguuccaaaagaugcccauaauguugcuuuggaggacagcauuagaagugauguuccuauucaaaaagguuuuguggauaaaccuuaaacucuuggcgguguuuuuguuuguauuuguuuucccauuuuugaaaacauuuucaaucauauuucuugagacucauuggaaauaugugagcuaaaaaggaaauacuaaauugauuuuagagaugaaaaaaaaaucuucagcagcagugacuugcccauaguucaaaaagcaaaaauuuacaagugguggaagcaaaaguagaaugcugcuguugugacuccuaggucagcggucuuuguugaagcaauggaguaauaaaucaaacgacuaauuaaaaacaaaacaaugaaaaauccaugaugcuuaugaacaacguuagggcaaugaauuugaaaacaaaaaaagggaagucuauuuuaaaauagaacu

SEQ ID NO: 16393 - RNA, 830 nt, Homo sapiens
caaagggaauugagcaagaugagagcgaccauguagcccauggugcugggcuccccaaaaggcaaaggcaggcagagaggggaggcgccauacuugcugccacccagcaggggaacugcggccauggucaaggccagcagggcacagagcaaaaugauuacuuucaggcuagaaaauggagcuuucguuucaaauuuugcagaauauuucacagagaacccacgcuccagggcugccagaguaagcaggaaaacagaugauucugaagcaaaaauggacaaaaaaccaaugacauggcaaccaaccccauucucccaccaggcaccaugucgugcaaagcugccaaaagugaacgcauccacaccagccagcacggcacuggagacucccgugagcauguucacugcugcgaugaccccaauuaacaguuuaaugggggaaauguacagaggggaucugaaaacuguugaagucaccaaagcauuacaaguaagugccagaacugcuaugguccacacuccaauucugaucagccagccaucaagcagguguucacaggguuugaaggggccuagaaguccaaggaaggcaaagauugaguaucaaauuaggguuuacaacuuuugcugaauuacccuuuugucucuuuauuuaggaugccaagagauaauggucaaaaacagccuaauaacacacagugcccaugugcaugcuccacuaucucaagccacugucacccuggaucuucugcagcacuggcugggugaguacacccggugcuccuguuccaggguauugauggagaaaugagaauggagaauuucgaucac

SEQ ID NO: 16394 - RNA, 861 nt, Homo sapiens
cauggcgguuggcaagaacaagcgccuuacgaaaggcggcaaaaagggagccaagaagaaagugguugauccauuuucuaagaaagauugguaugaugugaaagcaccugcuauguucaguauaagaaauauuggaaagacgcucgucaccaggacccaaggaaccaaaauugcaucugauggucucaagggucguguguuugaagugagucuugcugauuugcagaaugaugaaguugcauuuagaaaauucaggcugauuacugaagauguucaggguaaaaacugccuaacuuccauggcauggaucuuacccgugacaaaauguguuccauggucaaaaaauggcagacaaugauugaagcucacguugaugucaagacuaccgaugguuacuugcuucgucuguucuguguugguuuuacuaaaaaacgcaacaaucagauacggaagaccucuuaugcucagcaccaacagguccgccaaauccggaagaagaugaucgaaaucaugacccgagaggugcagacaaaugacuugaaagaaguggucaauaaauugauuccagacagcauuggaaaagacauagaaaaggcuugccagucuauuuauccucuccaugaugucuucguuagaaaaguaaaaaugcugaagaagcccaaguuugaauugggaaagcucauggagcuucauggugaaggcaguaguucuggaaaagccacuggggacgagacaggugcuaaaguugaacgagcugauggauaugaaccaccaguccaagaaucuguuuaaaguucagacuucaaauaguggcaaauaaagagugcuauuugugaaaaaaaaaacaacaaaaaaaagaaa

SEQ ID NO: 16395 - RNA, 111888 nt, Homo sapiens
gagccuucugcgaagcaaccuagccccagggaaacgguagcggccgcagaagccccgcucucuguaacggccgcggaggagcagcaagccucccugugagucggugggagacaagacggagcggcgguaagggcgguagggaagugaagcgccucucuccaccuuguuagaagcgcgcugaaagcggccugccuacccaccccaucgcugccguuuugcagucgucgcucccaccuuccgcugccgccuggagggaagccggagcgacgggggucacggcggcggucagaggguaaaggucuugcucccagcagccuccgcgguggauacgucgccaucuuggauccgcgggacaagaaaauucaugcggugaguuuuugguaaauuuucggaagucuggcagcggggcgcgcggcgggggcggcagauucggggcccccgcaaggcgggggaaugccccggggccgguccggucgcgcccaggguccgccgguagcgucccggcccaccgcuucccguugcuuuugucucggcuccaaucgagagacggagagcggagcgggcggggagggggguggcggcgguggagggagggaggggguguguauggggguggugguggaccggacguaaagcgucgcuguacucgggccgcugcagcagcagcagcuccagauccuaggcccggucccauccgcgagugguggggcuuccccagacuccacuccccuaggcucccgccagcgcggaggagccgcugccgccgcgcugcuuccugggggagaagagaaggcggcagcggccguggccguggccgacgagcucgagcccgcuuuagacggcucugccgccuucccggcagcuggugcugucuguggcuucuuaccuucucucaauacacguauaucaucugccaguuauguguauuucuguuaguguguuugcaagugucagaugggagacacuggacuggcuaacgggugucaggauccugcaggcccugggauaccgaaggcugugcaugguggagggagaaggaaugcaacugcgaugccgccucugccaccgcaccaggaaggugaagcuuccguagugucguagacugaguccggaugauccuggggcggcggaggaaccacagacgcuucugucugugaaguugcaaguccuggguuucuacuuccgcaggggccucuccaccuuuugcugucguaggucucgcuuaaaaguuuaacagaagaaaagaguaggguuaaaagaggccuuuguaguucuucauugaagcacuguugucuguccgggugaaagcugauaacucuugguaacugugguccuuagcaaaagagaauuggaguuuucuuuuauacaaaguauuuccaagguuuuagaccuuauauuuauuccaggccuguagguacgguauuacuaccacaaaagucuuacauuaaggguaccacccucucagagggaaccuaaacaucaacuuccuucgaauccuuggagacaucuucacuuuucaacauccggaagacugagugcaacauauuuuguuucauuuucauaaaagucuuggucagagaaucccacuccuuuuaaaaucguuugggcaauuccucauaauuaaguacacugcuuugaacccuuaguucuuggcgaaaugguaaaaaguacucaguuaaaaucaguucacgagggaggccaacuugaauuuaagguucaaaguugaacauauuuagugucaugcuuaauauuaggaauuuuuagagcucggaaucauaagugugacuguugauuucccuuuugaagcaauauaaauggaaagaauaaaguauggggugagggaugagauagaaauuuuaaaguauccauuuacaugcaagguugauguugaguuugggaaugcuuggcauaauugacaacaguucuuuccaaacgucaaugaauaaaucucacaauuuuguaagguaacuauugcagauugaaaggguuaagaaucauaguuggcugaaaugguuaagugucuauauucacaucccaguucauugaaauguuuuauaauggaccaagauaauuaguaagcucuguauguugaauuuguuuaguuuguaguucuauuauaauguuaaaucuaaagaaaaaaauacaaaauacacuuaaagacaaaacauguuccacucuacucacuuauuucuugacuuuguaagauccuuacuguaaaaaagguacuuuucucucauauuuucugagagcuugaauuguaauaauuuuugugaauacuuuguauuuuagagaggaagugagaaacugcugaaguuuuuuuugcaucuugauuagugcuuuaucaauacaaauaaguuaauguaaacauuuguuggcaggaaucuuuuucuaaguauacaauguagagauaucuguaaccuaaucugaucucagggaaugagaauugccuguuuaaccaagcaacaaauacagccuauacaauuuuucaauuucuauaauacuuuaauuuacaugguggaaaaaugagggcaaaaugcuuguguaugagugauuuauauccccaaguaccugcucuugaagauaaaacucagauuguggcuuaucuucugaugcugggcaaaaaacaaaaacaaaaaaauucagaaugauacaacuucccauauaccucccuacaagaacuaauuaccuuuguuuuugcuuuauaacuuuggauguugcacuuuuugauuuuucagagaugcuuuacaguuauuguaaucugaaaauuauuuguucaaaaguaaauaaaauuuucagguguaugaauagauuuuauuagaagugauucuaacccaguucucauuuguauuccuuuaguagauacugguguuaaaaguaccuguauuuugaaagaccauuacagaauuuuuuacaaccuguauaaguuauaguuuuaucuuuucuagugacagacuuacuucauaagauuuucugauaauaugaauaaaauguaugcuucacauguauauaugaaauaaugaguaagcauuaauagaccaaugaaaagaacuuagcuuacaauuuauuuucuugcucuuuaaaagcagugguaaauaauagcuuuuuuuuguuguuaaaauuuguaacuguagaaaguucauucuguugggaucacauauuugaaggcaaacuaacaaugccaugugcuugcuugaauaggcauuugaggacagguuauuuuccugagauuucaggaaaauauaccaccaaacauuuaugauguuauuuguuaccuggaucuguaguggauuuuguaacacaaagaggcagaauauccaggguaccagguagggcaguuuaggggcagaguuaauaugagguguacuguaauguuugaguggaauuacauacaguguuaaucaagagaucuagugcuaugguagaacuuauucugcuugaugauacaggugacuguucuuccuuacuaagagcaguuucuaccugugauacuuaaagggauugaauuucacugugacuuauaucagauauuuugaaaagagcugugcuaaaguugaugucauuguagaaaguuugccuugaaguggaaugaaaguuagguuuuuauuucuuugguuuuucuguuugacauccuuugauuucuauuuuagaauucaacucuuaugacuaaucaugcugaugugguuuguucauuuauuuucuuugucuauacuauuaggaauguccuggaaauagaauuuguacuguguuuucugagagcuuguucucugaaauacagaugcaaaucuguugguaucuguugguauaucccuugggggugugcugcauuauaaaguaauaaaacaguuuacaauguuugcuuuuugucaagagcuuaugacauauaauauggaaauacaaaaaagugaauuauuuaggaaaaaaugggaaauuuuuccuuuucugggcacuucaggguuuuguauaugcguagacucaggaucuaaguccacuuagauauauaguuagauauuuuggacuauuugccacuuaacccugcacauuuucuuuuccuuauucuuuuuuuuuuuucuuugagacgaaguuuugcucgucgcugaggcuggagugcaauggcgugaucuuggcucgcuaccaccuccgccucccggguucaagcgguucuccugccucagccuccugaguagcugggauuacaggcaugcacccagcuaauuuuguauuuucaguagagacaggguuucaccauguuggucaggcaugucucaaacuccugaccucagacgauccgccugccucacccucccaaagugcugggauuacaggcaugagccaccacgcccguccuauucuuuuuauucauguguauguuauugcauguauguguguggggggcaggugguagugcauauuuuauguaucuuucacuucucuguuguuugaugaacuucuuccauacuccucuuugguaucacuuucuucauaaaucuuuccugacuccccaaauccuuugcuguauugcuuuuuacucuucaaacuucuauuauagaaugucacacuguauuguaauuuacuguccaucuggacugggagcaccugagagguauggccuugacuuguuuauguuuauguuuugaaugccucuauagugcauaauacuuaauagguucucaauacguaucuauuaaacugaacuguugcuagauugucauuugacagugcuguuucacaauccacagaucugaagcaacagauuggaaaagugguggggagaauagcuuccuguauuccuucacuuccuugaauccuuucuuacaguuuugcuucuuaauuacauauggaaaaauagauaacuagcuucuuagggaaguguguguaaaguuaguauggaauuagggaaggauguuaguaauagagugauuaauacccuguuuugcuucuggcaggauguuuagaucuguauuucuugcauuucucgcuguauuuuguaugguuauggcuauuaugugaaggagauauuuuguauuugucuuuacaagguaucauguuuaccaguacuuacccaugagcucauauuagauuuggggcuucugaagauagauucuguuuuucucaccuuuuuccuccuaaugccuggcccauugguuaguagaaagcaggauuucucuaguuugaauaaaauugcccuuauggaaauaaggugagaugugucuuauuggagguccaaaauuuaaaaagcucugaaaguugaucauuucuuuuguuuuguuuugaauaagcaaggugagaaaauaucaacuggaauuauaccugugaauuugauuauuauuaucuuucuuaaucugauuuuccuacauuuucauauggaaauguucacguguuugacugcagguguugccauuggcagauguuacaucauauaugauacauacaacauuuuaccuuucucaaaucugaaacuguguuuugagaaacaucuggccuuuauagguuuguuuaagagauugugagccaauuuucugcccauuuuagagauguagaaaucaaaacaggauagaugacucucagaauugcauuuuaguagauaugcuaauauugauaaugauuuuaggaauauuaugucuuaauugccuguauauguuccagagaccuuuuagugacuaagagcugccaaagauacagaguguauauuuuuaaaaagggaguaugauccaguacucaggacaccaguccuuucucugccuuuucugaauggaaaugucuuuccuuauacgugaguagaugaaaaugcacauuuaguaaguuuuuacuaaaacuuaguaaaaacuaaugauaaaaugagugagggaaaauuauguauccuggcaauuuagguaacagugaguagacuugcuuguuuuucaaacauauugauauacuauuuuuccauuuguguauucagauguugaaacagcuccaguuuguauuagcaucuggacaaaauguaaugacugauuauguaauacaauguguuugagagaggagcauuugguuuugugucauaucuggcaagaaugugcuuuuguauuacuuucuacauuguaaauuauaaugccuauccugcauacaaauuuuguauuuaguuuucugcuuguaagaaucuuucauaggucaguaaaauaaaauauuaaguuuacuaugccauuccaagcaccugacuacuuuuggcuuugcuacuuaauauuuuuaaaauguuuuacagcuugcagagaggacuuuuauauacauuaucuuaauuuuauauauauuaaaauaaguuuaaaacuuagcauuuauguuuauaaacaagcuauuuuggucaauaagaaaauuagaaguugggaauuaugaaggccguuuucaucuucagacuggacucagagucuaauuucuuucucauuuauuuuagcgcuacuuuauagagaaaaucgugauuuauuaaaucaaauagauguuaauggaagacuuguuuuuguuugcaucugaucaucuugcagauccuggauauuuaaucaaauugaugcagaaguuugaaagacaagcagcaguaggaaauuuuuguuucaagcuugacuuuucugacaauauccaacagcugcucauauuuuuaaaaauuagaaacauucacugagaaacguuaaaaacuuaaaagcaaauacuguguuauaaugagaauagguaauaacauaucauugaugcuacacuuuacauauuauugcaccauuauucugagguaaucauaugccgaacagauuacugcacaaaguaaugcuuuagggguguaguuuuuaugggaaugaacaugucuggccugaaauuagaaaaaaaauuggagccauaaucuuucuaaucuaugcuugcuuaugagaaauucuagguauauuuaugucaggccaaacuauuugcuacagcaaaccgguuaaccugacaucugagauagucuuuaaaguguuuaaguuugguauacaaugcacuuguguguguauaugacucauccuaaaauggauggauguguguaaaaaaauuguaauccaaugcuuaaaugaauuugugaagcacaaauaagugaaacacuaagauguuucagagcauaguuugaaaaucccugugcucgaucaccaaagucacuuccaacaguaaaauucuguguauuuuaaaaguucuuuuucuauucccugcacaugcaaaauucauauaauuuagcugcuuuuuaguaguauuuggauagaaauuguuuauuaaauuuaaaguugaggcucugcugguuauauguuagcacucuagauguuuucaaguaaauccuuuaguaauaugaguguuuagucucugcuugacauuguuauuggauauaugacggugauccagacaagucuccaccuucauuaauguaacauucuggaggaggagacagacaguaaacaaauaaauaaacauaauuucagguaaugguaacuuaggaaaaaauaaagggggauaaagguacagcaauugauuagaaauggaaaaaagauuaaguagggugaugagagaagacuucuguggagguaucaguugagcagaaaggaguaagccaugcagaaaugugguugaaugguuuuccaggcagaaguaauagaaggcccugagauagggucaaguuuuguauguuugaagauaagaaauuucauaaacaauuacuuagugcuuucugcauaaauggggguaagcucuaaaggggagaagaggugauuaaagcauaaugaucugugucuuucacuucagaaaauauugugguggacccaguaaucuguaauagguuuuacaaagagcaauaggaaggagggauuauuuuuuauuaaggugccuugaaauuguuuucuacaucagaugaauugcagggguugagggguggucugucuggaguacuggaaaaugacauaggaaagcaaacugaaaacuuuccuuaauucauguguuuauguagaauaauaaaaccuauacuuuucuuagaaauuaguaauaaguuucauauuuaauuagauuuucuuguacaguccaauaaauguuacuuugugcugugcacuauuauaguugcacugcguaauuccucaaguuaaauuuuugucauacuguagaaacauccuagaguagaguaacuuuguuucagggaguuaaugaguuggcuucaaggaggugauaagugagcucuggguucugaagggugauuuguaguuaacuaggugggggaggguagggaaucagcauuguaaaugcacaaauccuaggaaaauguucuagauuuggagaauggugagguaauccuccauagcccuugauggaauucugggaccucauaggagaaguuaguugaaggaaugaaguagccacaguaugaggucuuaucuuuuaugugaugagggaaccauuaaccauuaggaggggaaaaaaaagccagugagauugauaagcagauucguguuucaggggaaaguuuagauuccacagucgauuuacaauuaaaauuauaagcuuaaugguguauguuuaugacauuuuugaaagauuauuuucucuccauuaaacaaauugaguacuuugcauucauauaagcaggauuuuuauuuguuaagaacuguaugacuuugaaacucuguagucuaucuuuuagagaacuuguuauauauguaaaugaaugccaacuguucaagauuuuuccguuacugggguggaauuuuuguauacguuuuggggcaggcaaaguuugaguauuaucaucugauguaauguguuaggcaugagauuuaacauucuuggauaaauugaaauaauaccaagaaaaucuaaaucagugauaaaaucccuacauaggugcugauauuuauguuauguuacuagaagugcuuauuuuacaaugcuaugauauguguuuguguguuucucaaaauauauaacacuuggauauauuagguugcuagcauuaucuguuaauugacaugcagaaacaaauccuaaauuaauguuuuuaaagagaaagaauugcuucucugagaauguaguuucagcaaguuauuuuuauuuuuauuuauuuauuucuuuuuuugagacaggucucacuuugucacccaggcuggaaugcaguaucaugaucacggugcacugcagccuugaccuccugggcuuaaucaauccucccaccuaagccuccugaguagcugggacuacaggcgcaugccaccaugcccggcaaauuuuuguaucuuuuguagagacaggguuccuccauguugcccaggguggucuugaacuccugcgcucaagccaucugccugccucaucuucccaaagugcugggauuacuggccuaaauuauugcuuuuauuguaugcauuauauacuauuuuaucauaacaaaaguuaaugguucaacuauggcauuuagagcugcccacguagccugauugucuauuuaguucacuuuugacugaguaaaauggagcugaucuaucugcuauuaaagagaguuauauucugaaauuuuacaugauguucauaaugccuggaacuaaccagccugaaauggaaucaccguuguacuguuuucaauuggcuaggugacuuauucucccuauacuucaguuuucucauuugaaaaauguagauaaaaauaaauaaauaaaaacaaagaaaaauguagauaaauaacaauacuuacccaguagaacugauguaaggauuaaaguuuuuuguggguuuuuuguucguguucguuuuggagugggacuuguuagguuaaagaggagcuucugggguauacaagaauuagccacaauuuauuucauagagugcacuauacucuuuuuuguaucagauucguaaauguaaacaagaaugcagucuugcucuuagagucuaaacauguuuuuccuaccaggaauuuuguuuagaugaccuucugugaaguaagauguguaauauuuugaguaacauaaauaaaucgucauauugcucugucuguaguacuuggcaaagcacagggcacauaauaggcauuuaauaauuccuguguuaagugggauaaaucuaauggguuaggauucagacagacuggugucuaccuuuuucaaccugaauagugcagaguuaguuaccuguaguaguuuuuucuucugugccuguuuucuuccuuaaaauuaauaaaauauuuucuucccuuaaguguauuuaguagguuuaaauaugacccuguaaaacuccugacaaguagguauuuacuguuguugguucccaugccauuuccuuuauuuagagcaaaaauugcaaaaauccuggaaguucagaagaaacacuuagcaccuuuuauuuauuuuuuugaaaguugagaaauguaccauugaguacgugcucaucuuuaaugaagagauaauauauuauuuuggaaagacuucacacuuugauucagaugauggguuccagucugggcucuauaaacuuacuagcugugugccuggacaaaucaauuaguauugaagagccucagcuguuugauaauuuauaccucccaguguugcugauggcaacucagauaaugaaagaaaaaguguuuaacuguagagcaugucaaaguaucaugauaauuauuccugauuauuaguuacuguagugaaacuaguauaguaguuuccccuuaauucaaggggaaauauguucugagaccccaguggaugccugaaacuacagauagcacugaaccuuauauguacuguuccccccuauacauacauaccuaugauaaaguuuaacuugcacauuagguacaauaagagaugagcaacaauagcuaauaauaaaauaggccaggcgcaguggcucacgccuguagucccaacacuuugggagaccaaggcgggcagaucacgaggucaggagauugagaccauccuggcuagcacgaugaaaccccgccucuacuaaaaaauacaaaaauuagccgggagugguggcacgcgccuguaguccuagcuacucaggaggcggaggcaggagaaucgcuugaacccgggagguggaguuugcagugagccgagaucacgccacugcacuccagccugggggacagagcgagacucugucucaaaaaaaaaaaaaaaagaacaauuauauaauauaaaaaaguuaaaugaaugugaucucucucucaaaacaccucuuguacuguacuucuugugaucugucagucugauaaucaagauaguuacuaaugugaauaagggguggguagcauauguagcaaggauaucaugucccaggugggauggagcgggaugucagaaaauuucaucacacuccucagacuggugcccaauuuaaaacguaugaauuauuuauuucuggaauuuuccauguaauauuuuuguacugcgguucaccaugaauaacugaaacugaagaagaagaaaccgcggauaaggggagaacuacuguaguuucuuaaguuguaugauugaaugauucauucauuuuuaccuggugaugcugcugcauuugggugcuuugcccuuuaugcauuuuuauuuaaauagauaucugguuuauuaggcuaggcgcaguagcucaugccuguaaucccagcacuuugggaggccgaggcggguggauuguaaguuuuaggaguucaagaucagccuggccaacauggaaaacccugucucuacuaaaaauacaaaaaauuagccaggcaugguggcacgugucucuaauccgagaugcuugggaggcuguggcaggagaaucgcuugaaccugggaggcggagguugcagugaguugacaucaugccaguguacaccagccugggugacagagcaagacugcaucucaaaaaaaaaaaaaaaaaagaagaagaagaaaaaaagaaaacuggcuuauuggacuuugggaggggaguuuggagagauugugggagugguaaaaaaagauucugcuauguucaucggagcaggccaguuaauugaguauuuuugcaugcugagguccugaugcuuucucuauguaucuauagcaggaaauuuacuucaucuuaacuccugcuucauuaggguaaaauaucaugauaaucuuugggguauucccauuuuuguaacuguauuuguguccuuucucuuuaucauuguuagccaaguguauuuuuugugaacaucgugucuguuuuuuugaaauucauuuuuaauuuauaguuagagcauugagaaugucagugcaguaguuugaaacucuuguguauucuugugcauauguguaugaauaacuuacgcuguucuuugucccuuaaaucuguaagaucucuuggguacugagccuuuugaagcauuaaaaguaaauaccauauaaggcaagcagaauaguacuaaauagcugcaguagcaaagcaaggaaagugaaucacagaguaaugaauuuggaaaaugacugucgugcauuguaggaaaaggcauugcuuuuacuaucauccuuguaaaaucuaguugcugacauuaaguauuuguuguaugugcugauuauuuaaucguguacuguaacaaaggcacuuacaagcaaaauacuuuuucuucuaaaaacauauacugaaacucuagaaauuggaguacagcuacccuaaauccucaguuaguuugcuauucaauucuuucauauuaacuaaggcaaauaauuuaaaauugagcaaauaacucauaucuaaaacuuauuuauaaaacauauuuguaauauaaaacaugaacuucuagaagaucuacagauucuggucaagauaugccccuuuauaauuucaauaguuuaaauaaugauugucaggcacagcaaaauacucaggcaucagauacucaguuaacucuguuauguuugcuauucuuagaagauuauuaccacacuuuagaacaguuuucaauauccaaggcuguuugcuuauuucacuggaauuaacuaaaaguaauuagggaauucauuccucagaauaauuuauauccuaagcuuuaugaugaagaaggcuuuuauuucuaauuguauauuccagccuuggaccaaaaauguacaugcuaaaauaucaagacaaggcaaagauauauuuuugcuuuucugucacuuaauacuauuucaaaauaguuucagauuuaucaauuggcccagaaaaagaguauuuaauuccuuugauuuggaacaucugauucaaauuaaugauuugagaaguuuuuaauauacuuugggaacuucaacuuggaauucugagguaaauuguuuuaaagggaagauucuuuuguaauagaaaguuucucuauaacuuaccuauuuuguaauuuuggauucuuguauauugauauguauuauuacagcauaccaaggaaguaauaguguuauuuacugguuuuuaaauuuuuauauggagugaauuaaaugugagguucugcugaaggagaccuguggguaaaaaaaaaaaaaaaaaaaaagugguaauagcauauacuuauuacagaaaaaguagaaagguuggugagagaagaaaauaaaaaucacuuccaagccuauaaccuagagaaccguuguuaacugaggcaaacauugccauuuccuuugcaugcauguguuuguaagcucuacagucucucguuuuucucucugauuauuaagguaauaugggggaugugaaaaugcaggagaguuguaauaaagagaggagaaaaagccacucagagacauccaugaaaguuugcauuuuugugaugaagaaauuggaguagacaugguaauuuguaaccuguauugaaaaaacaaaacugacaccauaagcauuuuccagugucauauauuuauccaaaacaggauucuuaauggccagagcauaacugauuuaaugauuguguaugauugaacauuuuauuuuuuuuuuacuuuuauaaauagcacugugaugaacauucuuguaccugaauuguuuguacauuuauuucuuuagaagaaauuucuauaaguacaaucauuucaaaguauaugaauuuuggagguaagcagguccagugcuuagccaauugcuguguccuuagugagauuacuuuucaagccuuaguauucucucuguaagaacagguauaauauacuuaacucagagguuagaaggaguaaaugacaacauauguauagcauuuagcacauccgauaguauacaggauacucucagugagucuuuccccaacuacccccuuuuuuuuuuuuuuuuuucuuuuugagacggagucucgcucuuucgcccaggcuggagggcaguggcaccaucucggcucacugcaagcuccgccuuccggguucacgccauucuccugccucagccucccaaguugcugggacuacaggugccugccacugugcccggcuauuuuuuuguauuuuuuuuuuuaaguagagaugggguuucaccguguuagccaggaugcucucgaucuccugaccucgugagccaccugccucggccucccaaagugcugggauuacaggugugagccaccgcgcccggccccaacuacccuuuucuuaaguagacucuucuucccuagcaucuauuguaauuagcuauuacgcuaaaaaaauuuugucuuucauuccaccacuagaucaugaguagggacaaguucagucuaguucauuaauguauauugaaaacucguacaggccuaacaaauguaaauauguuggauguaugaaaaguuaucuuccaaagcuuuuaauauucaguugcuuuuuuucuuacagcaaagcugugccaguuuacauucucugcagcucuguguaaauuguguccuuuuuaauuuacugucacugauacugaguauguuguguuaacaaaaaguucuaaauuucaaaguuauaaacugauaauuuuaaaaacuuguauuuuuuggcuuuuucucugaagaagcaauauuuuauauucacuucuauuuucacguuuucuguuuauguuuuucauucuuacuaauaagaauaaagacaaaauaagaguaauauguuauaguccuguccgugguccccucccaagcauuauuccauacuuccugggaagaaaaaguaaauagcaucacacaauuaugagacaggguuaauauacagaaguaccauaucaaaacugaucuccaagggguuuaaacuggauaaacuuacggugaaaaaguuuaaaagaauuuuugccuaauuuaauuuacuguauuaacacugaaaauguagguuaagauguuauguuaaaaucagauuguauuuucaguauuaagcuuauguuuucuggagggcuucaaaaucacuuucauaucuguggauguauuugaaaauaguauuuugcuugugggaaguaggcaaagacaaguaauauuuagguauuguauuagauauuuuauguuacucauucauuaauuuaacaaauauuuauuuaacuccuaccgugugccccaagugcuauuccaaaagaauauagcaguguacaaaauaaaaucuauauagauacauauaaucugacagauggugguaaggauaaggaggaaaagaaacuaagggaaaguauggaguguguaugaggugcagauuuaaauaggcuggucagggaaguccuuucccacugauuuccccucaaggcgugagccuguggugagggagcaauccugugcuuguucaggagaaagggcuuucaggaagggacaacaacaaagaacaaaaaaccugagagagacggauucuugaugucuuaugauuaaaaaauugcaaagcaguauguguggcuagaguguagugggaaaggaagagaaugguagauggguacagaaaagggcaaaugaggaaagacuuugcuaggcuaccauaaggacauuuuuacuuacaguaaaauauaccuuguauauacucuucacaguuguuacacgagguuagcugaauuuuucccauuuuacaguugaguaaauaagguagguucuagcauauaacugguaauuaacuucuucaaggucacauaagcuagccaguaagauccagagucaggucuuugacuucaaaaccuccugaauuuuuguuuguacuguucuuguucaagcauacuuacagagccuuucacuuuuacagugaaauucagaccgggcuuaguuuuuaguguugaucuagggugaguuuucaugcagggcuuauuuuuuuuuaauauccauaggaacuaauaccauucuuauuuuuaaaucaacuuugucaaggaaguuuacauauaauacaagguacccguuuaaguguccuuuuuuaaauuaguuuucacaaauuuauacacccguuuaaccaucaccaucauucagauacagaauauucccaucaacccucaaguucacugauuccauggagaccccaaucauggcccuggcaaccacagaucugcuuucugucaguauauuugagauuuuuucuagagauucgaacaaacggguuuguagguacugcauuguuuugugccuucuuuugcucaacauaauuucaugacuuauuuauguugcauguaucaguuguucacuucuguuggauauuguuuuguuggcuaguacucuucuaacuggugccugaaacguuuguugaaugaaugcauauaauaaauauccucuucccccaguuuugccgcuuuccuuuaucaugagacugcuaaaaccucuucuagauuuuguauguugcuagacuuaaauuuguguauagaguauuugaagagauaauagugaaaaaugugcaugauuuggagcucaguauuuguuaaaaagacuguuuucucuauuuauuuaucuuaguacccuucucuaaaaugagcugacuguauaugugaagcuuuauuucuggacucucaauucuguuucauugauugguaugccuauccuuaugccaguaucccuugauuacgaucugcaauuuugaaaacaggaauuuuugagaauccuccaacucuguucuuuuucgagauuguuuuauuaguaucugcuccaugaauuuccauaugaauuuuagaacuagcuugcuaauuucuccaaagaaaccagguggaauuuugauagaauuguguugaaacugaacaugggaugucuuucuauuuauauaguuauuuaauuucuuuuuuuuuaaucaauugaguaccaaaauagacuuuaauuucuuuuaagaauguuuuguaguuuuuaugguauguuuuguauuacuuuuguuaaacuuacaccuaaguguuuuauucucuuggaugcuucagaaauggaguuauuuucuuaauuucauuuuuggauuguucauuguuauuguauagaaaugcaauuaauuuuggcguauugauuuuguacccugcaaccuuguugcacuuguuuacuuaauuauuauaaaacauuacuauuaauaaaaucuuaaguauuaaacugcuauguaaacuguuguauauuuucaagucuccuguugacuuaucuuguaucuaguuguuguauucauuauugacauggaguauuaaaagucucccaaccacuguuguugaauuggcuauuuucucucuucaggugucaguuuuugcuucauucauuucggugcucuuuuguuagguuuauguguuuauaauaaucuuuuuaguggcuucuuuaggauuuucuuaucuaugauaucauguaaucugcaauuagagguaguuucacuucuucuuuuccaauccagaugcauucuauuuuuuuuuuuuuugccuaauuguucuggcuagaaucuuuaguacaguaugaaauagaaauggcaauucuguuuaguggacaaccuuguauuaucucugaucauauaaggaaagcauucagacuuucaccuuugaguauauaccuguguuuuuguuuuuuuuuccauggauaccuuuuaucaguuugaggauguuccuuucuauuucuaguauguugagugcuuuuauuaugaagggcuguuagauuuuuucagaugcuuuuuuuggugcaucuuuugagaugaucaugugguuguucuaauauguuguauuacauuauuuuguuuuuaugauguugaacaguucuugaauuuuugggauaaauccaacuggucauguuguauaaucccuauuuugcuguauuuguuuucugguauuuuguuguggaucuuugugccuauuuucuuucuuucuuuuuuuuuuuuuuuuuuuuuuuuuuugagacggagucuuguucuguugcccaggcuggagugcaguggcaugaucucggcucacugcaaccuccaccuccuagguucacgccauucuccugccucggccuccugaguagcugggacuacaggcgccugccaccaugcccagcuaauuuuuuuguauuuuuuaguagagacgggguuucaccauguuagccaggauggucucaaucuccugaccucguuguccuccugccucagccucccaaagugcugggauuacaggcgugagcuaccacgccuggccaguuuuugugccuauuuucauaagauauaucagucuguaguuuucauuucuugagauuucuuugauguuguuaacuggauaauaauggucuuguaaaaugaauuaggaaauguuccagguuccaaaacucuucucuguuuuagaagaguuugugaagaauugguaucaguuuuucuuaaaauugguacaauucaccagugaagcugccugggccugagauuuuuuuuuuuuuuuuaugggaaguuuuaaaauuacuaaugcaaucucuucacuuguuacagguuuauucagauugucuguuucauccuaagucaauuuugauagucugugacuuuguaagaauuugucccuucccuuuaguuauuuaauuuguuaguauucaguucacauuauuucuuuacgauccuuguuaugccuacccuacaaaguuguaguaauguacuguuucuuuccuguuuuuaguacuuugaguuuucuuuuuuuuucuuuucuuggucaguuuagcucaaaguuugucaaucucuuuaucuuuuuagauaauaaacuuuaaaaaguauuucucauuuuuuuauucucuaguucacuuauaucggcucucaucuuuauuauauccauuguuugcuuuugguuuaguuugcucaucuuuuucuagguuuuguuuuguuuuguuuuguuugagacggagucucgcucugucgcccaggcuggagugcaauggcgcaaucucggcucacugcaagcuccaccucccagguucacgccauucuccugccucagccuccgaaguagcugggacuacaggcgcccgccacuacacccggucaauuuuuuuguauuuuuuaguggagacgggguuucaccguguuagccacgauggucucgaucuccugaccucgugaucugccugccuuggccucccaaagugcugggauuauaggcgugagccacggcgcccggccuaauuacauaauuauuuuuaucagucugucaaguuugcuagcagugaauucugccaauccaucuuaaucuccaaguuuauuuugccuuauuuuuuuuuccgguuauuuguguuuuuugcgauggagucuuucucuguuacccaggcuggagugcaguggugugaucucggcucaccgcaaccucuaccucccggguucaagcacuuccccugccucagccuccagaguaucugggauuacaggcgccugccaccacaccuggcuauuuuuguauuuuuuguagagauggaguuuugccauguuggccaggcuggucuugaauuccugaccucagguaaucugucuaccucggccucucaaaguacugagauaacaggcaugagccaccacacccggccuauuuugccuuuuuugaaggaugguuuugcuggauauaaaauucuuuauugacaguuuuuucuucauuguuuugaauaugucauccuacaucuuucuggccaccauuauuucuaaugaaaaguuaguugugacaagucacuuuucucuugcugcuuucaagagucuuuuugucauuggcuuccaacguuuugugcuaugauguuucugggcaugaaucguuuuguuuacccuacuugguaacucuucuuggauguguagauuaguguuuuucuucaauuucagagguuaucagccauuauuuccugaaauauuuuucuguucuuuucucucuccuuucuucuuacucccauuacacauauguugauucacuuaauaguauccuaugcuuuuuuuuccugagguuuuguucacauuuuuuaauuaauuuuucucugaauugcacaacccuaugaaucuguugucaaauuuacauucuccuuguucuccugguucagauaugcuuuugagccccucuuauuuuugagccucugaauuuuucaguucauuuuacuuguuaacuacauaauaucucuuuuuuucuuaucucuuucuuaaagauaagacauugucacaucacacuuuccuuuacgucuuugaucaugauuuccuuaaauuauugaauauauuuuuaacgacugcuuugaagucuuuauuaagucugacaucuuggcucuuaaacaggcaguuuucguugacugcuuuuucacccuguguaugaauuacuucuauuuauuugcaugucauaauuugugggcgagaggcuggacauuuuacaugaacuuugcagcaucucuggauacugaucuuucuucuccuuugugcuuguuugcuuguuuaauggcuuggcugggcuuuuucaaugaaguuuuauauuucuugccgugugaagugccugaugucacccaugagaggguacagccuuggacaugggcaauuauauugggaugacagugauuuuaguaggaccauuuccgauugucuuuuucacuuauauauaucuguuaaaaccucugcuucuguuggugucacacccagauaugauagccuuuacuaacugcuggugacugcucuuuuguuauuaacaguucucuggagcauaaauuucuccacagugagaucaaauuaaauuuuggccccuuuguaggggcauuuuuuugaggcuagucuucaguguuuguuaugaacugcggaggucuguuccuagcuaucucucuucccaguucucuuugguacacuagcuagcccgugguuuaacuuguuccugucuuagagcuaccagcuuccuuuuaguugcuuacugcccaaaucuccauauuuuugaggguacccuuaggcuugaacuucucuacacucugucccaaauaaagucuuuucuuuuugggaggcuuuuagaguucucugcucuuaggucugcuccugcucugcagcagaaucucugagccacuaccagugggcagggugguagccucuagucuuuuuggcuuaccuaucccuguguguaaccacggucuuaugagugagauggguugaaggcaaauggggccccuguguucuaggccugucauguuuacgguagagccucugccuguguuuugaggcugguggcagaagugagggaguugaguauaagaaauucuguuggccugucuguccuggagagauacucuaacccuugacuggaaacuaggcagggagagagcccugucuugaccccaucugccaggauuagaaauuucauuaugcugagcgggcagagggaagaaaggggcaguguggcucagauacuauagauucuugcuauuucuauugagauuuaguagauuauuuaaaauaaaauaguuuuucguuugcuguauucccuuagaacacuccccagagcacugaguuuuuguuuucuuuucaagcaguuuucuccaauuauguuuuuuuucauugauugaauuuugacaauuaagucagucuuauuuucucuggauaaaccuuacuuguucguagaucuuugggcauuuuauugaauuugauuugcuaauauuuuguugagaauuuuugccuuuauauuuaugaggaauauuggucuuuaauuuuuuuuuguuuguuauuguuuucuuguuuuuaguuuugguaucaguaaugccucaaaaaugacuuaaguguuuugugucccauuuucuggaaaacaugucaaguugguauuacuucuucuuuaaguguuuugguagaguucacuaguaaaacuaccaaaccuggaguuucguuuuguuucuucucuucucuucucuucucuucucuucucuucucuucucuucucuucucuuucuuucuuuuuucuuucuuucucucuuucacugugaguucauuuguuucuguagguguaagacuucagguuuuuugaggaauaggugcauuucaucuaaguugcugauuuuauuuuuauagaguuguucugguauuauuauccuuuuaaugccuguggguucuauauuuucucuuuuauuccugauagugguaguuucugacuuuuuucuuugucagucugccuuagagguacaucaguuuuggugauuuuccuuuuaaagaauuagauuuucuguuuuguuuaauucuuuuuuucaauuucuguguuuuuuccucucaucuuuauuuauuauuuuuguuuacuuuugguuuauuuugugcccuuuuucaagguuuuugagauguaagcuuaggugauugaccugagagcuuuucaaagauaagcacuugaaauuauaaauuuccccuugaguacuaauuugguuacauccuacagauuguauguuuuauuuuuguuuucaaucaguucaaaauauuucuaaauuucccuuuauaauaccucuaugaccauggauuacuuagauaugcacaguucaauuuuuauguauuuggagauacuuuccaguuucucaugucacuuuuuaguguaauucucuuauagucagaaaauauuuguaugaauucaauucuuuuaacuuuuuuuuuuuuuuuaaaagaacuaagaugcaacuaauuugaugaauguuucauuuucuccuuuuaggaauuuguaaucuacugucguugauguuguauuauuauuauuauuauuauuuuucagacagaguucucucuuguugcccaggcuggagugcaauggcgccaucuuggcucaccacaaccuccaccucuggguggaggcugaggcaguaguucaagcgguucuccugccucagccuccccaguagcuagaauuauaggcaugcaccaccaugcccagcuaauuuuguauuuuuagcagagaugggguuucuccauguuggucagacuugccucaaacuccugaccucaggugauccgcccaccuuggccucccaaagugcugggauuacaggcgugagccacagcacccggccguugaaauuauauucuauaaaugucaauuagaucuaguugguuaaugaugguguucuguuuuucuguauccuugcugacuuuuguuuacuugcuuuauaauuacuuagaggaguauugaaauuuccaaauguaaugcuggaauggucaguuucuccuuucaggcuuauuaguuuuugguauuuuuaacuugaagcucuguuguaagugcguacacauuuaagggauauuaugucuuccugguaaguuggccuuuuuaucauuauuuaacauacauuucuuagcccugguaauauuuuuuaauugcucugaaguguacuuauucugaugguaagguagccacuccagcuucucuuuguuuacuuuuugcaugguauaucuuuuuucaccuguauguuuccuguagacagcauauagucuuuuuuuuguuuuuuuaaccauuuugacaaucucauucuuuuggacuaucuauaucuaauauaauuauuguucuauuuggauuuagauaaacccuuugcuuuuuuaaauuuucuguuuguuccauuugcuuuuucacucaugugauugauucuucuuuccugccaucuuuuggauuaucugacuacuuuuaauauugcauuuuacuuauugaguuuuuuaguauauucuuuguguauuuuuuuuuagagauuacuuuagggauuacaaugcacauucuuaacuuuucagaauuuacuuauuaugucaguuuccuggggcuccuauaauaaauugccacaaacuguagcuuaaaauaccagaaauuuauucuuucaugguucuggagguuggaagccccaaaucucaagguaucaucagggccguaaauccuuugaaggguauagagaagaaaccuuccuucuaguuuuggugguugccagcaaucguguuccuuggcuuaucccugcaucacuccagucucugccucuguuuucacauggucuucuuucucuucccacuguguuucuguacuuaaucgcuccuuucuuuugugaagacacaagucauuggauuuagggccuucauaaauccaguaugacuuccuguuaauuuggugagauuugcaaugacucuguggccaaauaaggugaaauucagagguccuggggguuaagucuugaacacaucuuuuuugaguacacaacucacugcacugcacuuauaucacuucaaguggaauguggaaaccuugucagcauguaguucccuuuacucauccccuuuuauguuguaguuucauauguauuacauuuguauacuucagauacucgucacacagugaggucacuugcuuucaacuaucaucauguuuuaaaggauuuaagaggaaaagaauagucuaucacagggauugcaaacuauggcugcaggccaagucuagccugacaucugcuuuuuguaaauaaaguuuuauuggaauacugccacauuuguuaguuuauauauugucucuggcugcuuuugcacuacaaugcagaauugauuaguuacaauggagacuguuaggcuugugaaacuugaaauauuuucuaucuggcccuuuacaaaguauuuacuaucugacccuuuacgaaaaaguuugccaacuccuggucugacauguacacacacauauuuuccauuuuuuucccauucauucauaaaacucuaaguuuucuaccgguauuauuuucauuuuguccaaagaaucuuccuuucuuuauagcaggucugcuagcaaugaauucucuuaguuucuuucauccgaaagugucuuuauuucaccuuuguuuuugaaggaugcuuuugauccauguagaauucuggguggacaguucucucgguagcaauuagcuagaguagaguagcagcaacugccuucuuuagguggucuguggaccuuccaguuugccauacuuuuugauacuuucucuugucucuuugacauugauacccacugccauucuugauauuuacuauugugccuauguggugguuuuucuuaucaaaggaucagaagaaaguaaaauuuauuuguuauuuucugagacagggucuuguucuuuuucccaggcuggagugcaguggugcagucagggcucacuugcagccuugaacuucugggcucaagugauccucccaccuuagccucccaaguaguugggacuacagggugcgugugccaucacgcucagcuuauuuaaaaaaaauuuuuuuuuuuuugguagugauggggucucacuauguugccuggucuggccucgaacucugggcucaagugauuuuuccuacuuuggcuucccaaagugcugggauuacaggugugagccaccacaccuagccagaaguaaaauuuuuacuguacuccuguuucuauguagugggaaaacaaaaucauaaguccguguuucaagaaaugugggagaaacaauaauuuuuaauggcauuuggaauguuuauacauguccgguaugcaaaaaggaucauaccuguuuucagacuugucuuuuuaaacacuugaguuggcaucuuaugcugcaacauauauuuucaaaaugcuuuaacaucucacccaucauuuucuuuuucaaaguagcacuuuuuccuguauaauuuaugucuuucccuaauaacuuuuuggcauauauuuucagugucuuugcccugucuugcuuucuuauagccaagucacaucaaaguugauuuagcccuggguugugaaucagaaaugcuggauucuguuuucucucacucugucacuaauuagcuguguguaugagaccuugaacaagguuaggccuaccagacuacaauguaucucugaaacaagguguuuaaacucaauuucgcucugaagcuuuuuuuuuuuaagcuuuuuuuuuuuuuaaggucuuuacuauucgaaguuacucucugccaacaaccuuguucaugcugugauauucucauccagagguuauuaauauuuuuuguuccaugaaccuuuuuggcucucuggugaagaauguggaccccuucucaauaauaguuuacaugugcaaaauuaaauacauaugcuuaugaggucaccaguuauauuggaguacaguuuuuaaaauauugacuaaacaaacucaguaacaugcauaucaacacgaagucuacugguauauaguauuaauaacuuuuagacuugugaugaauauaaaugauaauuugagauuugaagcaacuaaagugauaugaaaauaucugugguuucuagugguaacaaaaaucaucacaggugccucuagcaccacuguggcuuguuaccuacauuuuaaauuaaggaaauacuaaauuucaguuagagguuuguaaaauuaaagcucuagcuuuuuuaccccagccaaguuuauguaccuucugcauucagucaaaagacugaagauuuauagaaccugguuaagaauucugucuuuuccagcccaugagacauuuggcuuagugccuaauauauauuaggugaacauaaguuauguguaauacauaugaaauacauuccucagugaaaaaguauugcuaauaaagguuuuaauauuauugccauuugugaccuuguguuaauuauaauuagugcuuuauaaauccauagagaacaauuggcaaacacagaguuuuauuuacuaccuggcauauaguagggcucaguauuuuuggaaggaaguuagaagagucucugauuauuaguaucaaugauuuuugaccauuuuauuuuuaaauacuuguuucaaaaucucugguaaauuucugugugaaauaauuuguuuacuuuaguauuucuugacagggaauacagguauccccuauaaauggcaagcugcuauaguuauccuuaguauaacacaugauaaacugaaacuuaguucuuagauaaauaaagcaaacaauacguuugucugcacugccugaaaauuuugaauugcacaauuuuucaaauauucucaauucaguagcagugaaacaacacauauugagguuaaaguucuuuacauuaauaguauacuaccacuguucuuagaguagacucauaccccuacuucuuugauucuagguuuacucuaauuuuaauguuucuccuggaaauguaaguccuaaguuuuuauagggcuuuuuaguugccuucuuccuccucauaggaaaauauccauuuguuaaauaaagauauuaauauauacagaaauauguuuguaaccaauauucuuaaaccuacacuuaacugacccacucuuuuaaacaaaccauuauuuuagauucuuaguccugaguauucugagcauuuauagcuaguaaacuacucucuaguuuacccuuguacccuuuucuccaccagguuaguuauaugccuaacaagaaucaguuuuuaugccaauguuaauguaauuuuuacuuuaaaugugaucuaagugaauaaaauaugagcacagaaagauagaacuauuguuuuaaugaaaagcacggugaaugguucggaaggacuuauauaaaguucuuuacaaauugcuaaaggauuagguguggauaagcccagagguuuaggaaacuuuugguucaauugacuaaacaguauggaaaacuauuuucucacauaucuggaggaauggaagcuuuugugugguugguuaaugcagugguuuaauaauuaauuccagggucagauucuuucuguuuguucugccauugucagagugucagcuuguccacaggcuagcucucuuuaugguuacaagauggauauaguagcucuaguugugcuauucugauauaacaacaccuauuggggaaagagggucuguuuuuucuuucuuuccuagaauccuaccaucaguuuuucccuuaugucucacuagccaggauugguuuaaaugcccuuucauaaaucaauuacugacaagagggauaggauuaccaaauuggcuuacacugaucacauuuccuuuuuuuuuuuuuuuuuuuuuugagacaggguuucuugcccaggcuggagugcaguggcacaaucucagcucacugcaaccucuaccucccagguucaagcgauuuuacugcuucugccuccugagcgacugggauuacaggcacccaccaucacgccuggcuaauuuuuguauuuuuaguagagauggggugugccauguuggccagacuggucuugaacuccugaccuuaggugaucagcccgccucagccucccaaacugcuaggauuacaggcgugagccacugugcccgaccagcauuuacucuugaaccaugugggaaaguuugaauauuuggacaacuaugguggucacagauagaagggcuuuuagagugucaaccaggaguguuugcuauggugagacagcuauuaaaaaauuagaaaguauuuguuaaauuucagaaagauucugcuauuuauuugccuuuaaggucuuguucaacuuuaaacaaaauugaaacuggacaucuuaaaagaugcauuauagaugugcauuauacaaaaaaugaugugaaaaguuaauuacuaauccuacacucaaaagcuuguccuacgucagacuaucaagggggaauaaauguccauuuguauuuuaaaaguauuugauuuggcaggaacuaacuuuuaaaauuaaccuuccgguugcuggucuuuuucuuacuagacaaggugcuucugcugcaguccuuguaaggaaaaugauguuuccauaaaauuaaaguuaguaaaggauuuaguauauuucuugugcuucauuuauucaguaaaauguaucuguuauguaucacuuauuguagguacuugugauaacagugauaagcuuaauagacaagguucuucugcuuaaggaacuucagggauacagacagaaaacaaaugagaacaaaauucagacuguuggguguucagugaaggccuuucugaaaagagauagucaagcagacauguuaacgucaagaagcaguuuggcauuuggagauuugggguaagaucguugaaaaggagcagcaaauauaaaggcccuaaauugagaacugacuggauguguuugagaaacacaaagaaaggcaauauggcuaguacuuacugagauauucucacuucuuuucuuacucuuuguuuucuuaccuaucauuaguaaucacuauauugcuuauaccguuaagucuguugcuucucucaugcuucuuaauacucacaacuuuugguuaagucugcuucuaccuauacuguuccugcaucccugcaguuguguguggcuagagaacaccagccucccauggguccuuaguacuacuuggcaauucuaccuacugucguuccucuaaucccuucacucucccuuucuuagaagaccuuuuccucccuccucagaccuguaacacuuccucccauauucuuaugcucacccgauaacuucauuucuuauuuuacuaagaaaacagaaacagcugaaugagaacuuccauagcuuuuauuacuauggccuaccugaaucuguuccuguuuacuaucuuuguuucuguuucuauugaugauauaucuuugugccuaucuaaggccauucucuuauuaaugccauccacaucugcucagagucauuacuccaguaauuucucucucuccaucuuguaucaucagcauuucccucugugccauaauuuuuccugucuuuaaaaaaagccuucugucaacgcuaaauuuuuucagcuauuaccauuuuucacuuuuauggcaaaacuucuugaaaaugaugucuguacuuugucuccaguuucucucuuccuguucucuugugaauccagucuaguuaguacauuuauuucaccaaagcuaucuacgaagauuaccaaguaggugaucuccaugcugcaauccaaagauuaauucucaucuuuuuuuuuuagucaacagcauuuugaaacaguugauuacauucuuccuugaaccacuuauuccaguuaacuuucaagauaucuaccauacucucuuugguuuucaucucccucgcuggcugcuccuucucuaaaccaugaacuagaccaugcagauauauuauuuucauuuauaauaggaaauuaaaucacacagaagcuaagcaacuuguguaaacagauguacuuuucgggcagcaggaagacuagaaacagccccuguugucugaauuucagaccccaguuuuauuuaagcccauaucaaaugaagagcuuuuaauuuucaagccugugguucagaaauuauugaacuuuugucguuuaagaucaguaggauucccuuuauaaguauucacuucauuugaaacuuuuaagccacaguagaagaaaauuucugucucgagauggugggccuuuuagauagaccugacucucuacuuauaguaaauuuuguguaucagauguguagaauccuccuuggaguauggaugugagacaacuguacaguugaguuaaaaguaguaccacuguggaaaauggaagacacauacaacauuguuauaaaacauuaugacaaccagagagcaaauucauuucaauagauuauuguuaaguuguauuuguuuuucuuuguagauauaggcaacuuuucauuuuacaugcuaauuauaggucugugaaacccauauuacuaaaauacucagagaaacuguucuuaguuaauauggcaauuuucccagaccagguaugguauucuugaguuuuauuuauuuuuauuucacugaaauucuugaguuuuauuuauauuuauuucaucuguccaucaacucagaauuuuuaaaacauccaugugaucaagcaaaaaauuaguucauaagggcaaggaaauauuuaugugacugcagucuaccuauuaagaaaacauugcuugauguaguucuagaauuugaggaacccuuauuuuaaagauaauggcuaaaugcauuuacugcauguuuuauugagcuccagugaaaucggucacaucuuguaguuuguccuaauuaauagccaccccagaauguaaugucuucuguuaaaaaaagagaaaaccuguucagcugguucagcugucuuaaccuaaccaaauucauauuuuaacuuugaguaugguaaugacuaccaaauuacagauauuuuagauacuauuuucagcuucuaaaagguuugggcauuguuuaaauacuauugaguaaugaagugggaugaggggaacauggggaagguuuuuuaaaaaguuuaaaagaagaaaaaguuaaaaaagauucaucuaagucauuuuauuuuauagcuuaggaaacuaaggccagagagaaguaauugaucuauuuuuuggguuuguaauuuugccuuuuccauaaugucauauuaauggaauuguucaacguguggccuuuggggucugguuuguuuccuguaauguagcaaaaaugcacuuaagauucauccaucuugcaugaauuaacagcuucuuccauuuuguuguugagaguauucuguuguguagauacucuguuuauccauucaccuauuaaaggacaucacgucuucacuggaaugaaguacaucuucauacauguacugguuuuggugugaaccuguuuucaguuuauacugguaaauaacuuuggggcauaguugcugaguuguaugguaagcuuguguuuaccuuuauaagaaacugccuaaccuucuaacauggcuguacuuaccuucauuuuugaaagauauuuuagcugggcuuagaauucuuuguagauaguuuucuuuucuuuucuauacuuuaaauauauugaaccacucuccucugauuugcauuguuucugaugagaagucugaugucauuccuaccuuuguuacucuauguauuuuuuuccccugcuuuaagauucuuguuuauugcuguuuugcagcuauuuuacucugagauguugugaucaugugguuuuguuuuuguuauucucuuuagagguuguugaauuuggaucuguggguuuauagugcucaucaaauauauuuaaaaaauuuaguuccaguuuccccuccuugugcuucagccucaaaacuacaggcagugagcuggguguacuacguuuguucuuuuucuugacgaucucuguccugagaagauuguugugugaugucuggaaaccauuguuucauauauuuugucuaguuuucuguuuauuuaagguagaaggguaaacauagccuccuuuuuucaucaugaaauacauccuugccuuauagaaaauuucauuguaguuuugcaaauauuugucuuuucugaauucuugaauauaggacuuggugggagaacaguguauaaaccuuaauaaauuuuggcaccuagggugcaugcugucucucauacuuguuccuuuucacagauugugucucucuuugacguauuguacauccuuucauuuccaauaugaagguuaucaacagaauuuauugcugaauauuuuuauuuaauauaguacagugaagauaguggugacagauguuaacuuuucauguuuauuuggaagaaaauacagugucuucagucauuuuucuuuuuuguuuauuaaaaggagauaaugauucuuaguucacuauagaauauuagcucccacauugauuagaguauauaauggcuauggauugaaacuccaggccaugaaauauuuccaguuauccccagaagaggaaacaaagcaaauaauaaauagauuuucccuuuauacaaaaauccauaauucuucaaagugaacuuguaucugguaaauucuuacagauuaaauauuaauacguauuguugugguguuagccuauaaauuucagucauuauuuuuuguauauaauuagguuguauuaaagauguauacagcauuaggguauugaaaauuaucuuaccugauuauagauuuccaacauucuuuugcugacauuaauauaauuggagguaauucguagacccuaaauauuauauaagaaggaaaacauuuuauucuauaaguacugacugaaauuuugcauuuauuauccacugaauucagagucaccauguauguauuaaugguaaggcauguacuacuuuacaauuuaauauuauacaacacuaauauuaaaacgguuaauauuuaggggaugcauaauaaaauaaucuugcuuucuuuuugugacaaucgugaaaauuugaguuggagccaaaugugcgucauuuaacaauuccugaauauccaauucauuuguaacuuuccuuaugaauaaccucauugcuugcuaaaugauaaagauuacauuuauaauaguaaauaugcuuuaaaacuuuacuccuuuguuauuuuugaaagagauauuuaauuccaaagguauuuauaaauuugguaaucaauaauuacaauuuugucauacagccugacugaaguauuuuggcuaaacguacacuguaagauagucagacuuaaguaaaaauacaacucccacuaccuuugugaugaaacauaaaagaggagccagaagauagguuuuugucaccuggguucuuuuuaaaacuuaaauuuaguaauauucauuuuuaauuuuuuuuuaaauguucugcccguauagauugcuuuuuagagguacuccauauauauguguacauguguguuuguugguuuuaauaauucuaauucacucuccuuauaaauuauagauuagauguuaucuccucacaaaauguuuguugauauuaaauaauagcucugaauuugaauaccaauguuuaguggcuagcaagauuauuaguucaguagguaugcauacuacuuccuuagggagaaugcuuaacaaaacuuagguaagagauaucugucuugaaaaugcauauuuacaaauucuuuguagacccaccuuugaauauuugaacucucauuuucaauauucauuuuaaagacagcauuucuugugacugucaccucagcuucagugcuuuuuuuauuuuuauuuuuuauuuuuuggugggaggugguaccuggagugcaagucauuuugacuuauuuauaucucugcaguuuaagaaaucauccccauuauuuuuucgcccaauguaaaaaagugaauucccuauuggaguaugcaugaaauuggaugacugaaagacaaaagcaucaaaggaaguugacauuuuuugcucuucuuuuuggaguaaaguuuaauagauuauugaguuauguuuguaucucuuaaucguguuaagaauauauguugcauucucauuuuguugcaugggaauaaaccuacacagaaugaaucgguagcugugugaauaacuuguauuucuaucuaucauauauaaucauuuggaggggaaggauuuauaguuaaaugauugaaugugaauuguauauuuuugagauaacuggagaagauucauguaaaagaaaaaaauaugucaguugugggagggguaaacuuuuuuguccacuucauuuuuuauucacuguaaauuucucccuugugugugaugucuggcagacagucuuaauugaagaaaguagaaguggguaggaagaauguuucauauuuaauaauuucuguugcaaauaaaguaugccagucuagcccgcgaaaaugguuacgaggaagacuagaguauagaacaauuacuuuuuguuuuuuguuuucuguguaucauauugaauauuuuugcugcuguugauauauuuacauguuaguaauuuugauggcuuuuggauaauuccacucuagagggagacguggugggcgguccuuccugugacacgacccuugagugacaguucuauuugauugccuccgguacugugaggaaaggacacgacucuauggugaggacugauggacauacauuaucugagaaaagaaacuaccagguaagaccagucuuucuucuuuuuucucuauuggucuuauagcuacauugaaacuguucaaauguguuauauguaauuggaaccagcaaauugguuacaccucaauuugaaaauuuggguuuauaauuuuaaauuaaguacuggauuugauaguugaaauaguugggaacacuuuucaaaauaaagcauauucauaauguauauuuuuuagugucaaaucagguuuucugagauauuugucaaaacuuagauuauuugauauacaaguuaugacuucaugacugaauucaaaaugguaaaaacaaaaguguugauugcuuuuacguauauuauuccuggaagacuaaacccgaagucuugugcuauauuuuggauaacaaaguauauaucacagaaauguagacaaaauugaguagaguauagaagaaauagaaaugagaaacccagggugcuuagagacccaaauucuauugaauuuguuauuaguuugcuguccuuaaaugcuagauucuuguuuucucauuuaauaaggugguuaauaauauucauuccuuauucaguguguaggaaggcuggaagaauaguggaaauguaacauugcuauuucugagcuuugaaaagaaggugaauuuuaaagauugugcuauuaaacagugauuuaaagaaaaccaacauauuugaauuuaguuuuuuaaaggaaauauccuuuauucauuugauagugaucuguuaucacauuuauuuaguuauccagaauacagaauacuuuaaaguuugaguacaaauaaacuuuuaggcuuccugcacagauauguguccaaccuccccaccucccacacuuccuuucacucaucaguucauucccucuagguugugaaggcagcuaguaugauagcagcagcuuugguuaacuaacuguuuaucugcuaaccauuuauuuuagcccaguuaaucuuuucuucccucaaauuggaaaaguuagcaguggagcaaauuguaaauuagucuuuuugguguaugguauaacaaagaggcuuugauuauaagaucuggguucugguuuaggcacuguuccuaauuaaaaauaaugucauauuuaaccuuucuagaauuucuucuaacuugguaucuaaaguuucuugccagaucuuuaugauuuuaauaagccagagaaaacugaggguaugcugaaucaguuuucucuguaaccuuucuucugaguuguccucauagacuugaccaacauagccuuugcuaaugaucuguacucagguguagcuccugcuucccacccacuuccaauuaccuugacucauaagauuuuaauuggucacacuucuuggacuucugcaucuuuugguagguucugccaaauuauuuuaagaauuuugugauucugaauuauauggcuuuucagugcucauaauccaauuuguaaagugugaauguagaauuuuuaugugauuacacacuauaguuaauuugucucauggaaccacauuaauauagaauuccaaaauuuauacuuaagaaagaaaacagaauuauguuuuauacaugaagagauuugcuuauucuugcucuuucuacacuaaaaguacuccauuguuucagucauauuauuuacaaauaauccagguuuuugagcauaccuggaaaaugcauuuuugguuauggguuugcugccucaaaauguuuucccuuuucucucuucguuuauugauacauaauuguacguauuuaugggguacaugugguauuuuguuacauguauagaaugucuauauaagaauguaugggaaauucaaaggaauguucaucacuaaaguaacauuuauauuuguacugguagucuaagaauuuuuauauucuuaauauauucaucauaauaccaaacaggaaauuuuguuucuauacaugugcuuuucagaguaggguucaaaaauaaaauaauuuuacaauccagcuuuaaacagcuguuuccaagguauacuucaauaugcauuuagcaucacuaaguaaaaacaaaagagaaaagggacauagagggauaaauucuaauguuccauagcagaguagggugacuauaauuaacaagaagguauuguauauuucaaaauagcuagaagagagaacuuaaaucuuccgaauugaugaaaaugauuuuggauuuuuaaaaauucuacuuuggaggaaauuuauguauuuuucauagauaaaguagaauuucuuugugucuauguuuauaaccauuuucauuuaucuuugagggcuuuugcuuuugagggacacuuaauauuuuauauuuauuugaacauucugauaauaggcuaauauugaagaguuuaacaagaauuuuuguaaaauuuauccaggucucauuuccuuacagaccugauuaaagccuuaggaauuaaguuuaggaaggugcauucccuuggcucuauacuaaagauagugacuuuuaaaugggcuugguuugaaguauugauuuuuauggugguaucuacuuuguguguuuucuuucuuacuauaaguuuaagcccaguuagguauuuggaguuugaauacaguagcugaaguuuauuugcagagauagacuggcauauuaguucagauaaaacaauuuauuauauggcucaugguucauuuuuggauugucaagcuuuuuccaaggaaaugcaccuucaguuuuuguaaccauuuucuuaucuuccucuaauuuagacuaacuuacccuagcuaugagcaugcacaugcacaaauguaaaccaucuuaauuaccaauuuaacuaaucaauggcuuucccuuuuuuuuuuuuuuucuuuuuuuuugagacggacucuugcucugucacccaggcuggagugcaguggugcgcucacugcaaccuccgccuccuggguucaagcgauucuccugccucagucuccugaguagcugggauuacaggcgugcgccaccacacccagcuaauuuuuguauuuuuaguagagauggaguuucaccauguuggucaggcuggccucgaacuccugaccucgugaucugcccgccuuggccucugaaagugcugggauuacaggcgugagccaccggugcccgauccggcuuucccuuuguuacauaacauauucaagcuucuaaacauuaccuuuagacuuuccaaauucuggccuccuuacauccauuuaccuuuccaauauaucuccuguuacuuuuuguaguagauuuucccauuuaauaauacaacacugcuuuuaaucucccugccaugcaguuucacacccacagggguuuacuuauauugguuauuuucauguaaugccucaccuuuguucacaugauucaagaauuaaguaucaguuuuuccagacgucacccuaugguagauucaguguuccuuucccuuucuuucauagccuuuacauacuucuaguuuaguguuuaccauaauacauuguaguuguguuuauuuguccuugucuuccuauagacuugugcaguccaaugccguaggaacuagucacaaguagcuauuuaaauuuaaacucauuuaaauuaaauaaauuuaaacucauuuaaauuaaauaaauuuuaaaguucauuggucacauuaaccacauuucaaaugcucaguggcuacaugcugcuaauggcuacuguauugaacaguguagauacagaacauuucuaucauugcagaaaaucguauuagauaauacugcuguaucuaauaagcuucuugaaaacugggaccguaucuguuuauuuugguacugccaauaccuagcuuggugcuugguauguagauagguguucaaugcauguuguuccaauaaaauuaaauaaaacagugaaagaagggaaaggaagaaauggaaaguauacuggguaacauaccaguguaagugguaugggaagguagagguauuugcaagauauuuagauguuacuuugaauggaacuuuucaguaugaggucauuggucacaucauaugcuagcuaauucaaugcauuaucuacaaacugggucuaaugcauccuauuccguacguuucugaagaaugauucauaaucuaaaacauuguauuuuuguggaauauaguaugucagagaacuguaaaaaugauuguauugccauuuucuuccccaacauuaaauaucuuacuuccuuuuaauuaacuuuaaaaaucacagaugccuauuaccaaaacguugaagaaaaauacggaauauaaaauacagugugaaaguuugccuugacaacuuuacucuuaacaguuugguguguaccucuucagaucuuuacuagugacuauauaguguagaugugauucauugucuuugucucuaacaaauguguauuuuucugcauuguacuuaauggagcuauuuccguuucccauucuuuccucugcccucuuccccagaaguaaucaauaguuuuaauuuuguguuucauucuuuauauuuuuauaacuuauuacauauauguuuuucaguauauugagguacaucuuuuuuauguauuguguggcaauuuuuuggaaaguggugccccauauuuuauuauuuugaguaggaaaaaucauaauuuccagcccacuuaagacccuaaacaauuuccuagauauagcuaaaguacucaacaccuacuugauaauucaccaaggauuucugcauaauacagaguauuuaaaauacaaacuacuuaauauaaacagaaacaaaugaaucacuaaguauauuuccauuuaguauguacuguauucagauaauacuuuuucuuuuauacugcaauaaaauuguaauuguaaauaaacaguuaaguguauuuccuuucuuuuauuguuaaguggcacauuauugaacauguuucucucucugaagucaggaugcaucuuacagcugauggugacuucaagucauaguugugacaaacaguaccagcaccaaagcaucuuagaaucuaugauauauaguauguuaaagauauauaaugaauauaaagaacacuuaauaaaauaaaaucauagcugaguguagugcugugcaccuguaguccuagcuacuggagaggcugaggcgggagauuagcuugagccccagaguuugaggcugcagugagcuaucaucacaccacugcacuccagccugugugacagagcaagacccucagucagucgauugauagauagauagauagauagauagauagauagauagauagaauuuuauuaaauuaauacuuaacaauugaaaaguugucagaucuggugcccagagaagaaaaauugaguuuguaguuauuauugcugcuugguguuaggugaagaugaauaagagcgaccuaaugaaagaaugaguuuaaaaaaaaaaaaaaaaaaaaggaaaaaagccugaauccaaugaauugguucaguuuccucuucuuugcucuugaaagccuugcaaccagauggcugugacauguuaucacuagccagagauaaaguaaagggguagaaugacuuuuuaugugcccuuuacuugcauuuauacagcugcuuaagaugaaguugcucuuauaauuacauuuuugauugugaaagcucuguucaugucaugaucacaugaucagcaacggaagucacuuugacuucaugauguaaauuuuuuuuuuuuuuuuuuuuuuugagauggaguuucgcucuuguugcccaggcuggagugcaguggcgcgaucgcuggagugcucaccacaaccucugucuccuggguugaagcgauucuccugccucagccuccugaguagcugggauuacaggcaugugccaccaugcccagcuaauuguguauuuguuuuuugguagagacagaguuucuccauguuggucaggcuggucucgaacuccugaccugaggugauccaucugccucgaccucccaaugugcugggauuauaggugugauccacuaugcccagcuuuuuuuuuuuucuuuuugagacagggucucacucugucacccaggcuggagugcaguggcaccaucuccgcucacugcaaccucugccaccuggguucaagcaauuuucgugccucagccucccaaguaguuagaacuaccuacacgcaccaccacauccgacuaauuuuuguauuuuucgguagauacaggauuuuaccauguuggccacgcuagucucaaacuccugaccucaggugaucucccugccuuggccuccccaaaguguuggaauuacaggcaugagccacugugccgaccuaaucuaaauuuuuaaaaauaaaauuugaccuuuuuuuuuuuuuuuuuuuggcauucauggcuucucuuuguccucuuucucaggccaaccaguaaugucaaaucaaguuaaaugaauucccaaguuccucauugguuggcucauugccgugugaugcuaaguguuaaccuuucuuugaaugcauuauacguucugauacuuuuuuuauuaucaucugaaaucaucaaauaaggugacauuuguuuuccaaaaaauaaguuucaccaagacaccugguuuauagcacccuuagugaauugguaauuuuuucauagugcccuugggccaaaagaaacucugcuaaauaaguaauuagguccaaaucacuuauauucauaugauuaucugauagauauugcuguauuuccuaagaagauauaaaauaucuaguagcaccccuguguguucgcucugguguuccuuuuggcaacguaugacguagacuuuauauaugaaauaugaaguguucucuuucagaaaaauaguuuacauuuaagugguuugccuuaaucaugaaugugaaauguguacucauuaaaucaaaaguuaagacauuaaugcggauauuucugugaaucagagaaaauacagaagcaagcaaaguuauguuuugauuuuguuuuuguuuuuguuuuuuuuuuuuagacgaacucuugcucuguugcccaggcuggagugcaguggccugaucucggcucaccgcaagcucugccucccagguuuaugccauucuccugccucagccuccugaguagcugggacuaaggugcccaccacgacgccuggcuaauuuuuuguauuuuuuuuuuuuuaguaaagacgggguuucaccguguuagccaggauggucucgaucuccugacuucaugauccgccugccuuggccucccaaagugcuuggauuacaggcgugagccaccgcaccuggccgcaaaguuaucuuuuaagagguuaucuuaggucuugcguggagucuaggaugauagcacugaugguggcagguuaguuuuuuguuuuuuuuuuuaaaucuuucugaauuuccacauaaaaauagaaccagcuagacagcaaaacuaaaacucgugaaacauaacagaacuucuugacaaaguguccccaugaaccccaauauaagcagaugagaacuaagaaaaagaccuacaguuuucaguuuuuaugcauaaaaugagacccauugggaugucugauggaccugagaguggaggcacccaauguagucaacagguauucacugguaaguacaauuagccaguuugaaauugggagagauuuugucaaccucauaaggugagugaggaacccaugguaaggcuaaagugauuggagcagcuuagcucucugaccucuugagagugacccaccaguguguccuucuaggauuccacugaggagaggaauuaaaauugagcaggaaagggacaacagugacauuggaaagagaagguccagauaaaaaugggagaggggagcagaaccaggaaaucucaguaaauaagcgaucauauuuucaaacacuaugugaaaauaacagaagagagaacuuuaugacguuagagaaguuuaucugaacaaagcaguauucuaaaacuucaggaagauuacauuccuaagaggucuucuaggaauguauuugggaguguuuauaccaauuuugagccccaucaguaguccucauauucaucugacauuugauaauuucagaauuaaaauuuuuuuccaucuauugagguuguguuugagauauauugagauauucuucauagucuuuuaaaaaagauuuuuuguuuugucuuccauauuuaaucuaccugaaauugauuuuuguacaugguguuagaaguacaguuuccuuuccccugcaccuaaauuaucauauuagcauuguguaccaauuuauucuaaccuccuuaacuauucaguagugcuagcucuauuguaaaucaaguuucucuuuauaugcauggauuucuuaugucucuguuaccuugauguguuugucugugccuauaccaauaucauguuuucuuaaauacuaaagcuuuguguuaaaucuucaugucugucugucaaccuuuuucuucauaagagucuugacuuggccuuuugcucugugacaaauuuagaauauucaugagaaugcuccccuccaacacaaaaagaaguauugaguuuguaaguggaauugcauugacuuuaguuuucuuuguggaagaaucgauaaguuuauguauucuuucauguuuucucucaaaguuuuauauuuuuuucauaagggacuuagaaaucuuuaguccaauuuaugacuacuuuuguugcuuuucuugguuguaaauuaaaaaaaaauuuuuaguuauagguguuauugaaauauaguugacuuuuaaaauugauuuuuguaucucaauguugcuaaacuuuuuaauuuuuauaauuuaucuguaggcuuuuugggggguucauauaaguaaacacauccuuuggaaaugacaguuuugaaauugucaccaguuuugaaguugucaucauuaaauaauauuugauacaggauuuuuuuuauagauauacuuuaucaggguaaagaaauuguucauaaugcuaccuuauauauuuuuuuccucuguagcaucuuuuucuucuuaagguuguuuacuaugugcguuuuccccuuauuuggucagacuuacuagugauucgucaguuuuacuaggggucaaauuuuagccuuuauuuauuucuaaaauuuaauuuuguuuucuauucaucaguguucuuuaauguuuuccuuucacuucuuaggguuuguuauacuguucuuuaaucuuacguuuuuaauuuuccagguaauuaucagguuugucuaguuaucuuuuuguugcugauuucucauauaauuccauuuugguucaagaauguggucuguaugauacaauuauuuguuuauguguuugaacaaaauguauauuaaccaaauuggcagguguauugcuuuguuucucuccauuagaucaaguguuaaucuuauuauguacaucuuauguauccauauaaucauuuaucccuuuguuuagaucuagauuccaauauaucuuauuucuuuaauuauuuuauaaauuuuuguguuuagccugugauaaauccaacaauuggaaguugucacauauuaugcuaauguuuuuguuucugcugguucucauugugccuuguuuccuuguguguauauuaagcuaucauuucauguuucuuagaacucugggaauucuuugagcacuggguagaaggggacauuucucccaaggggauuuucacuuguuuuugcuaagacccuaaggcacuaccaauccagaaccaauuccaaauaaaauauuagcuugagguugcaguccacauaggcaaugugaauuuaugcuuuuuuguggcuauaaauuuucagagcauuccuucaccacuuuuugcuuaccauaaauaacaggaacaucaagauuuuuugcuguccucuuuacuaagggguuauuacaauuaugguguagcucuuuuuuuuuuuuuuuuuuuuuuuugaaacggaguuucgcucuuguugccuaggcuggagugcaaugguacgaucuuggcucacugcaaccucugccugccugguucaagcaauucuccugccucagccucccaaguagcugggauuacaggcaccugccaccauguucagcuaauuuuuuuuguauuuuuaguauggaugagguuucaccacauuggccaggcuggucuccaacuccugaccucaggugauccaccuaccucggccugggauuacagugcugggauuacaggcaugagccaccgcucucagccaggguguaacauuuuaagguacaugauuuauaaaaagcuuuuuuaaauagcuucuccuuuagggauauaagcuuguggcuucucuggaauucuagcuuuuacucucauuuaaggguguugaauuucccuuccucccuugcagguucagcuguacacuuaaaaauguaaccucuguuaguguuuauuuuguucauugcuguauccucaccugagaauaaugucuggcauguaguaaguauuguugauuggauaaaguuaguauuuuauggagugauuuuaguuguuauuuaguggggcauucuggguucuuaguuguacuaccaaacaacaucuauuuuaauuauucuuuagaucucagcugaaaucucacuuccuaagggaaacauuuucugcuuagacuucuguuacauuuucucauuguucaugguaauuuuagggauggugguaauguuauuucugcguuuuauuaucauucauaauggaauagguuuguugacucuuuuucucuuuuucuucccaucuuuuccuguuuuuacuucuuaucccuuucuucucuccuuucgcuuuuuuuuuauucccucccuugcccugcuuuauuuucuugcucacuucucuuccuuuuuucuuucuucccuucuuucuucauaauauuuuucuucuaccuaaaggauuaaaaaauuuuuuuucuaaggcacuucuaguggugaugaauuauuuuagguuuuguuugaaaagucuuuauuucaccuuuauuuguaaauauacuuucacugagucugaaguucaaaauugacggguuuuuugcuuuuagaauuuuuuaaaugaugauucgcugucuucuuauuuccuaugaaaagucugcugucauucuuauguuuagucuuguguguauaauauaccuuuuucucucuggcuaauauuaagauuuuuaaauuugucacuuauuuuacacagcuugauuaaggucuaugucgguauaauuuuuuuuaugagucuuacacgugggauuuguugagcuucuugaauuuguauguuuauacaaauuuaggaauuuuuuucauccauuauuuauuugaauauauucucugucuucacuguccuuugaggacuccaauuacgcauauaccuaauugccuggaguugucccauagcuuacugaugcuuuguucauuuuuuucuuucuuuuuuucucaccaugcuuuaguuaggauaguuuuuauuacuguuuuuuuaaguuugcuaaucuuuucuucagcaugccaauuauucugccuucuuuuacauacaaaauguaauuauaacuccuugcauaucauugucuacuaauucuguuacucauguuuacuaauagaaacuaugucuguuucuauugaguguugguuuuuuuuuccuccucauuaucuguucucuuuuagggcuucuuugcauggcuggugauuuuugcuuggaugccagucuuuggaaacuuuaucuuguugagugcuauauaauguuuguauuucuguuaauauucuuuagauuucuugugguugcaguuaaguuacuuauaauagaagccauuugaucuuugagacauccuuuucuuuuuuuucuuuuuuuuaggucuuguuuaacagaaccagaguaaucuuuaggguuaauuuucuuccaacuacuuaagcaauucuuuucugaauuauguaaauuauguuuuucuacucuggcucauaggaaaauaaaugauucccagcccugucugggcccuggggauuguuuucucuguuucuuucagguggccuuuuuuuuuuguuuuuuuuagcuucugguaguuuccuuccaugcaugugcuaaucaguacuuagcugaaaucucagaggaacccucugcauauuuucagagaucuuucucugugccagucauucuuguuuaguaucccagccuauucuggcugccuuuaauugcccucuucuccacuuccucaauucacaaagauugcugggcuccaccaaucuggaaucccucucccucacugcacacugaaaauucuuucagucuuauaagcaaggguaguuguugagcccucaaugauucuuucucuggucucaaggauuauuguccugcacggccugauauccugugucugaaaucaauuguuuaauauauuuuguccauuuucaaguuguuuuaggugggcugcugcuacaacuaauacuaccacacuacucucucgguuggaagugaaagucuuaauguuucauuuuuuaaaauuauuuuuucuuauuaaaauuuuuuuuauagagacagggucucacuauguugcccaggcuugucaagugauccucccaccucagccucucaagaugcugggauuacaggugugagccacugcacccuuauuucauuuuuaaaaacuauauuuugguugagaagaugaaugaaaaccaucccugauaaagagaauaagcuuuugugucaauauucagauaaggcuuggaugcuuucucuuguauaaaauacuauacagugugcaauauacacaaauuucagaccauuucucagcauuuaaggucauuuagaaugaaaaauaaaacaguacaggucaguaaaugaauuccaguucuuauguagaauugucauaguccugauucaauuuaacuuaaaaauuggacuguuuccucugaauuuccugauucccuuaagauucccuagaauccaguaggcccauagauacaguggucauucauuuucucagcugucagguaaaaauuuuaccaauaagcauuucuuacuuuaaaaaaaucuguguuguauagcauaaaauaguauauuaucucuguauuguuuuaucuggaucaguaaauuaaagacauuauaauaaaugugcuaaugaaaauauaagauguuuucaaggaaaaaggaaagacccuuauuagggccaaaaaugcuaccggcacaugaaauuuuacaccuauucuuuucuaccaaggcacuuuucuaaaggcacugugauaaaacuaaaacaaaugugcuugguagagugaagagccuuuaguuugagccacuagucuucacauucuaccugaaucacuuggguccauuuauguaaagucuuugacaccguguucauaguuaacagugaaaccuuuaaaagauuugguuugcuuuguuaaagcauuuccauuaaauagagaaggaaaguagaaaauuaccauuaaaacaccaugguaggccaggcgugguggcucacgccucuaaucccagcacuuugggaggcugaggcgggcagaucaccaggucaggagaucgagaccagccuggcuaacacggugaaaccccaucucuacuaaaaauacaaaaaauuagccaggcgugguggcgggcaccuguagucccagcuacuugggaggcugaggcaggagaauggcgugaaccagggaggcggaguuugcagugagccgagaucgugccacugcacuccagucugggcgacagagugagacuccgucucaaaaaaacaaaacaaaacaacaccacgguaauagauacugcgagcaauauucacggaugaaugcuauaaggaguggacagaaauguaagggcagacagguauuugcauguucucacaguacuccaaaacauuucuuauuuaaaaagagaaaacuaguaguuuacaguggagaaaacuuccagaugcaccacuucaccuguaauaagacauauuaacaucauaugcacucauauauuggaauauaugcaucacauaugaugcacuugagaagacuacaucagcucuguggugauguggcuuucagaaugcauaacuucagucuaaugagaaaacaucugacaaaccccaacugugggacauucugcaguguguaugauauaacaucaauauuaugaaagaagaaagacuaggauaagucucggauuggagaagacuaaggaaauguaaaacuaaauguaaggggugggggacaaaguguuguaauuuuaaauacacaaggaauuccuuacugagaugacuucacaccugaaguaggugaaguaggaagccaucuggaugucuagaggaagagcauuccuggaggauaacaaaggcaagggcuuggagacaggaguauguccgauguguuugaggaauagcaaggaggccaguauggcaggagcacaugaagagaaggggagaaugcuaacaggggagauuagagauaacaaagaguaaggucaugaaggccuuggaggccuugguaauggugcaggaguccauuguaaauguguuucaccucuauuccguuugauuucugauguucuuuuauucugagccugaaggggauaaaguguauaaguauaaaauguaauaccuaacaucuagcacuguguguaguagaugcuaacucagugauuauugaauuaguguacauggugagauguuuagaaacauuuuaaagaucaugucuucccuugcuaaaggaauacuuuucauuuuuaauuacuuccuguaacauaaauuaggauucugauaccucuguauauuuuuaaaauguaaagguuuuaaaauaauuugucaccuucaauaauaucuauuuaugcuauugaacagaugucuuaaauaagcuucuauuuuuauuaguuuuaguauuuguaauagaguuuauuuuucuuugaaaauaacucacuuuuuauauuuucaaggauucaacauuuuuguaaaagugaauugauuucauaucuuuuuuuuuuuuuuuugagauagaguuuugcucuuaucacccaggcuggagugcaguggcacgaucuaaacucaaugcacccucuaccuccuggguucaagagauucuccugccuccgccucccgaguagcugggguuacaggcaugugccaccaugcccggcuaauuuuguauuuuuaauagagaaggguuucuccauguuggucaggcuggucucaaacucccgaccucaggugaucugcccgccucagccucccaaagugcugggauuacaggcaugagccacugugucuggccuggauuucauaucuuauuuaaauccuauauucagauuguuuuguuuuaaaaucuuaaaauuuuucucuuuauuaucuuguuugguuaaagugccagguuuuuuuugauggagggguccuuauuuguuuuuaucagcauggagcaguuaagaaauucacuuuuucccaaggauuguacuuauaucagaguuauguguagguuuuaaaaguucacugguccaccuuuacgaauuuuaaguacauccauauaguacaacuuuaauucugcuuguugaugguguuaauguguaugagagccuuagauuuaauguugaguacucaagagagcaagagaguguacaaggaguggauaggcacaaaguauuugaacacacugucuuacauguuuucauaauggccagguaagcucugucuuugcauuuucuggaaaagugugcaaguuuguggugagcacugcuuuuuuuuuuuuuuuuuuuuuuuuuuaaacuuaguacuuugaauuagucugaaagaugaaucuggguuuggccaguaaugaagaggugaacagggagucauaauguugaaacuggacauucagaucuuuauagcaugauuuccuuauuuuucaaagagcggaagaaucccaucguuuaucauguucugguuggacuuucuuacuguuugcuggaguugaacuucagagcuauggcgucaacccugcuguaauaucucaggggagcuccuaggguggggcuggugccauggcucacccuccaaccuuuccuucuucacuucagccuccagcucugagcuuuccaauccccagaguagcaaauguugaaagaaguugcacagguaaguaugugguggggaaagccgggggaaaaaugguacugucaucaguauuuugaggguggauguugggccauuuuaucaaugagucauuuuguuaguuuagaaauauaauguuuguuaucaauuauuuuucucauaaaacucauaaauuauuuaaaaaauagugaagaaauaauuuuaauucuuguuagaugugaaauaagaaaaaaaccuuaauaaacuauuaauauuauaaugcaaaggaagguucuuacauuuuuuuaaacuuuauauucuccacaguguauauagcagguccagaaaacccauguucaaaaaagaagcuaaaaaaaaaguuggggaaggccuaaguccauagacuauaauuuugccauauguaacuuggucucaggaggaggcaaguuuuaguuuucuuccacuagcuuuagaugugcuauuuuuuccugagguauuaggcagguagcuauguuuuaaucuuuacagaaauagaaauuucaaacaucuuuuuccuugaagucuugacaggaggacuggaacauuucuaccaaucucuagguuugaaguuaacaaaaauaaguauagauaucugguacguaauucagcaaauguuuguugaacgaaugaauaaacucaucagauccugugucgugugugugugugugagagagagagagagaugccaacacuccuggcauuuucuccuugucugccuugcacuggaaaucaugaucuaaacaucacagauuuaauuuuguagggauguagcucugggucuucacuaccuuacuuuugagcuucuucucagaaagcuuucaaaacguguuucuuucguucuccuacaucuaucccauauaauucauguucauugauuuauagauuuuugcacauacaagacauucacauuaaacccaagaaaaacagacucuuaagauggcccaugguugcuaaguuucuucagagaaaguaugugaggguuaaaagagauugggguucuaguguauuugguauuucaggucucaaaacaagucaucaaaauacagacuucccagcaguuugucucccuuuuuuucuugaguuuuuuagauaacuggacgcucuauauaaacacaucucccucagcaaaguacaucccguuuuuuucucaauauguauucauauucccuuccuuccucccucuuuaucagacccaucuuugccuaccgucuuuuaaggauuuaaaauauucucauuagaagauuuuccuucuguaugcauagaggauuuguuuuuauucuaaauguagagauuuucuacuguuauauguccuuccauuuguauuuuauaguuuuacauccuaauauuuaaagauaaaguacuacuuuaauuuuaggcucuauuaugugaguucucaacuccaacuucuuacugcucauaagagguacuaauuauauuuaguucuuuaguauauguguacuuuuuuccuauggauuagcacuuuuugaauaauuagaauuuugguuuuaggaugaugcacuuagcuuuuaaagcuuauauauuaauuguucaaaugugaaucuauauaaagcauauuggugcagcacauuuuaagauucuagaaaaccacaaaaucuguuuauucauguugaaacauacagaacauauucucccuagaucagagucaaacuuguggagguauuuguagcauuuugguaacacucccuagagaauuuguagacuuugggggugcauauuaagggauaacauacauggcuuuucagaauauuuucugaauaaagcagcuucagacaccagauuuuaguuuuuggauuaggaaagagugauguguuuuuccacccuccccucccccaccaacacacacacacauacccuccccaucuuucagauauaggccaucuuguuuuauuggaugagccccccaaaaauacacagaaauaugcuaaauauuucuguaaaccuuggaaaggacucugccaggauauuuaucuacucuccaaaauagugauuguggaaguguuuguauaggucccuagcuuucuacuaaagccuauuuccaaccagucauagauuuuuguguguguguguaucuacauguuaacuaucuuugguauucauugaggccuuuuuugcuuauuuaugguuauucugcauuggcuaaaacaaugaguugcucuuauuuguuuccaugcuaucgauuugaugauuuguaauucuagacuuuaaaauuuaucuauaucuucacuuuucuuagauccauccuaagcagauucaugaacuuuucauuauaccuauaucauauuaaaaauaugaaaccauaguauucuagaacucggaggacuugaauuuguuucucacaugaagaguuuuuuuuuuuuugguaaagauuuccagguauuaauaucuuuguucuuuaagaagcuagaauuuuuuugugcaguguaggugccuuucuguccuuuauuuaagccccccccccuuuuuaaauuguuuuucaagaauuaaauaaaauuagaauuauuuauaguaguugcgaagcaggauaagcaguuuaaaauccuaucacaaaaaauacuacugaaacaaaaauaucuuuguuaacaaauauuuccagguuguaacaauauaauauuugauauacgaauauucuacuuccauagaauuugggcagucugugagauuuuuaccuaucauguuuucccucuaaagggcaauuauaaaaacgcuagauuaucuucagguauuaggacuccucaucauugguuucagauguuaauuggcuacaccuugauaaaaggcagauaaguguuaauggcaguuggcugugauuuuauauuaaguuucugccuauuuuauagccaagaacuugugcauauuuguauauuguuuguugauauugaauauggaauucagagagaaaauaagaacucaaauucuaaauuacucagaucuccauuaggaaaacagugccugagaaacacuuuuucccccuucucagguacuguauaucuugcaguuagcagucuucaucuuguauaaugcaagcagacuacaaacucuguagcugggagugaaaauuuguuacucaguaugaagcagugaaugagacaauugauuuuaucgugugacaccuguaccaacauguuagcaguaaaacuccucccuacauuagagaaucuacaauaaaaaguugcuacuagggaauuguuuuuguuuuaacacaaguucuagaugugcccuacauauguaaugcuauaaugucuacauuagagcuauuauaaugaaauuaagaguuugguuauaauuauccuaauuccuugaaagguuaaauuguguucacuauacuuaaguaccuaaaaauguuaguucuuugggaacauggaaaccagguauauauagcuuuuaguaguuauuucuacuuaucugaagcccuccuuggauaauaauuuuuuuuuguuuucauuuuugagacguggucucacucugucacccaggcuggacugcaguggcgucaucuuggcucacugcaaccuccgccucccaaguucaagugauucuccugccucggccuccaaguagcugggacuacaggugcguaccaccacgcccaacuaauuuuuguauuuuuaguagagaugggguuucgccauguuggccaggcugcucuugaauuccugaccucaggugauccacccaccucaaccucugggaguugagugggauuacaggcgugaaccacugcaccugguggauaauaauuuuuaauugguauaauaguauuucuuuuaagcauaacuucauuuucaaauuaaugcaacuuucuguaaaauacaugugauuagucuuguagagacuggcuuuugucucacaugucuauaaucagucauaaucaguccauucuuguucuugugcuaaagugaucuuuuugacacacauaaauauucgauugugguauacccuacuuaccauuguucacaauauaaggaccuuccuccuccaaucggcuuuuuauuugcuccuuacugcuuuucccuuuacaaauucaagaacaaaacacacauuaaauuguuaguuguauauuugagagucaguguacuaucaugguuaaaaagggggacuccagcaaauuggucuggguucaaaacccaucuccgcauuuaucagauauauaaccuuaggaaguuaaccuaacuucucugguccuuagcuacaaaauagggauaguuaauuguucuuacuuucuagcguuaucuugauaauuacauaaauaaauuuuaaagcauuuagaauauucccuggcacaauaauuuauuauuauuuuauaguuaugauaaaguguuuucagagacuguauaaaacaagaguccuaauuuagugugaaaguuucaaagaaugggagaaagggcauuuuaaguagccguaucagcauaugcaaagaccgggacauggaaacuaacuucuguucugaguaacugaagguauggcaaggguuugguggugucaggggacuuaggagagaaguuagagguuacaaaacaucuuauaagccuuauugauuugggagugcuguugaggaauuuuuaucagaaaguccaugaagauaaauaauuuuuacuuuaaaaaaucacuuugaugugggagaguagaauugaggggaagaagaauagauuaauaaagaccuguuuggaggcuauuggaguggcuuguucuaguguauuauuaguccguucucaugcuaacaaagacguacccgagacuggguaguuuauaagggaaagagguuuaauugacucacauggcuggggaggucucacaaucguggcagaaggcaaaugaggagcagucacgucucacauggcggcaggcaagagugaaugugugcaggggaaccccccuguauaaaccaccagaucucaugagacuuauuuuuuuuuuaauuuuauuauuauuauacuuuaaguuuuaagguacaugugcacaacgugcagguuuguuacauauguauacaugggccauguuggugugcugcacccauuaacuugucauuuagcauuagguauagcugcuaaugcugucccuccccccuccccccaccccccaacaguccccggugugugauguuccccuuccuguguccauguguucucauuguucaauucccaccuaugagugagaacaugcgguguuugguuuuuuguccuugcgauaguuugcugagaauaaugguuuccagcuucauccacgucccuacaaaggacaugaacucauccuuuuuuaugacugcauaguauuccaugguguauaugugccacauuuucuuaauccagucuaucauuguuggaccuuucgguugguuccaagucuuugcuauugugaauagugcugcaguaaacauaagugugcaugugucuuuauaguagcaugauuuauaauccuuuggguauauacccaguaaugggauggcugggucaaaugguauuucuaguucuagaucccugaggaaucgccacacugacuuccacaaugguugaacuaguuuacagucccaccagcaguguaaaaguguuccuauuucuccacauccucucuagcaccuguuguuuccugacuuuuuaaugauugccauucuaacuguugugagaugguaucucauugugguuuugauuugcauuucucuaauggccagugaugaugagcauuuuuucauguguuuuuuuggcugcauaaaugucuucuuuugagaagugucuguucauguccuuugcccacuuuuugaugggguuguuuuuucuuguaaauuuguuggaguucauuguagauucuggauauuagcccuuugucagaugaguagauugcagaaauuuucucccauucuguagaagccuguucacucugauggucguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuagaguuuuuaugguuuuaggucuaacauuuaagucuuuaaucuaucuugaauuaauuuuuguauaagguguaaggaagugauccaguuucagcuuucuacauauggcuagccaguuuucccagcaccauuuauuaaauaggcaauccuuuccccauugcuuguuuuugucagguuugucaaagaucagaugguuguagauauguggcguuauuucugagggcucuguucuguuccauuggucuguaucucuguuuugauaccaguaccaugcuguuuugguuacuguagccuuguaguauaguuugaagucagguagcgugaugccuccagcuuuguucuuuuggcuuaggauugacuuggcaaugagggcccuuuuuuggugccauaugaacuuuaaaguaguuuuuuccaauucugugaagaaagucguugguagcuugauggggauggcauugaaucuauaaauuaccuugggcaguauggccauuuucacgauauugauucuuccuacguaugagcauggaauguucuuccauuuguuuguauccucuuuuauuucauugagcagugguuuguaguucuccuugaagagguccuucacaucccuuguaaguuggauuccuagguauuuuauucucuuugaagcaauugugaaugggaguucuuucaugauuuggcucucuguuugucuguuauugguguauaagaaugcuugugauuuuugcacauugaucuuguaucccgagacuuugcugaaguugauuaucagcuuaaggagauuuugggcugagaugcuggaguuuucuagauauacagucaugucaccugcaaacagggucaauuugacuuccucuuuuccuaauugaaugcccuuuauuuccuucuccugccugauugcccuggccagaacuuccaacacuguguugaauaggaguggugagagagggcauccuucucuugugccaguuuucaaagggaaugcuuccaguuuuuguacauucacugugauacuggcuguggguuugucauagauagcucuuauuauuuugagauaugucccaucaauaccuaauuuauugagaguuuuuagcaugaagagcuguugaauuuugucaaaggccuuuucugcaucuauugagauaaucaugccguuuuuuuucuuugguucuguuuauaugcuggacuacguuuauugauuuucuuauguugaaccagccuugcaucccagggaugaagcccacuugaucaugguggauaagcuuuuugaugugcugcuggauucgguuugccuguauuuuauugaggauuuuugcaucaauguuuaucaaggauauuggucuaaaauucuuuuuuuguugugucucugccaggcuuugguaucaggaugaugcuggccucauaaaaugaauuagggaggauucccucuuuuucuauuuauuggaauaguuucagaaggaaugguaccagcuccuccuuguaccucugguagaauucggcugugaauccaucugguccuggauuuuuuugguugguaagcuauuaauuauugccuccauuucagagccuguuauuggucuauucagagauucaauuucuuccugguuuagucuugggaggguguaugugucaaggaauuuauccauuuccucuagauuuucuaguuuauuuguguagagguguuuauaguauucucugauggugguauguauuucugugggaucaguggugauauccccuuuggcauuuuuuauugcaucuauuugauucuucucucuucuuuauuaaucuugcuagcggucuaucaauuuuguugauccuuucaaaaaaccagcuccuggauucauuaauuuuuuugaaggguuuuuugugucucuauuuccuucaguucugcucugauuuuaguuauuucuugccuucugcuagcuuuugaauguguuugcucuugcuucucuaguucuuuuaauugugauguuagggugucaauuuuagaucuuuccugcuuucucuugugggcauuuagugcuauaaauuucccucuacacacugcuuugaaugugucccagagauucugguauguugugucuuuguucucguugguuucaaagaacaucuuuauuucugccuucauuucguuauguacccaguagucauucaggagcagguuguucaguuuccauguaguugagagguuuugagugaguuucuuaaucccgaguucuaguuugauugcacuguggucugagagacaguuuguuauaauuucugaucuuuuacauuugcugaggagugcuuuacuuccaacuauguggucaacuuuggaauaggugugguguggugcugaaaagaauguauauucuguugauuugggguggagaguucuguagaugucuauuagguccacuuggugcagagcugaguucaauuccuggauauccuuguuaacuuucugucucguugaucugucuaauguugacagugggguguuaaagucucccauuauuauugugugggagucuaagucucuuuguaggucacuaaggacuugcuuuaugaauuugggugcuccuguauuggguguauauauauuuaggauaguuaguucuucuuguugaauugaucccuuuaccauuguguaauggccuucuuugucucuuuugaucuuuguugguuuaaagucuguuuuaucagagacuaggauugcaaccccugccuuuuuuuguuuuccauuugcuugguagaucuuccuccaucccuuuauuuugagccuaugugugucucugcacaugagauggguuuccugaauacagcacacugaugggucuugacucuuuauccaauuugccagucugugccuuuuaauuggagcauauagcccguucacauuuaagguuaguauuguuaugugugaauuugauccugucauuaugauguuagcuggugauuuugcucguuaguugaugcaguuucuuccuagccuugauggucuuuacaauuuggcauguuuuugcaguggcugguaccgguuguuccuuuccguguuuagugcuuccuucaugagcuauuuuagggcaggccugguggugacaaaaugucucagcauuugcuugucuguaaaguauuuuauuucuccuucacuuacgaagcuuaguuuggcuggauaugaaauucuggguugaaaauucuuuucuuuaagaauguugaauauugguccccacucucuucuggcuuguagaguuucugccgagagaucagcuuuuaguccgaugggcuucccuuuguggguaacccgaccuuucucucuggaugcccuuaacauuuuuuccuucauuucaacuuuggugaaucugacaauuaugugucuuggcguugcucuucucgaggaguaucuuuguggaguccucucuauuuccugaaugugaauguuggccugccuugccagacuggggaaguucuccuggauaauauccuccagaguguuuuccaacuugguuccauucuccccgucacuuucagguacaccaaguagauuuggucuuuucacauagucccauauuucuuggagacuuuguuuauuucuuuuuauucuuuuuucucuaaacuucucgcugcauuucauucauuucgucuuccaucgcugauacccuuucuuccagcugaucucauuggcuacugaggcuugugcauucgucacguucucgugccgugguuuucagcuccaucagguccuuuaaggacuucucugcauugguuauucuaguuauccauucgucuaauuuuuuuucaagguuuuuaacuucuuugccauugguucgaacuuccuccuuaguucggaguaguuugaucuucugaagccuucuugucucaacucaucaaagucauucucgguccagcuuuguuccguugcuggugaggagcuacauuccuuuggaggaggagaggcgcucugcuuuuuagaguuuccaguuuuucugcucuguuuuuuccccaucuuugugguuuuaucuaccuuuggucuuugaugauggugacguacagguggguuuuugguguggauguccuuucuguuuguuaguuuuccuucuaacagccaggacccucagcugcaggucuguuggaguuugcuggagguccacuccagacccuguuugccuggguaucagcagcgguggcugcagaagagcagauauuggugaaccacaaaugcugcugccugaucauuccucuggaaguuuugucucaggaguaucuggccguguggggugucaguccgccccuacuggggggucagggacccacuuguggaggcagucugcccguucucacaucucaagcugugugcugguagaaccacuacucucuucauagcagucagacagggacauuuaagucugcagagguuacugcugccuuuuguuugucugugcccugcccccagagguggagccuacagaggcaggcaggccuccuugagcuguggugggcuccacccaguucgagcuuccuggcugcuuuguuuaccuacucaagccuuggcaauggcgggcaccccucccccagccuggcugcugccuugcaguuugaucucagacugcugugcuagcaaugagccgggcuccgugggcguaggacccucugagccaggugcgggauauaaucuggugugccuuuuguuaaaccuguuggaaaagugcaguauuagggugggagugacccgauuuuccaggugccauucgucaccccuuucuuugacuaggaaagggaauucccugaccccuugggcuucccgggugaggcgaugccccgcccuguuucggcucacgcauggugcgccgcacccacugucccgcacccacuguccggcacugcccagugagaugaacccgguaccucaguuggaaaugcagaaaucacccaucuucugcgacacucaugcugggagcuauagacuggagcuguuccuauucggccaucuuggcuccacccucaugagacuuauucacaaucaugagaacagcacaggaaauacccgccuucaugauucagucaccucccacgggguuccuucugcgacacguggggauuauuacaguucaaggugauauuuggguucagacacagagccaaaccauaucagcuaggaaaugaccguagagaugaaaagauauugaugauauaaauaauuucaauaaauauauaggguugguuugaucagcuugaauuuuaauuguugaagaucacaaagguuacagacagcauuuuugagaguuaaagugacauuuuucagagauuaccaugaacaguaacaacugugaauagccaaaauuaagcugaaacauaagauuuguguuggguucuaagauaguuagugcugcaaagucauguugaggugaugaucucagggauuuuuagguguauccucuguguaucuucaggccugccucuuacuucguugguucccuaauugccauucauccugccuguaucagggaccacuuuacccgucuucucugaaguucuugguuauuuuaucugaaguuuguuuuuuuuuuuuuuuuuuuuugguaaauuucugugauuauucugauuuaccacauuuggcuuugaaauacuguauuuaaauguugagaaugucaugccuuaggaauucauagcuagucuaaacuaaauaaugaaggaggaauauacugggaaaauccagccaacuuaaguggcuccauuacgucuuccaguuuaauucuuuauuacuuucugagaccaauuccuuuuggggauuugguuugguacagaggauuagcuuacuuaucucuguauuuuuaauuuaauuuuauuuuauuuuaagacguagucucguggugucggccaggcuagagugcaguggcaugaugaucuuggcucacugcaaccuccaccuccuggguucaagcaguucucccaccucagccuccugaguagcugggauuacaggugcaugccaccaugccuggcuaauuuuuuguauuuuuaguagagacaggguuucacguuguuggccaggcuggucuugaacuccugaccucaagugaucugccugccuuggccucccaaagugcuggcauuguaggcaugagccaccauuccugaccucuguuuacuuuuuagaauaugcugcuuaguucuuaugaaaucaaaggaaagauuaaaugucuugauuaaacguuuuagaucuguguucaaaaaagguuuaagaaacauugguuuugcuacaugcauauauucuuuccugguaaaaaaaaaucucaauuugucuuagaaagucuggugugagugucaaguaaaaagguggucacuuaacaaaguauauauaagcccuugacuuguuugcuugaauaaagcugacaaauuguacacaccaaagauucuaaugcuguauauccaagaugaagucugauuuaauuuuaaacuacagccauaguuuaaacuacagccauaacaaugggaguacauucugagaaaugcgucaggcacuuuugugaauguggaccauacuuaaacaaaccuggaugauauaaccucuugcuccuaggcuauaaacauguacagcauauugcuauacgaauucuguaggcaguuguaacacauugguauuuguguauuuaaacauaccuaaacacagaaaggguacagugaaaauaagauacaaaacauuuuuuuaaaaagguuacaccuuuauagggcacuuaucauaaacggagcuugcagaacuggaaguuguucuggguaauucaguaaguggugugugaauguaaaggcuuaggacauuacaguauacuacuguggacauuggaaacacuguacacuuaggcuacacuaaauuuauuuaaaaauuuucauucucgaauaaugaguuaaccuuagcuuaccguaacuuuuuuacuuuauaaccuuuuuaauuuuuuaaaaucuuuuggacucuuuaauacuugacuuaaacacguacagcuguacaaaaauauuuucuucccuuauauucauacuuagcuuuuuucuauuugaauuuuuuuguuuuuuuacuuuuuagauguuuuuguuuuguugaaaacugauacacacacucauguauuugcuuaggucuaucaaggcaucacuaggcaauaggaauuuuucagcuuguuuauaaucuuacgggaccaccguuguauauaugguccaucauugacugaaaugucaugcugcacaugacugucguuuauuaaaauuuuuauuuaccaaauuaacuuuuuaacauacguuguaaccaguaauuucaauguauuucgauauaauugacauauccucuuugaaauuuauagaaauugauuuuuauguacccuaauuucucuuucagggagaagauggguauaguuuaacccuuucauaucauccauccauccauuccuacuaguucugccucagaguauauccuuuauucaacuacuacucaccacccuauuaggccaucauuaucuaucacuggccuccuaaugcauuuuccugcuuucguuuuauacccucuuuagcccauuccucauggaguagcuaggaccuuuaaaaaaaaaaaaaagccaaauuaaguuacucuuaagcuucgccuaaauccucucuugauuucccgucuaacaaagaauaaaauccaaagucucucaggcucucgagguguacuauauggucuagccccaaccagucucucugacaugaguuccuacccuucaccaccuaaguucaugcugccugagccauaccagugagggguuuacugacccucugaacugacugcuuuuccuucaagcauuugccuggucaguuacuucucugcuuguuuucaucucaguuuuauguucccugauuauuuuuaaauacuuccuacccuguuccaucauucuauguagaauaaaggacgggcacuuuaaaauuaaauaaaucuagcuuuaugaaaaaccuguguugucuuuuucucuugugauuuugccauggauuagaauugucucauaccagcacccaucucuggauggggguuugcauucaugggggagaguaaaacacccuuaccucucccucccuccaucugucuuucucucugucucacucucguuuuguuuuuuaauuauuugcugaagucauguaagaauaauuaguauugucacugauguguaauuucugugccagagcacacaaaacagaaauuaagcuuaaguuugguauauuuucucucucucucucucucucucucucucucacacacacacacacacacacacagugacucuugagaaaaucugguauugauggaaaaggaacauuucuucauuuucuuucgucuggaacauauguuuaauuuugccuucaaaccaaaccuuuuugcaagauauuaagcauaaaaauuuuaauucuauacaauuaauuucaauuuuagaauucuaggagucuauaauggucuugaugauaaguguuauacaaacagugucaaaagaagaguuuaucaauuugagcuuauuuauguguauaaaauuugaugagagaugccuugauauucaccugaaacuuuauugaauaauuauugaauuaugcauuuuccauguuuauucuuucuuagaauuagagcucaauaguaagaguucuauaaagauaauuaaauguaucuuuaacuuucaaaaaacaaacuucuaaaaucuuauguguagugaaucuuaauuugcaagcucuaaagugauuuuuugccacuguuuccuuuuugaaauuacucacuaagaaacaucuguuuucccccuaguagggacuacuuagggagcugguggauaggcaugcgggauccuggucugaaauaacagaguuacagaauagcauucugagauucaccaggagucuguuucccaaaaaaagauuaaguaccuguguucuaauaaauuguuagacccuuaaaaaauaucuuuguauauuucacaccucaagcgauuacuugccuaaaagcauauagcaaaguaauagguuagcuguccuuagacuuuauuuauaccugacugaauagguuuucagaccucaggaggaaagacagucaaauaauuaaguuuccuacauauuuaacagggaacuuaaaauauauaagaaauauuaaacagcaugggugcuuucaacagaguuacacguaaaguuuggccuucaaagucugcaacauaguucaccacgucuacugauauguaauagugacuacagcauuuuuugaaaugagacauggaaauuguucacucauuuauaauggaaggaaauauucuuagucauaaugaauguacaagacagauaucaaauuugagaugaguuuuccccaaaaauguacuugugaaaagacauagucaccuuguauucaagucuuuaaaaucucuuuucucauugacauugguuuaccuugauuuucaaaguacuguuaggagaaagacacauugaccuuaaauaacuuuagucaguuaauaguuuugauaauuuuauagaggucacauuuuaaaaauaauuaaaaauuaaaauuagcacagauuuuaauaauuacaguuggcccuucauacccauggguucugcaucugugggucaaccagcugcagauugaaaauauuuggggaaaaauaauggaugguugugucuguacugaacauguacagacuguuuuuucuuguaauuauucccugagcaauacagugacuauuuauauagcauuuacauuguauuagauauuauaaguaaucuagagaugauuuaaaguauaugaaaggauguguguagguuauaugcaaauauuauaaaccauuuuaugugagagaauugagcauccguggauuuuauuuuuuaauccaugaggggagagguccuagaaccauuucuucacagauagcaagugacaacaauuuauguuggugugagcucaaaauugcuaauguuggauguuacaaagacuggaaaaacaaaugaauaagcagguuauaucauugaaauaauaacuuuauaccaguaugaucaaugaaagauuguacuucaguuacaugaguggguacuugcuugagauaaaauucuaguaugccacuauauaugcacugauucaaaaaacgguauauuucaguaaacuuagauuguaaggaaagaugaaugcuugggaaaacagauaacugagaaaauaaggugaugacagauacacaaauguggaagaugcaugugaagauuuugaauaauuaaaccuaaacuuaauuuuuaaaaaaucuauguaugggaaaaugauauuggccauuuuugaagaguaagguauacuuaguuuuuuaaaaggaaauggaauuguuaagauaggcuuuaugugauucuccuacuuuuagggucuggaaauaaacaucuaacacuuuauuguuauaaucagauuuaugacuuuaucacaugcgccacuagccauuaguugaucaauuucuguaucuuagcaaugcucccuucauguucuguuuuccacauaggaguaagguaacacugaacauuuuccaaaguauuaccccugauaaaaguaauauuuuuguuuaggugacaaacagcauguuuggugcuucaagaaagaaguuuguagagggggucgacagugacuaccaugacgaaaacauguacuacagccagucuucuauguuuccacaucggucagaaaaagauguaaguuaaucaauuauguuguauuuuuucagcaauguaagucugugucuggguuccugaaaaacagcauaucaagugcagaauacugucugugguugagugacaaucuuuucagcacagugcuagucccuuuggugcuuguauccuuuugggauacaaagacaaugaauuuguauucuaauggggaaaauaaauaucccaugauucucaaauugggauaugguaauacugugauagaaguacucaaagacauggaguaaacaugguauaacuucuagaucacugauuuuuuuuguuuguucaauaugggaaauaacuuguuugauauuaaaacaaaugcagauauagaacagaaagcagauuuacgcagacuugaagauauaauggcaagcuguaauaaaacuuuaugcuuauugugucaucuagcuguaauucuggaccucagguguaucucuccucuguucagccauagggauacuauaauaggaaaaauuuggaagaacuguauucaaaaugugauggaugauauagagauaugaauuaaaugcuuuggaaggcuaauaguucaauaaucccauuugggauaaaaggauuuagaaugcaaccaagucauaauuagcaaauuuauaaaauacuuaaaaaugaauguaauuacuaaaauucuguuaagcuacuuuaaauuauacaauguacucucuagucacaccaguugcauucuuauacuuuguacaccugcccagcuuuuuuuaccuuucacacuuuauaaacuugcuaugccaaaucuccuuauguauaaaacaaucuacucuagcuauuaaccuaaugagauuuauacugauguuugaagcauuuauaaaguucuaagauauggaacaaaugcccuuguuuuucuuugaaguugaucauuaguaaaucacuuccuuugacuuugcagaauuuugcaaaucagcuuaaccuacuagguuuauguuaggauguuuguuauucuguuuuuguauuuuccuuuuuuauuuugauuugaacauucuugugucauuuugaaaacaaacuaucaauggcauuauugggcuuuuuucaacuaauguguguuguggcuuuguugauaauuaguguguaguuuaauagcuuauggaauaaugucaucuaauuuucuguuaucuuauugcgcuuuuagcuaugugcuauguaacuuauaauugaauuauuauuuacacagguuucuauuuaaguauugaccuuguaaauaaagaauuugggauauauuuuugguaguaucgccgcagaaacgaaaaccuacaauuuguguguauugcugugauuauauaaugaaaguuaaguuugcuuggaaaauguuaaugaaauauuuauuacugaugaaaugcauuuauucuaauuaggaagauaggaagcuuucagacugaaaucuaaaaguauauaaagagaaugaaugacaaagagauauaugucuucucaaaagcagaaauacuauaugucuacauuuuaaaaucagaauuaguauauauacuuacacacauacucacaaauguuggccaccauucugauccagcugguuggcacagaaguaacagaaugguuugauucacaaaaccuuuuuuaaaaaaacauuaauuaagaacauaguauggcauaggaauuaagaacuuggacucuaaagcaauacaaauauguguguuuggauccugacuuugccuguuagcaagaacuucuccaagucucaguuuccuuuucuguaaaaauaggaguaauaauauauuggcuaccuuauacauuggcugcuguugcuguuacuuuuuuaaaauuacaaaauagcacagguaaauuauacaaauuuuuaaaaauacacuugaagaaaaauuaccuauaaugcuaucagaaauaauugcuaaaauucuaauuuuaugcuuuaaauauuuuuauugaaaaauacacaauuauuuaaaucuucuaggucauacagacauauuuuccaucaaaaaguuuguaccaguuuuuacuguaaucaccacucuccaugccaacaagaauaccagcaauuacauuuaagucuuugcuaauagacaagcuuauuguuuucauguacauacaguaaaacaucauuaauuuuacacacacacagugugaugggucuuuuccauauaguuauuggucauuuguauuucuuccuuuguguaccuuuuuugugucauuuucuauuucucuauugagaucuuaagucuuacuaguuugcauucuccauguauugaggauaacaaccucuugucauucauuacaaauauuuucccaguuuuucaccuuuaauucuugguauauguaguauacguauauuugucauuuuaauuaaaugugauccaucagucuuauuuuuaaauggcuucuguuuucgagaucauacuuaggaagacauuucccaauuacuuucuuauaauacuuuuauguuuuguucuucacauauaauuuauguccauuagaaauguguuuugguuuaaccugugaauuguaggguuccaaauacuuuuuuuuucuacaagcuuauccaauugcaccgacaccauuuaugcuuuaaaucacgggucagaaaacuuucccuuaaagaaccagauaguaacuauuuuaggcuuuguggaccaagaagcaaaaucaaggauauauauaaaaucaaaaccuauuuuguauaauaggccuuuauauaaccaucuguaauguaaaaacuuucuuaguucauguaucuuacaaaaacaggcagugugcuggauuuguccugcaggaaauaauuugcccaccccuggguuagaucauuaauuuauggcuaauuaaaauaucccuuuauuauaugugcuagugucucauacauucuugggccuguuucuaagaucuuguucuguuuaccauacugauccugugucagaacuacaacauaauugaauugccauagcuuuguagaccacuuuaacaucuuggguaagaaucuuugacauccuuuguuuuaaaaaaaugguuuuugauuguugcacauuaauaucaauauagaugguuuuucggaaggauauuucucccuuuaaucuuguucuuuaugcguuuuaauaggguuuugcaguugccauuuucauugcauuuuucagauugguuuuuacugaccuauggaauacuuuguguaguuauuuuauaacaaacugccauguaaaagucuucuauuaguuuuuggugauugagaauguaagcccuggaaauccuacuauguaaguuuuuaugucagcuaccugauuugcuagcugugugucuuaggacaucagucucugugugucucaguuuucucaucuguaaaauaggaacaauaguaccuagcucaugaaggauuuuuuuuuuuuaagugggagaauaguuaguguuugugaggggggcacugaagugacugcuguaauuaagacagacuguagaaaauagguuagcaaugaauauugaaaaccuuuaaaauguaaacauuccuugagucagucauaugucuuuccguaaauuuguacuucagcuguaaccugacauucagacaauauaauauaaugccauacuuguuuuuaacaaaaaauuugaggcucaaguguuuaaggaauuaaguacauugaguauuacacuauuuuucaaauguuccuuauguaagcuuaagaauauuuuaaugaaaauuauuugaaauaccuaguagaugcauaucaucaguuaccugauuuguaagcuacccuguucugugacuuaaugacuauuuuauuuuacugucugccuccucccuugccccuuuucucuuuuguucuuguuuguuuguuuguuuguuuguuuguuuugggggauauuuugagacagaauuucgcucuuguugcccaggcuggaguguaauggcacgaucuuggcucacagcaaccuccgccuccuggguucaagugauucuccugcuucagccuucugaguagcugggauuacaggcaugcaucaccacgcccggcuaauuuuuguauuuuuaguagaaacgggguuucuccuuguuggucaggccggucacgaacuccugaccucaggggaucugcccuccucagccucccaaagugcugggauuacaggugugagccaccgugccuggccuuguucuuuuuaauguauuaccuucucauaguuuucuuuuuuugugccuguuugcuagauuucauuaguuucauguuuuaaguuauccguuuuccaauuuuaaagguucuuuagcuucugucuagaucuggaacucuuaugugugugcaugcauaugcuuucuuccuuuuucuuugucucuuuuucucuuuguagauaugguacaguuaaaaagucauaauucauuugugguuuuuguccuggaauaauaacauagugcuaggaauuauauuaucaccauaauuuugaguauauuauacagagucuuuuaaaaauaauauuuuaaaacuuaaauaucauuuuuuaauugcugucauggucauggaauuuuuauuuaacaaaauuuuguuguauuuccuugcaacaauuuguggauuucuuugacauucuguauauuaaaggauaaagaaguucugugaaggguuaggggaauaaccagaaucacauuacuguuucuucuaguugcuuccugguuuuuauuguuguuguuugacugcagugugcauuguagauuucugagagauauggaagaccugauuauuaugaugauuuuagagugugcuguaacuuguuguuuucagcauucuauuaaucuuuuucuaccguuugccacucuuaagagcacaaguucuaugccuuauuuuaccuggaauuugugaagauaaacuuucuuuagccccuugggcaaaaaguuauauaaauuaaggguauuauuuaauacauuucucaagagucugaaugcccccucucacuccuauuaaugagaguucugcaacugaggggaagauuagauuauuagcagcugcugcuaccauuuauugagcacauacuauaugccauaucuuauuucauuuaaccuauacuucagcucugugagguagguaguuauuuucauuuuauaggaaggaaaccaaguauugguuguuccauagguaaguggcagaaccaggauucaaacccagauuauuucugacuccaaaacuagacucuuuuuacuugugcugcauccccuacuguaauguguuucuugaucuaaaguuuuauauuuuucuaagaaauuuaccuuuauauuauuaacuuucagaauuuaaaaaauauauacauuuuguuuucugcuaauaguacuuacuguucugucagaguauauuucuugugcauuuucuauacucauaaaaagcauuucugugacauucacauuucuucacuguguauuaaauccauuuuuagcaccgauuuguuugaugaaauauugccuucagaauuuaaaaguacagguucuuagggauagacuuuauaagaaauuagauauuugcauuuuugacacauuuugaggcaguaauuuuaagauaugucuguauagcugaucgaugcuuauuuuacaugaauguguugaagguuacaaacucuuaaauuuaacauuaaacuacuuuuauuauuccuguaaagcuguguuuacuaaccaccuucauguaguggcacauagagaaaauuguauauaauauuacacacugugguaagugaaucagccuacgguucuugaucucaaguaauuggccuagggaccuaccaccucuuuaccuucaugcucugcuuccccucccuacuuacucccuccucccauuuugagagggcagguagauacccaggcauaucuguaacucauggauguauaaucagugugagaaaguagacuaaaauguguguugucuggaguuaacuauucaauaaacauaaauaucugaugaaaaauguuuuaaguguuuuguuugacaauauucacauuauggauuguucuaagucaugcauuuauguuggccagcaucuuauauuugcagccuuuagaaacaacuguacuuuuucauuuauagcuuauaaugacagaaaaucaugauucuuaagaauuuuauauaaaucuuuuaccuccuuuuuuugaugguugauuuguauuacuauuaggaaaaccagauuuuaagauaucaagcauuauuugggauaaagaaggccacuacauaaucauaaaagaaaacuuacuaaaaaggauaaaacuuccuuuuuuauuuuuuaauuuuacuuuuaaguuccaggauacgugcgcacaacgugcagguuuguuacauagguauacaugugccauaaaccuuuuaccuucugugaucaacuaaagcuuuauuauauauucuuguucuugcaauuuggaaaugaacuuuuaauauaccuacaaaauauuuucaguuaaugcaguaacaguaaucuauaauaccuaagaaaagaacuuaucaggcaucuuuugaucuguuggguuauaauugggaaagaauauauaguuuaauuguauagauaaaggauguuaguuuaauuaucuagguugcacaaccucuggauuugggagggaauauuuauaagguuugauuuuuuuuuuuuuuuuuuuuuuuuuagaaaaaucacuacugucguauuaauauuacuguuuucuuuagagugguguauaacucagcccuaccucaagaguuacugauguguaccauuggucuaaaacuauaguauaaaaaauuuugcaaacuuuaguauaauugaaacaacuuagaauuuugacaugaaaauaguaugaaauguauauuguaaaaccucuacccuuuaaauguuuuaccucagcaccacaagacagggugagaaaauagaaaaaaaaacaaacaaaaauacauguuucacuucuugguuuuucuaacuguggucagugucagcaugauuuuucaucccuggaaaccacagaucagccucugauaguucucucuuuugugagucuccauuaaccuccuuuucccguuauaccccagcuagucaacaggacauaaaauaacuguuacuucuaccaccagaaugcgucuuauuuuuagucucacuucugcuguugucguuuaguaucucagcauaucccauuucugcuauuagagguaucuucccaaaacccauuuugauugccaccuucuugcuuaauauuauuuuucuuuuuauugcuauaguugguagccauucuuguaugacauuuauuucgcauucuucuaugccauaacaugggugagcuuuaucuccaaauagagaugaacuuuaucuccuuucauaguuauccuaucaccacuguuuauguucucuaauaauauuacaaaucuuuauuuuuuuuaacaacuggauacuggguuuuuguguucaauuuuuaaauuuuuguucaauuuuuuugaauuucaauaguuuuggggguacaggugguuucugauuacauuacuaaccuuuguuacacuuauacucacugcauauucuugagggaagaccccuucauuguauguaccuaaauguuaccacucuauagaguauuccugauaccuuuguguagcuccagugauguuucauguuuccuuuagagcauuuaccacacugugccuuaaaauauaaugaguuguauaauucauucucuuuccccacuagauuguaagccccuugaugacauggcucaugucuuauuuaauuaggauguuuugaugguugucuaauauaagacaggaaauacgcaaauaugcacacacacauauuuucauuuacucagcuucaguauuuacuuuugaguauauaacacugcuacauucauuucuaugaggauauauauaaugaauguauguucugugaacauaucuucaaauaauuuacaucuacaaggaaaaaaaaauggauaaauucaaaggcauuguacaagugccaugaaguucacaucacaaauacauaaauuauauaccaugucuauauaauuuuauuuuuuuaacuugcuaagugaaagaguagugcugcuguaacucaaguuagugugacuuuuagaaaacuuauaguauuaaaaauuaauuucauuucuacaguuugguuuuaucgaauugugauauucucuuaagaaacauggaauauauuauagaauguuuguuuuauguuuuucugaagaaugagaaaauguuagauuuucacauuuaugguaugauuuacagauuuguggaguguaaaugcaaugcucugcucuguuuucuuuaugcucuaauauaauuaauuuguuucuagaugcuggcaucaccaucuacaucaggucagcugucucaguuuggggcaaguuuauacgggcaacaaaguaagaauuuuguauuuauucugggauacuuuauuuaaagagaaaaauaaguaacuaccaaauaaagaacaaccaguacuuccuuuguggguuuauuguaugacuuaaaaggaaaaauguuuaauuuucagaguuuuauuuuacuuacauagcaaaaccucauuauuucagaccuuauugauccuaugguugcuauuacuuggauauagcauagauugaaauuuauuucaacaucuuuuacaucuguaaauuuuuugcaguauuuuugaagaauuugcuaaacuaaaaauagacauucucuguguuuucaauuaaaggaaguuaaaagcuuuuuuaguuuauuugacuggcuacucuguguguguguguguguguaugugcacgccuguuuauuaaguaaacucauuacuuagcaguuuguaaaauguucuuuguuucacaaguauuucuuaaauauuucuucuuuugcuuuagcucagucuggauauagaaucuagauuuuugacucacgguuuaaugcuuguuccguuuugcaggcuucuacuucuauuuuuuuaaaguguuguaauacuuuuaaagcgcuuagcacagagccuagugcauaguaagugcucaauaaauguuagcuauuaucacauaaaauuuuuauaaaacuaaacaauaaaauaucuuuauauuuucucaaauuaacuucccaaauuguuaaauauuaguaugauuuuaucaucucuguuaaugucagaucuguugaucucccauuucuguuaauguaaucucuguuaauagaagaagggaauuaaaaguguuauaaauucccaucagacauuauaggauaauugaauaacugaagaagacaucugaugacuauccuaaccaguuucaaguaaaaaucaauaauuugauuuggaacucucccaguauaaugaaaagcaaaguuuugacagguaucagaauaguuugucauaacacuuuaccuuccaaauugauucgaagugggaggaugaaacuaauuuuguauacaagcaugguuuccauuuacuuuuuucugucuaucuuuuguggcuuuucucuuuuuugcuauggaacacaauuuuguuaauauagaauuaguagauaaaaguuauucuguauuaacaguuucuccaauuaaaccaagaaacguauuuccaaagcuuauuacauaaaaaaauuguuuaucuacaaauauuuauccuaguuguugaaggacuauuauuagcuaguaauuuauucugcuuacccuguguuuuaguguggcuuucacccuucugguaacccuuacuauagaaauaucuagcuauuuuaaagcuaccuuuuauuucuucagagcaacugcaaagaacuuacuuuaccuuuuggaagaccaccguuuaucacagcagaaaguagauauggauuggagaaaaauuguauuugagaaacuaagguuauuuuguaaaggauaauggcaauuacuauacuuauaaucagcuaucuggauuuuuuaaaauucuggucuaauuuuuuuagccuacaaaucugaaauucuaacugggcuaagauauggaauggguuauguuuaaaaugcaguuauaucauugguaugacagacauuuauguuuuuguuuuuaaggacauacaaagauuaauacaugagaaaauuuauuuucauuagaaaaagaauuuuuaagguacuuacuaguuuaaaaagaagccauguauggcaaacauuuuccauuggaguucaguauauuaaauaacuauauuccuguaacauuggugaagcaacauuuugaauguauggcuuacucuuuuaaaaugacauuuuaaguguuagauagaguacagaaaaauugaaucuuagaucaacuggaacuguaauguuucaggucaggguguaauuauguuuuuccaagauaucgaucuagaagcuauaacuaguggaaaaagaaagagucuagguugccaauuucuaucuguuaggacagacccgagaaggccaaauaggucauucagcugguagguaaucugaacaaacaccuugucagacagcagaacacaagcuaccaugugggucuugaggguuaagguuuuaauaauuuaagucagaaugacaaaacuuaaggaacugaguuaaaugaaggauggagagauaaggaauuaguaggugaguguagauuagagauauuauucuuauggcaacuuacuguaauugcacauugagauugguguaacuaaaaguucguuucccaagugcauugaguaccacuauuaauucuguucaguuggcaaacuuuuauuguaauuugugccauuaaaaaugugagaucuacuaucuauuguauguucuugaugguuagaaagguuagagguggaagagauauagaaggaagagugcccucucuagaaguaagagucacugagauuaaacaagaaagggaguuugucuuggaauagauacagaagugcuuaaacuuagauuuggcuagauuuggguggaagugauuaugcagugccaugagguagccagaaaaugcuggaacagagaccuguauggucuucaguucuaguauaguaugauuguauccaaauauguaaauaauuggacuuuucauccaauaauucacgugaauacuguacauggaaugauaacuauagaaaccaaugaacauacucuuguauucaaguugcauaauguuuccuauuuguuauauuugagugugugauaagcuuucaggugaauuaaguccucacuuaacauaaguuuuuugaaacugcgacuugaagcaaaacuacauauaacaaaaccaauuuuuuguucucaucaacauuacaauggaaugaaguugaaugaaacaacacuauucaaggaccugcuguauguauuuuugccugaaaucacaguuuccaagaaugaucaguggcauuaagugaagacuuacuguacaccuuauaagcuucaagacccaugagcucccuuaagcugucuccuagauuagaaucaacagggaaccaggaauuaauuucuccuggauagucaaagcauuggaauuaagugguugauaguugcauuuaccuuuucuuaguuaccaacaggaucuaggaccuuguaagauuggagaaaaaggaaacugucauuuacugagugcuuucugugugcauauuaucuuauaggcaccuagcuuagcaaaauaucugggugaauucauuauacaaauuugugucugaauucucagaggacccaggcaucuagauggaagaagagcuaaaucugucagaauuucuaaguucuggacuccuagcuugagaacaaugacauagucucaugcuuccagcagacauuucuuuggccuccugcuuuaagaacaccuaugugaaagcuacuuguuucauagagaacccagagcacagguggggugguucagaagugaugcuaucagcuauguaaauaggugcaugacauauuuugguugcuuucggaaauuguaggaccauugaacagauacuaaaugcuuaguaauaaguacagagugcucuaggauuucuugcucuuuugaacacauguuuuauaguuggggaagauaggacauauuuauauguaaaauauuaaauaacagccugugaugcuaacacauagauuaaaagauaccaugugcagaaugguguagacagacuuuuagggagcaaauucugucuauaccauucuccuugaggagaaccaaaaaaaaagggaagcuauagugguauggaaaaacuucaaaaagcagguaggaauuaaaguugacaaauacuuaugggucccuaccauacauguugugccauucuagauacugcagaugugugguagaagagaucauccucauuuaugccaucucugcauaguguaccuacugcuaugguguugcugcauuauuuauugcauguccucauugccuuuguauccucuguaccucgcauaugacaagcacucaguaaaucuugaaugcaugaugaacaagaagcagucucauauaaucuaguaggauaaguacacaaaugauuuuacuauguaguagaauaagaaguucgagguuauuuggauguuucagaugagauagggcacauucaggaugguacggcuguagacuauuuggauauuucaaagacaggaguaaucagguaucuuggaaaaugauuaggaaaagaauuuacugaugagauuauauuugagauuagcauugaacagacugugaguaaaguuguuuuagcagugggaauaacauccacagcaugggauagauuuaggaauggccuacuuuaucaagacaggagacaccuguuaggcuguuauauugauuucagcaagaaguacagucuucacauuucugagagauuuauuucaagaucauugcuacuuuuaaaguucaagaacacagcuauagaauaacauuuuccaccauaaaacauccuuuuugugugugugaaaaccaucacuugauuagacuaucuuauuuuaucuucacuuuugguaccaccuguuggcuuucuuuucauaaguaugacacacgcacacacacacacacagagcuaauauuuauugaauauuaucuacuguguaucagaugcgauuuuaaguauuuaugugaauuaacucauuuaaccuucacagcagcuccacaagaguuuaaggaauuuguucaagguuacacagauuguaaguaguagaaccaggauuauauuacuuuguaagaguaacuaugugaacaugagcugaaaacaucaguuucuuugauaccugaaugccaugacccuagaaagccauuuguacauaguagaaacuaccaguguuaaauccacaggugccaagaaucuguugaauuaagacauugugauagaauguauucauucuaauaauuauguauuuauugggugccuacaaugaaugagguauuauuucaagauauagauaagaauauagcaaauaacaaauguccuguuuuuauggagagagagagagagaauguuaguaauacugcaguaguccaggcaaaaaaaaaugggaugacuuggacuaguggagguguugagaagugaucagauuugguacauuuuguagauagagcuaacaggacuugaugauguaggagugaaagaaagggaucaagaaugauuucuaagguuuccgaccugcaaaccuuugugaaugagugccacuaaucuagagcagaaauuuagguugaggaaguguagaguguacuugggagauccacacagcuauuccacagguaaagauucuguggcacuccucuaaagauccagccagauguugagacucucagcugauucgagcacagcagccacuucucauaguuguggaagccacuuagcuccauccauguuucuugucuuauacauucuuagcaccuagaaggcaaagccuguuccuccgccagguguauaacuuguccucauuuucauauaucucgucauucucucagacugaacuauuguaacauuuauacccaccugacuccccaccacugccaccaccaaacaccuggcugagucucauauguuauuuaauucauauacuaucuucugucuccuccaggaaaauuuuucugcuuccagacucacucuauucccaagucugaguuaguguggucccuccuacaagcagucaagcacgcuaugucuacugcauguaaacaccuuggucauagcacuuauuuauuuuuaaguagucuuuuauaucucuagaacaagagaagggaaaguauucuugcugaggaguuagauaugaguaguaaaggacagauuugaggaaaggaauagagaaagaagaaagaagauuauaaaucagauauguaguguguaaacagaguaaaaugcuuguuaagguuagaaaacaucuuugggucuugacagaauuuuaauacucuagaacagugguucucaacccugacugcacccauggaaacaccuggggaauuuuuaaaauuccacugccaugauugcccaaaaucacaauugcuggagaggagaccuagacauuaaaguucccuggaugaugcaaacauuauuaacuaccauuaaaaaauggaaaaugauauugguugcaaaaaaggcauugaaauaggagucaagaaauuggaucauugucuuuaaugccucauuacuugugaucuugagcaagucacuuaaugccuagugugaauucuuuaucuguaaccuacuuggauaaucucuggagucuuuucuauucuaaaauacuuugaauuuaaugaagaaaauugcauaaggaaauaauuuuacaggaaucauuaaccagcuaagugcaagacagguugaagguaagaagccauugagauaaagcaccauuuauguuguccuuuuuaguaugggcaugccagugaguuccuagaggaagcuggcugcuuugcaaauggaaaaggggacacuuuaaggcaucaguuaaggacuacucucuccugccccuauaaagauuuuaggggacuuuauuuaaguaugaauauucagggauuugguugcuaugauuuuauuuuuucauguaacuuaauauuuuuuauuucuagcaaaaaauugaauaaagaaugacguauuuugccauaaguguuuaagugaugugcuguuaaucaguuugugcaguggaaauaauuaauggaauaauuucuuagaucauauucuuuaaggguuucugaaaaaugaucaauaaggaauuugacuaacacccugccagauaagagguaggaaucuauuuagaauguguucguauaguccuccuaauauuguguuguuauuaucaauuguuagauugaaagaaaaauuugacucaaaauuauaaccuuuuaaacuuuuuuuaaaauuuguuuuuauucuuuguaaaaaggugauaaccuuuuuuauaagaugauuauaagaaggaauugagaggaaguaguauagugcuuuguugauaagugcccaauaaauuuuaauuuuacuguccuuccagucaccugcucauauacaagcucauuuauacauauuuauauuuuugccuguuuuaguuuuuuuaugccaagaaaaacuccuugaguucuucccauuuuucuuuuuuuuucuuuuuuucagcuguauguccuauucuuggcauaauauuuuagagaugauuuuucugugauuguuucuaauuauacuagugagagauuagauuuuuuuccccuugacccuauucaguuguguuaguuugacucaagcaacucaaaguuaaugacuuaguauauuuaguuuccaaaaaacaaaucuuuauauauaccuuuccagugccauucuuuauguuuuaaagaaauucaguuuuuaaaauaaauuuaaaguaacaauuauuaaguauucagggguugaugauccaauuugaagugauauauucuuuuuugaucuuuuuauacuacuucaacaaaauuaaacuuagacuuuuugaauuuauuagcuguuuuugugaagauuaauuuuagaaagcuaaaauuaaacacugaaaguaaguuacuuuauuccauacggucucuguccaguuuuagcacuaaaaucaguucaaggaugccaaucccuaauuggccaaauagccuuaccauucuuguuuucuucuccaaauuuguuuuuuugcuggucagauaacuuccaauuucuaaaauauuccugaaaugauaaauuuuuaugauacagcauagaauaauauguauguggagacuugaaggagucaaaucucaaugagccuuuuguagggcuuaacgauuguuaaaagggggccaaaagggcacuaauuuuuggaaaguguauguuuguuuaugguggugaauguguagagagggugaaaaguaaaggaaaaguagaacaagaagaaagaaaacugauagguaugacgaugagagagaaagaaaauggaagagagcaagacguggagauuuagaaaaaagguugagggaaacauauucaaaagggaaaaagaaagcagggggaaaauacauuagagguguugaaauuaguaggcacucacagaggugcuaaucgagaguucuguugggcuccugucaugcugcuauuaaagagcauuagcagcuaagagaucuaaauucuaguccuaguucuuuguguugccguggagaagucaguuaacuuacaugaggcucagguuccuuaccuguguguaaaaugggaacauugaacuaggugaucuuuaagaucccuuccggcucuaaaauuguuugacauuaucuugguggucaguaacugugagaaacacauuccugaggaaaauuugcagcuauaguugacuucaggacagcauguuuagggaguagaauguaagcucccugaggguaggggccuuuucuguuguguucacugccauauccccagcagcuagcacaaugcguguuacauaguaggcauucauuaaauguuuguugaaugaaugaugugaaaaguauguugaugguuuguuaggagcacaccuagaaagccucaaagaaaaauggugugcuuuagggagggaaaagacagauuucuucugaagaaaucuuaagcaagcugauuuuuaauccuuauucuuccuuauuuugucccagauucaaagaaaguggcuucagcuagugacauucucauagucacaaaacuuacggugacuguagacauacauaaaaguguacauguaaucuaggccaguucccuuaaaguaucuuacagaaaggcaggaccaagcuuaggucuccauggaaucugagugaaaaguauauacauggaauauauuaguuauauugaauuagauugauuggauuaaaauucauucaguugagaggcacaguuagucuacaagcugagauacaggcugccaaauuuaagauaacgaucagugagauacucgcuaaccacuccuaucccuagguuagaaggugaaacauuauuaugccaaaggauaaaaucaccuuaaaucccuagcacugaagucaucuacuuacugauuaguucucacucuaucuuaucacuuuuauuuaaucuccaguucagaauaaguuugguugaugaagcagacuagaaguagaaagcacuaaaaagugugggucaggaagauggaggaaagggagaggaauucguagacagauauaacaguguaagugauagcuguacuucuugacuuugaagcauaaaagggaaaaaaauaaacguaugcugucuaugauaauuauccuggauuauuaaaaaauuuauaauuccuaugaucugaauaaaaacucaggaaauauacauuucuaaaaaaaguuuauccacagugguuuuguuuguuuguuucguaugagaaugauaaaacucuuagcagucuuuaaaaaaaaaaaaaccuauuagaauguauaguccauccccacaccuggcuccagggguacuagauaaauacaggggcauuauauuuugacgucuuuuuaaauguuuuaaaauuuugucuuuuauagcuauaucaguuugaguuuuuuuuaacaguugcuggcauuuuauguuggguuuguaaaaacaguaauguugagaaauauguauaaauaguaaauuggcuuuuucuaaaauauaauuuuaaaggaucacauaaaauuaaagcuacuucagcaaagcgggguuaaaugucuuucuguauacauuaguugugaauaaagacauaaaaacacauuacugcaaaauuucauaauggccucuuuguauauacacauguacauauaugcaaauaggccuuuaagaaauuuuagagcaauauccauucauaauauuguaacuuguuagucauuuacauacuucauaaugaaauugaaauaugaaaaauaggaauaugaaagaaauauccauucauaauauuaaauuucagacuggaacauauuuuuuguuaaaaucagaguuuauuuggagugaaucgaauauauccauuuaaaauuugcguacuauguuaggucauuaaaagugucuuaaaucgccaacuccagaagauggauaacaauuucauuccugauggcaaugaauuuccuucuucugaauuuuuuuauuaggugcacuaggccuuccaaugagggggaugagcaacaauaccccucaguuaaaucgcagcuuaucacaaggcacucaguuaccgagccacgucacgccaacaacagggguaccaacaaugucacuucacacgccuccaucuccaagcagguauuuauugauggaccagaauauuuuucaaaauguaucuugguagaguaaacaaacuuuuaguuuuuuaauaagguaauuaauuacuugauuuucugguucagugccuuucacugaggaagaaaauaccuaugcucuuuuuauuucagugcaaauuguuaaguacaguacaagugguuuuuauacugcagcucgcauacugguugucagugggguggauaucaaggguuaaucauuuccuggggagcuuuuucaaaaggcaccugucuuccucaaaggaauaugugcaauuuaaaauuccuccccagaugauugugaucauugcucccucgccacacauccauugcucuaaugagcauaaaguaaaacagaugacauagacuauacauuuaguaugcagaggauagaacgauaugccauugaaaugaaauuauucuaaauaugugugugaaauacauuuauauuuuaugucacagucacaccaguaguucucucaucuuagauaccaccuuuuaucaguugcacuauaauuugcccuuuauuguuuguuuacuuuuucuuuucaaagagcuagaaugacuaaagaauuaauaaaaauuagaacugcaauuugaaaguauauuugagauucuaggguuggaccaauugauuauuuaaagagaauuuuaaugagugauuguagagagcuuauuuaguauaauggacuucuuuuucagggguauuuugccuaugaauccuaggaauaugaugaaccacucccagguuggucagggcauuggaauuccuagcaggacaaauagcaugagcaguucaggguuagguagccccaacagaagcucgccaagcauaauauguaugccaaagcagcagccuucucgacagccuuuuacugugaacagguaagauguuuauugauacuguguauaauugucuuucuggguauacucagauuugccuuuucauauuuucacuuuguucuugagguguggcuucucucuaauaaguguguuucaucaugcauuuauguccaaagauucuguuacccaucacaaaacgauacguuuucuugaaaaucagguugauuuuggaaagcacauuaaaacauuuuguuguugugguuguuagaaaaggauuguucuuggauucgccaccaggcaaauuuugguugauauguccucucuuuauaaaauaaguugauuaccugugugguaagaguucuagguuuaugaauagaacuggagacauguuugacuauuacuacuuugcuuuaguuauacuuugaguaccuucucaaguaagauuugguuuugugcauuggagacuuaccaacaaaagacuuuuuaagaucacaucuauaguauuugaaaaccguaucauguuuagggauucaaaacaaaaaaacggguuuuuguacuuuuucacuucucuuuguacugucuguugcauauacuuugcgaauaagaggaguuacucauuuuguuaggauuuucaagcuguuuggguaauuuguaugagaauuaugucugaaauauaacacuuucuugcaaaaguaguauuuaagcuugauugccuacauguauauauauguauuuuuuaaauggagaaauguaggggcaaaacuaccuugaucuaguuguuaucaucauaccuguuugauucacuuuauucugucuaguaaaaucugaauuaaaauagguuuagcacauuuacuguuuaauccucauuccauaaacuccagguuuugcuuuuauuuagauaucuauaauuuuacugcucuuuuaaauuuuaaaaaacuuauuugugaaggguuaucaaaauucucaucuccuugauaccuuucuaaccuuauaucuuuaucauaacuuuaucauaucuuugugcguucucauaguauugggcauugaauguauaaauuuuuaccuuuccauaguuuuucacauuuuguuuuuaaaauacacuuugcuuaaauugucaauguaacauggaucucuaaaacccugcuuauuucuacuauugacagauuguauuuauuauaaauuguuuucaucucugagcacuuauuccauguuugaugguaccuguaauagcaucagcaauucuaauaugcuauuaaacaaaaauuuccauugacuuucuggcucuucucuagaguguuuguuguuuugucagcugcauguuuuaucaaaaaauuguuucacuauagguuuauagauuuagucaaaacccaaaaaacccugucaucuucauacagauuaaccccgcuuacagcauugauacacuaagugccuuuuaucagaagaauauaugacauuaaagacaugugguuucacuauagaaucugcauuaacaauuccuguugacacucuuaauuauuuggccuugcucuaaguucugccuuauuuuuuuuuuuuucuucacaugcuuagucuuguacaaaaaagggagggaggcaacuguaacuauuuacgaaauaccaguuguguauuaauuuaaaauuggggacaccauagacuguguuuucuuuuaaguauaugaaagguaaacuauauuuagauaagaaugauguauuuuugagcacugaauucaauuuuaaaacgcaccauucaauucaggucacuacauauuuauugaaugucuauuaugucuuccugaacacuaaagggcagaagacacagagaggaguuuaacaugggaggaguaugacauaaacuccuguguccaugaggaguuuauauucuaguugggaagaugaauacuguaagagagaagaucuauuaugaaaaguaauauuugcaagcuuuaccaguaaagaagaaaaacaacuauuuagcaagaauaaucuuaacacuaaccugcauauuuuugagguuagguaauucagguauccaggaaguuggcucuucaaguacacaaaauggugcccugaaucuguuuuccucaagguucauauauaaauuuuugaguuuuuguuuuuuaacuaaucugccuaaaauguucugguucucauuuguucauggaaggacuuuagagaaguuuucaaguaaagauaaagaauagauucagaaaaauaauauuaguguugguuuugaaacauauuguuauuuuauauggagaccaaaaauacacacuucuguuuuucuucaucugaaaguuaguguucuuacuguauaucuaaaacuauuuucuauguacccaguaugucuggauuuggaaugaacaggaaucaggcauuuggaaugaauaacuccuuaucaaguaacauuuuuaauggaacagguaagcuuauucuggagcuaguacccuacaaaaaguaugauagauuuaugaaauauaaagcaauucaacauacuggucuuuaaauacgguaggauuuuuuauuauguuagaugguagauuuuaauucagugaaaaauaggaauaggauucaauacagugaauaguugagagagauguaaauuuuuuuuacuuagcaugguaacguaguaauuuguguuauaacaucaggauuauuuccuuaacaccuggagagagccuacacauuaacuuaguuaguauuuaugccucaaaauauuuugcuucauagcuuuuacuguccucagcccugucacugugagaacuauagcuuagacuagguugggugguaugacauucuggcuauggagauccagauugaagagaaccuuuaaaauuguauggaacacuuacguuuuuucuuaauaguuuuaauaauacuaauguuggcauuuaaccuuuaugaauuguugauucaguuuuauguauaaaauuuaguuacauggaaaaccaacucugauuuugacaguaaaaaauuccuucagucuuuugguuuauuucuuuuaucaacugcuucagauagaagagaacaggaagcuuuguugcuauuuugcuuuagguuuuaccuucuccacccuacagacccuuuccugagaaaggaaauaaaggauguuaugaucauaggagcaaaaaugaacagcauuauuggagaggauuaaauguaaaggaaguggaagguaaaagaaugcucacugaaauggagcauuuguagaggcaagagaagauuuaauaaggaaaugucauuuguagcuaugagcuuuuaauuucuaaauguuaauguaugcucagcagcauagauuaaucacacaagauuaaaaucuuugaaaaaagauuccaaauuuuagcauuuguaagugguggcuuguguucaagauguaguaugaaauacuguauuccauucuuucuaaaauguacauuucuucauaauuuaaugucuuugaaaucaggcuacaucugcauaucauaguuuaauuguaguuuuuuucuaaaugugauguaaauuaacaguaaagaugucugacagugccaucuuagauucugcauuaugguuuuauacagugcuauaaaacuugagaauuauuuuuuaaauucuguuuuaacuaagcauauuuuaugcuaggaaaauucccaauucuuucauaaaaauauagauuggggguuuauuaacuuuauuagguugaaacauagucucaaauaauaaauggcaaauuuaaauuccaucuuggaggaccuaaagauauguauuaaaaguuaauauauauucaaaauguaugacucauuuauaaucaaagaauuugagaaauuauaaauugaaacaggauauaaauuuuuaauuucuacugucuuauucagugguaauuuuuuauucaaaguucuuaagcugcagaaauaaauuuauaaacugcaguuuuuguaaacagccagguauaaaugauuuauccuuuacccuuguaauuugaaauugucaccugucuuugaauguuaauaaauuaauggugucuauuguuuuucugucaacaaaguaaucuugagauaacaguuacuguuugagauucuuacaguugugaaauuuggagaaaacuaaaaauuaauugggaaguggcaaaauaaauugaaaaugguaaaacaaaaauuaaaagcuauagcgcaggcuaaaaggacgguagaaaguuuucuucaaaaauuaagaacccaagguuauaagaauacuaaaaaguuaagaaauugagaugauuaaaauagacaaaguagagaaguuggguuaaauuuuaauuuuuaaaggaagccagcugauuguuuuaacuuaaaaugaacaaaaauacauuuaauuuauucuauauauauuuauugagcgccuacuguguaauagguaauauaaacuucugggcuuuguaucauauuucuauauuuccuauccauuuaccauauaugggaacccuacugccacccuguuguaccccacccucaaaaugcgcacaugcgcacgcacacacguuuguauaugaaagcggucaauuacagguggaaguccucagggcuucugcuucacugccugugccucagcuauaucuuucuggccauuugcaggaggcacuaucauugucaccauuuguguguaaccgaagcuucaagcauucuagauauaaccuccaucugagcauaaugaaaagacaaguuauaucguaacaaucucccucuuguuagcucacaagcuauaauuuuagguuaccaucuuccaugggggaaauauaugcuuuuuauucucuuuguuacaucucuaggauuugggguuucuauuaugcugguugcguauuccuuugcuaaauuguucauggaauucuuugacaugaaaucaaucugcaaguaucuuuugagcaccuacauacaccuaguacagugccgugcauuauuuaggaagaaggcgcaaucauuucgaauuauauuaugguugguuuuuauaaucucuuaaaaaauauuuguagaaucaauaaccaguguccuuucuuauuauuuagacggaagugaaaaugugacaggauuggaccuuucagauuucccagcauuagcagaccgaaacaggagggaaggaagugguaacccaacuccauuaauaaaccccuuggcuggaagagcuccuuaugguaauuaagcuuuuuaaugauggccaguagaaaguuuccauuguaugugcacacacauauacauuuacauguacguauacauaugcuuguguguguacacauguauguuugcauuuucuaaucagguuaguguaauuuuuucagaauugauauauuagaagugauuuuucuucccagaauaccaugauagcaaaguuaaaugggaaaacuuuguacaaaaacccaagaggaaguccucauugguauucagaaguuauuuucuucuguuaucccugccuuaguuuaccuuaaguguuuuauuuuguggucugccuuuucucuccuuaauugaucacacauuuuuucaaaauaauauauuccuggugauuaauaaugacugacuauacauugaagauguuuuucugagccaagguuuuucucaaccuccacacuguugacauuugggccagguaauucuuuguagagaggagauguggggggcuauuguguuuauacagaauguuaagcaauauuccuggccuuggccuacaagaugcuaguagcacuuucuguuucuaacccccauagccucuauugugacagacacaaauguuuucagacauuggcagaugucaccuggggaaaaaaaauugcccccuguugaaaaccauugcucaugggucauguauagcuuaugcagacucuuggucuccguuaauauccuucaucacccuuuuucacugucucuaauagauaagaaauuuggcuaaucagggauaaauggaaauaaaggaggggaaacauaugcaauaacaauauaacaauguagauaugaaaauucugugacagcaauguagcuauacuauuuuuaucacauaguuuuuuucuuuugggaaaaccugauagagaccaguaacaaaacggugaauuuaaaagaaucaguucauccauuauuuuaagauagaauuaauauuugaucacauuuucaaccaagaaggauuucugugccauucagauaugaauacaaauaacaguauaugaagaagggaaacauuuauuguuuauauucuaaaguuuccaaauuagucuccccaaaauaaaaaaaaaaaugaucugcccuggaaguugaguaccuagcuacuugauucucaguucagacucuaauguuuuuaaccuuuccucauagguccauuuuuucaucccuuuaaucauucccguugcucuccuuggaccaucucuaguuucuccauaucguucuugaauuguggagccccaaacuggauauuguucuccaauaagggcccgacuaaugccaaguauagugggaggauuauuucccaguucuugcauguuuuacaucuauaacauggaguccaagaaaaucugaaauaauauggaguuguuuuauaauugauugcaauuugcucacucuguaagucgcuuucaaguagaauacugacauauucuuuuaaauuuuauuuuguucauuuguauuugagaguuaacugguauuuauaauaucuagucaaauauuuaaauaaaacaagcuuuuaaaccaaaauuguuaauaauuaauccaauaucaaauuaaauuuuuaagcaccuacgcaugacauggauuacuguugauuucccuuguauuauuuuguauguugaguuauuaaucaguaaaugaaaauuuaguucuucauuguuacccuggauacuaauuuuuugaaguacgcuuucauagcauuaaaaaaaagaaaccuuuugguguauuaucaugaggaaaguuaacuuuauaaucuguagcaaaauaucauaaauaucaauugcaauucuccggauuauuuucauuacauaguuggaaugguaacaaaaccagcaaaugaacaaucccaggacuucucaauacacaaugaagauuuuccagcauuaccaggcuccagcuauaaagauccaacaucaaguaaugaugacaguaaaucuguaaguaacugagaaguguguaugugagugauguaguuuuucccuucagauuucucuuauauuaacaauuacuuacuaaauacuauuacaaaacuguuuuaucuugauaucuguaauaaccuaacuucugaagaauguggaaaagcuuuauaacuuagaagauagccuauuuuuuuccuauuucauauagguuugcaaauuucuguugaacuucucagaguuaauuuagacuuuuauuguagucccugucagcuggaucccaugaaguuugauaauauagccuucuaaggagcuguguuuuucuugaguaaguuuucuccuugaagaauuuauacacauuuuuauaccuguguugauucaaccaacucagcuucuucuuucugacuuaacaaauauguuuauuucuuccacauuucacugaaaauagcuuuucucugugugugaugggaguuuauauauuauuaaaauaauugauaaagaagaucgguaagaauuaaaauaaguacaaaguuuuaaagcuuguaugucuaacuuaucuucaagguagcuuuggugauuuuagguaauauacuauauuuaguuucucuuuuacaugaaagcauugaggaguguaacuucaaguguaucccaaagcauaaagaccugagaaagagauagauuuuuuuuuuucugugacugaagaucugagauaaauaagauauuuucccuugauuucuuuuucuuuaaauacucaaauguggaugauauaggauuuauuuguauaccauggaacaaugauggaaacaauuuucuauagaacuugaaaaacagguaauaauuuaacuaccaauuuaaauguaauaaagaauaaauagcaagguauuaauaugugaacuugaauuuguauacuuaacaaauuuuaaugucacauuuaauuuuuuucaugcuagaauuugaauacaucuggcaagacaacuucaaguacagauggacccaaauucccuggagauaaaaguucaacaacacaaaauaauaaccagcagaaaaaagggauccagguguuaccugauggugggacucuagaaaucuaugucaaagauauuauagaaugcuuuuuuuucuauuuuuuaacuuuuucuugaaaauaaaagcaacuguguuuuuccuacccaggucggguuacuaacauuccucaagggauggugacggaccaauuuggaaugauuggccuguuaacauuuaucagggcagcagagacagacccaggaaugguacaucuugcauuaggaagugacuuaacaacauuaggccucaaucugaacucuccugaguaaguuuuuucuguuuuuccaugucuguauauaauaccucuucagacuuccaguuuuuaauaucaugucaucaaauuaucucaccuacugcuacucauuguuaaccugcugauucucugggucauucccauucauguuagcucuuagaucacugucacucugcaguauuccuuuuauaauuuggcauuuuaugugugugugugugugugugugugugugugugugugcaugugcauguauauauguguguguguauauauauauauauacacacacacacacacacacaccuuccagaauccugaaaucucagcuccuugaauuucuuuccuccaggaauuuuuguccuguaguauacuucagccacuccuuuaguuaucccuuugaccuagucauuguucguaacugcagucucucaauuuuaaaaucugagcucgcaugcuuuccgacuuccacuuucuauuuucuauuucucuucuucuaguacugugauuccuguaaucauuucacuccauugggaccuucaaucuauugauucuucgguauuuuaacuguucuuccagauccccgucucuuuuccccugugaucaacucccuucuuacccaugaaauucuguggucagucauaauuguucauuuacauaucccaugacuacuugccauuuucucauguuguuauacuugcauggccaaagcuacaguacugauuguuucugccuauuucauuccugaccugugcuacugagcucugcuagagaaaaacacaugauaucacugccuggucuuccuuuauuuucaugcccaggagccucaaaaguaggcucuuaauucuaccagugauaauuauaccuugcaugcuuaguccauuuacucuuuugcucucuuaugcaacuaucguacacuucugcaugccccuaauaccuuuucuccuuauucuuacuaucaaaugaugaucuugcuuuucacuuuuacuguacuaagaaagauggaagcaauuagaagagcacauuuagcacagucuagccaacaaaucugacuaccuacagccaccuacaccuauguuauucuuguuuuccacccuauuaccauaauugacccaugcguucuacuuacaacacauuuucacacuuuguugggucauuuucaucaacauagaaauacauuguuacuucucucaucuuagaagaaaaucuuccuuugauccaaccuccuccguaaguuacuuucccauuucuuuauuucccuuugaagcgaaacuuuucaaagagucaucuccauuucuccgacuuggucuucucccauucucugguaagcccauuucagucaggauuuugucccugccacuucacuaaagcugcuuuuaucaaggucaccaaaugaccuucauguuauuaaauucaguggucacuuggaggaacucuugcuccuugauacacauucuuguacuugaauuugagagcaccauuuuuaccucaucuucacugguuggucuuuuucaguuuccuuugcugguaccuccuccuuuucuucuugaccucagugucauuccucuucucugcauuuacauccuugaugaucuuuuucuagucuuauuguuuuaaauaccauauauauugaggaaucccaaacauauguuuccauuccacacuucugaguuugagauuucuacauucaauugccaauuaaauauuucuugaaugaucaccccccaacuuauucugucuacagccuuuccaaucucaguuagugguaacucuguacuuccagaaacuuggcauuauucuuaacuccucuuucuuuuauaccccauaaucaggcuuuucccaaaauauauacagaaucuaaccaaagcucacuacuuuuaacugcuaccacccuuguuugaaucauucucucuugccugaauacuccauuagccagucacugggggucccugauuguccuuauaccccuucccguacaaucucuucauauaacagccaagacaauccuuuuuuaauacauuacuccucugcucaacacccaguaaauguuugugguuucauuaugauuaaaaaccccaaaucuuuuuuuuuuuuuuuuuuuuuuugagacagaguauugcucuugucgcccaggcuggagugcagugaugcaaucucgggucauuacaaccuccaccucccagguccaagcgauucuccugaguagcugggauugcaggcaugugccaccaugcccagcuaauuuuuguauuuuuaguagagacgggauuucaccauguuggccaggcuggucucuuaacuccucacuuuucaaguggucugcccaccuuggccuuccagaguauuggaauuauaggugugagccaccgcgcuugaccagaaaccccaaaucuucacaggccugcaaggucuuacaugauuauuguuuguccccuaaccccaccucaacagcuuuucccuuuguucacuguauuccagcuucacuggccaccuuguuauaucucaggcaugucagucaugucccugccuuaguugcucuaggaguucccucagacuagaagagucuucugccagauaauuaauaugacuaugucccuuauagccuucaaaucuucagaucugaccaccuuaaugaaaccuaacugaccacccuauuuaauaauuaugcauccagucuccccucccaguuccccucuaacaugggccauuguuuauuuauuuauucuguuaauugauuuugucugucccccuccaauccaccauccucaaccagaaaguaaguuucauguugucagugaucuuguuuugcucacugaugugucguaagcuccuagaacagugccaggcauauaauaggcacucaguaaauauuugaugaauuuaaacuuuugcaaauaguuacucaguuuucuucuugccacacaaauaaaugggaaauuuauuuaaaauuuauuuaaaauuuaauuuauauugggagcaugguauugaagaauuuaaagcaucuugaguugaaaucaaguaaaaguagaaaauuuuuaaucauguuuuguauauugugauauguuguguuauuuauacuguauugcaagaauacugagggaaggaguccuaucauauuuuacagacacacacacaaacacacacagucuucauuugcuucuguauaagucaguaaacccaaguaagggaauuagaaguaaagauggucauuuuacaguuggagucuuuguuuuuccugaaauaaaauuagaaaucucuuuuucuggauuucaaaauguuuucuuuuccuccuuauucagaaaucucuaccccaaauuugcgucacccugggcaucuucaccuugucgaccucaagacauagguaggagaaucuauuuguguuuagaccuuuuaaaaagaaauuuacaauugagaaucaguuaauaaggcuuuuuucauuuuauuauccagacuuccauguuccaucugaguacuuaacgaacauucacauuagggauaaggugaguguaguuuauuauucuacucagucagcaugaauuuaucuauuuuucacauguuuuucaguucaggcagcauacuauuuuugaaauaauuaguaauggucucagggauaugcuuucauauguccauguuaacuuguuaaaugguaaauguuaggacugguaaaaaauaaaaauucuuacauuuaacaacagguuacaaccauaaccgcaguugaugagaauaaacuagauuggaacauuugauaaauauccuucugauaaucuuauuuuaugaccuuaccaguaaaaagauuuucguuacaaguauuacagauacaguguuuuuaaugagauggucuguaucuuuaaaaacuauuuaugaccuuugacuuuucucuguauuuuuucauuuccauuuuuuuaaaucaccuaaaauucuaauucuaaaguaguuauuaacaacagauuacagcuuaaucucucuuuuuucaaucuaagaaagaaaaugguggcacuuuuugcuuuagaagaacugagaguuuguuucuauuaccaaaaaauauucacaaugguaccuaaauuuuagccuugggaaacuacaauuuagugaaaaaauauauuuuuguuauauauuuguguauaaauaucuauguguauguguauauauacaacagcauucugagugugccuuacaguucuguggucaaguggauguugauguggacaggcaaguaaagggauaccuuucucaaugucuucuaauacuugaguagauaaaaggcaagaaauacaagauggagaggucuccuauuuucuauuugcggauugugugauuugcucccaccaccacuguagagcucuuucgcuccaauuaccaaaguguuccagaaccuuuucuuauuaccaauuugagaaauacuaauuuaggagaauuugucacauuggggcugcugccugaauagggauaacaugaauggagagaaaaauuacauucagagaauguguaauaaccaaauaaguauuucgauauaggaucaaauaacgagauaaaaauguuguuuugggacacuuuuaagguuuauuuaaaugugaaaauuugagacuauugaaccuauguuuuacaguuugguaagcaguuauguuucuaccuuggggagagaaauguaaagcaaucaucuuucagacaucuauuuaaacaaacugaaaagccauuucuuuaugauuuuuguauucaucaucugugauuugcugaaagcauacaacugacuugugaaucauucacugucagauauagauucaguuuaacauuuuuuauaagccgucuauauauuuggcacucuacaaggugcuuucauauaccuucacucauuuuauuuacuuucuuaguaacccucauaggugucauuguccacauuugacaaguaaagcuaagagauuuuaaauaacuaggacacagucauauuaaugaguaauaaaaccaggacuugaauacaaguccuagaucucugagcacaaugcuauuguuagguucuuuuccccauuggguauuaaauccuuuuaguggaucuugcuuggaagucuuuauugagcuuuucuuccagucagcauaucaauuagauguaucagaaauaauuguuuaaaugacuucagucauuuaaaugaggaaauucccuuuuagaaucuuaacuaccuaucuguguaaucauguaauaacaguuaucuacuacaaaguggggaguuucuguuuaucucuccauuuuuucuuuaguaguagcaacuauauauuaggauuugcagauuuguuuuauauuucagaauaaguuauuuuucuuuuucagcuggcugcaauaaaacuuggccgauauggugaagaccuucucuucuaucucuauuacaugaauggaggagacguauuacaacuuuuagcugcaguggagcuguauguucaaaguauuuuaaucacuuuuguauuauaguggaucuugacuaugcugaaaacaucuuuaagugaugauggcuaucuuuaaauggaacuauuucuccaucaagaaauuuauuuuuacauuauuaaagugaauuuaauuuagauuaaaaccguaucuuaaccauggcuucauaaucuauauaccuaaaaagaauuucaaacuuaaugcugaagcugggugcaguggcucacacuuguaaucccagcacuuuggugagguggacagaucacuugaggccagaaguuagggacagccugggcaacacagcaaaccacauuucuacaaaaaauaaaggaaaauauuagcuaggugugguggcacacaucuauauaguccuagcuacuugggaggcuacagcaggaggaucgcuugagcccaggaguuugaggugucagugagcuaugauugugccauugcacucuaguguggcugacagugcaagacccugucucuaaaaauaacuaauaagugccaaauuuguaagaagacagaauugacauaacucauggauuuggugaaucuaauuuuuguaaauaugugaauuauaugauauucaugacuauguuuuuuauuccuuguggaaccauauguauaaauaauucgauacugaauuuaaucauuucauaaacauuauuacuuauaagcaaggcagugugcauauuuguuguacguuuugaagugcugauuaaaguccacauuuucauuaucagcagucuauuggccaguuuaaacaaauauuaauguaaagaaauugguucauugauauuuuuucccugagcaguucuguauuuaccugaugcucuaaaauuaaguuuucugucguuacucaaauguacaguuggcaacacauuuuguuaucaauagacaauuauguuuacuauagaguaaacuauuaguaauuauuuaugaccuuaugauugggagaccuuuucacaaauuuaaguauuucauaacauuucuaauaacauuucuauaaauggcuuuggaucaaauaguuuaaaguauauaauucaguauguugauaaugaauuguuucguuucauuucacaacugagaggauuuuucccuuauguuuuuccuucauuuuugugagaauagagauuauuaccuguuguuccuuuuaauuguucauaaguaaauaaauacauucaggcacucauucaucuaucacuggcaguucuguuuucauauuuuauuuaugucuuaaaaacuaccucaugacguugguaggaaagcauuucuuuacauggagguuuauuuugugggacauuaccuccucuggauguuacuuccucaguuuacaaguaguguaaauucucauugauucuuuuaugaauuguaauggauuuucucuuagcuuuugagaauuuagaaucugaaauuugaauaaaaaguaaauauauucaguauaauuuuucaaaaugcucuaguuucaagauaguuaaaaaauuauguggaauuuacauaauuaauucaaauauaguuuguauuuaguuccuuaucaaauaaugcaaauaguuggagauaccucaauuucuuuugaguguuaagaagagcaagaaaggagugaaguuuuugcaacacauugugucuuuauuuggucugccuauguuuuuaucacauugcuuauaaaacuuuuaaaauccuuguuuguauaaaaaguuucuuuaguuaaauaaaaguguguguauuaauuagugugccuucuggacaaauuaagaaauauuuuuucuauauuucaaugcgguuguauuuaauaacuuauaauaaaugaguaggaagcauucauauuuauuuauuuuauguguaauuuuuuuuuuccggaggaaagcuuuacaaaauguagaacauguuugauguaagccacaggaaaaaguuaauuaucuuuucuuuuaaaaauugaaguuuuaaccgugauuggagauaccacaaagaagaacgaguauggauuaccagggcaccaggcauggagccaacaaugaaaaccaauaccuaugagaggggaacauauuacuucuuugacugucuuaacuggaggaaaguagcuaagguauauuucuuuccaugugcaaauguauaaaucuaaacuugaaaaaagaaguguccucuuuuaucuguuuauaaguaccaauacauccaguuccaguaaugugccacauauuugccaacuguuuaauuccaucuccuuggcuugacacucuuagaagagugucccaaaacaauugguuucacugauaguuacauuauugaauuugguaagagguuuuguaauuuugcauaagccuugguaacauuugaaauauuuuuugugucuacugcuuuguaaaauaaagauacucucuugcaaccccagucauauauuuuuauauuuuuguaacuuuaagcaaggaugagauuuuucuaaaagcaguauauaaacaggcuuuuuacacuuggacuaguugcaggaaauacaucugaauguuuauuugcaaguaauuuuaagaaagaaaauuacaggcguuaacuaugacuauuucugugacuauuuugcuaaauauuggggagaaaucggcuauggagaaauguugauuauuuuauuuugguuuugcaacuuuuccucacuuaaacgccuuucuaaccgucccaugugcaaaauuuucaucagugucaaugcauauuucauaccugcauuuaguacguuguguuuauuuagucugccuaguagagaauauauuauucucuacauguggagagaauauauucucuccacucuauauauuauucuccacauuaucugauuucacaacuccaugauuuuucugauacauuuuccaucaaugauucugagguuuauaauuaaagaguuaaauuuguuuguuuuaaauaaauuuaaacagcagaaaaauguuucugacaguucuuuggacaauuuuuuaguugucaauuuguuuuuuuguuuguuuguaguuuugaaucugcuuuacuaaaaugauuauuuaaaaagguaaaacauuuuaagaagacaauguaaaaugccuaccagauauuuaucacaaaaauuuuuacaucccaagauuucauauaaaacucaaaaagccgggugcaguggcucacaccuguaaucccagcacuuugggaggcugagguggguggaucaugagaucaggagaucaagaccauccuggguaacagagaaaccccgucucuacuaaaaauacaaaaaaaaauuagcugggccugguggagggugccuguagucccagcuacucgggaggcugaggcaggagaauggcgugaaccugggaggcggagcuugcagugagccgagaucgcgccacugcacuccagccugggcgacagagcgagacuccgucucaaaaaaaaaaaaacaaaaacagauguccccuaacagacaacaccaaauaagauccacauaagaaauuaaaucuuuuuuuuuagauguuucucagugguaaaugucuuuacuucucagaccaaguccacauacuguauuuuguaucugaauuauuuuaacaguuccaauucaugugacuauuguguuuucagaagguguauuuaugaguuaaccuucuaguuaaauaaucacauuaauuaaaaauagugccugagcuauuguauauguuaccugcuuuuuaagauauguaguauacaguagaaagcuauagccuuuguaucauggauuugaauuuaacuccuauugcuguuauuuaugcuuugaccuucuacaauuuucuuuuucaugccuguuuccucuuuuguaaaauugaggugagauuuuccucuaaguuuuuaugaagauuaaaugagauuucauauauguuuauauacacacacacaugcugauuacagugcuuggcacacguuggguauuugauacaugguggugguuguacuaguuuacugcuauuguuuuuaucaucguuauuauagcuacuguuuuugcaaggaugaaaaaauuagagcugauuguuaauuagguuaggucauugguucucaaacuauagcuuguaucagaauuaccuggaaaacuuguuaaaacacaaauuucuggaccauaccuccaucauuuaugauuuagugagucuguggguggggccugagaauugcauuucuaacaagcuccuaagugacgguaguaaugacaugcuggucuugguccagaacuauauuuaaagaaccuguggauuaggugaugcuacaggagucaaaaacaucuuuggaagaagaaaaaaauuuuauuaggaaagaacugaaguuuucuccauucaauuugaacauuuuugcucaauauuauuguaaauuauuccaaacuuacauauguaaaaagggguggauauuuucaguaaacagcuacauaauuuuaguuaaauuuuguuagauauauguaugaagaaaucaauuugugagaaaaucagcuuuccagaauuaaguucuccucaugaaguuaaauauuuagaaaacaauguuaacauuaauguaggacuccuuuaauuuccagcaaaagcaauuccucagucagguaaaugucauuuuaaagaaaauuguaucuauuuaaauauggauuuacauauuuuuuauauauuauauauaaaacauaauuuagcucaguuuuaucuaucguguacaguugagcuuuugucuuuaucuuuaaauuuuuuaacugugaugugaaaaaugugagaaauaauaucauuaaguuacucccucagaaaucucuuucaagguaauaguuuguugguaccuugcacugacacgcuuuaaaauuauuuucauaguaaugaaaacaggcagaauuguugguauuaagauauuaaugagcagcucacucuugguuauauuaaaauacaaauucaugcacuuaaaauuuugaaguugcaguauauuaacgggauaaauuuuucaaaaaauucuuuaaaggauguguucagugcuuucccagaauauugauuaguaauuaagaaaucugggaccuguucauaaguauauuuauuaacagccuucaucaaauuauagaaaauccauuaacaugucaugucacaaguugaguccccaucuguaaagugggugugccuuacuauucacaguuaaagaacguauauuaaauaaccucaauucacuguaagaagccuacaguaugaauuaacauuuuaaauaauagcugauauuaugguguucuugaaagguacugaacuggucuacaccauaauccuggaguccauucauaauauuuuauguccauucauaauauuuuguaugagcauuuuuccccaaaucacuuacuauuuucagauaauuguaauauuaaauaagggauuagauaaucuaaaccagaaguauuucuuauccucuaaaaauuuugugacccugaguucuagaauccaauccauuauuuauuuacauaauuuccuguaaauaauauauacauuaaaauguugacauugguugggcaugguggcucaugccuguaauccuaacacuuugggagaaugaggcaagacgaucacuugaagcugggaguuuaagaucagccugggcaacauagcaagacucugucucuauagaaagagagagagagagaaacauagccagguguggugguaugcuccugcaguccuagcuacuugggaggcugagguaggaggauugcuugagcccaggaguucaagguugcagugagcugugauugcaucacuauacuccagcccaggugacagagccagauccuauuuuuuuuuuuaauuuaacauuguauuuugcuuauucuuuccuuuuauauacucauuaacuuuuuagcaggccauguucuccugugucguuuugcuggaauuacucauauuuuacuaauuuuaaauuugcagcaauucagauaguauauauaaucuucaugcauuaaauuuuuaaaauaauuucuuccacaguuaauuuuuaggugauagaggcugccuuauuaucaguagcuuucucaaagacuuaaaauuuaagaauucuuucggccuaauuugaccucguggaucuaucaggauuucuaacaguuaagauuuuuuaugucacagucugauauaaaugugauuuuucauuaauuucacaguuacauauuaguacauccuuauacuuuaguaauguguacuuuucuucaaagauuauuucuaauaacuguauuuaagauaguuugcuacuuccuaaaauuuaaguuaauauggauuuauuauacagguugagcauucugauucaaaaaucuaaaaccugaauacuccaaaaucuguaacuucugaaugccaacauggugucacaaguggaaaauuccauaccugacaccuuugcuuucugaugguucaguguacaguguaaacaaaccuuauuuucugcacaaaauauuaguaacauuguauaaaauuacccucaggguaugugaauaagguauauauaaaacauaaaugaauuucaugguuagacuugggucccauccccaagauaccucauuuuauauguauaaauauuccaaaauccaaacacuucuguucccagaauaagcaaaaucucagauaagagauacucaacauguagguaagagaaagcugacauuucaugagaauuugagaaaacaccucugcaguguguguuucucuacauaacuagaucagugauuacauuaauguuuuuguaauauuauuugacuauaugaauccauugcauucaguuuugcuugaauugaacaaguaaccuuuggagaauacauagccuaauuuuauuaauagaagaacuaagguaugaaaaaguugucuaaaaaguauuuggaacucuuucuagccuuugcaaucauauuauaaucuagaaauccuuuuuuuuccacuaaaagcaaauauauacauagacccucuaauguaucauuugauaauauuagaaaaauuaaauguuuuguuccuaaaacaaaggaagaaagcuuguguuuauucaucauauauuaauuacacauccauuaggggcuuggcacuauuccaaguuguagguaguaguauacaaaguagauagacacuugcuccuacagaauguaugagguugugcauguguguaguauguguguguauauauaacaaacauguaaaugguguuaccaguaaucaaaguaacuuauguauuuuaagaagaauaaaaguacguggaaaacaagauuuuaaaacguggaaggcaaaauuuuaccuauguaauuucuaaaucucugaucucuauaucaaaauuucuaaaucucuauaucaaaauuauuuacgcugcuuagguuuaaacuauauuuuucugggggaaaauguacauugauaaaguuaaucuaguuugaauuccuagucauacauuguaguucaucaaugugaaaaauuuuaguuaacuuacucaguauaacuuaccacuuuguggaaguuacaauuagacuuuuuuucccuguaacuacacauuuugaaaacaaaaaugccaauuuuaauuucagaagaaugauaacaaauuuucuucacgaauucagauagucaacuugaaccaagcaauaaaauuauuuuaauuccuagcuagggcugggagagggggaguagugcuacacaguguauuagggcaggaugucaugguugugguggugauucugguguuugcuaauuuuuacugauaagcaaauaaccucugugucuuaauuacuguaccagucacaugaaggcaaccuuuucaggcuaaagucaccaugguguaccuucuuuauaaacucucaggggacugauuuuuuuuuuccuuuuucuucaccuuauaccaagagagaaggggacugaauucuuucagcauuucuggauugccuuguaaugaaguaaaugaaucuguuuuggaucuuggacuaaaaauauuaaaaauaauguguuacacuacaaaagacacaggcuuuuugucacauggaggcuuuuugucacaugggucuggauccuaaugcuaggugugccgcuuacugaugacuuguccaaguuacuuguaagccucauuuucuucagguacaaaaugaaaauaaugauaucugcuuuacagaauuauuacaaagauuagaauaaaauuagcuguaucucuaauuuuagcacauacuaggcuuucaauaaauucugcuguuaggucuguaauaucuuuaaauuuauuuaaguguaauaucuuuaaauuuuaaauacuugguguuccaucuuaaaauuuggucauuauagucuagguuuucauuuuaauuuaauaauggaaauacucaucauggaaucaguuugaaaccagacagauaagguaaaauauguuaacccaugguagcuaaugucacuuguugccuuaaucuuuaauacauaauacauauuaagcuucauaauucuuuaaguuggauuaugcaguaauuugugcuaauucagaugguagaauugguaagaggcuuuuagagccucuugcuuauugggguugcagagguauuuguuguuugcauuuuuuucuaauauacauagcuauucugcaucucuauucuugaucuugggugggaaguaucaugaagaaauuaugucaccauucuuaaauuuuaaaacucaugaaguuaauacaguauuuugaaaguuugauuaaagugagcugcuaucuaguuuucaaauguuccuacagcagaaccauugucuaguuuucgguggcaguugauuuauauuugagucaggguuuuggguuugugaaaugcaagucuagugaugugugaguuuuaaguucauuauuuuccccagauuuuaaugagguuagaauaauuuuauguguuuuccuuuuuuuuuuuuuuuuagacggagucuugcuuugucaucugggcuggagugcaguggugcaaucuuggcucacugcaaccuccaccugccagguucaagcgauucuccugccucagccuccugaguagcugcuacuacaggcgugcaccacuacgcccagcuaauuuuuguauuuuuaguacagacgggguuucaccauguugauugguaaagauggucuugaucuccugaccucgugaucugcccaccuaagccucccaaagugcugggauuacagacgugagccacugugcgcggcccugcuuauuuuuuaauauaaauguaauaaagacaauuuggaaaauuauuucuaaacuuuuuucauggacaaaaucuuuagguuuuuauacuucguugaagggggcuuuauuuuaaauauccuguaauuuccagugauucagagauacaguaauugcccccucuuuuuuuaaguuaaaaacaauacacaacauuucagugucaagugguccauuaguagucucuugacuuacacacagaaagccugucuguauuuuuuguacucauugguuagaaacuacagcacauuauuuuucuucaagcuguauuuuauguagaggaaaaacaguugguauaucuguguugauguugauucauauauauuggguauuuuauuuauuuuuauaguaaaauguauuuugacaaauguaaaaugaaaaggggaagauaucuaaauucuugaauuuguuuuuauaggaguuccaucuggaauaugacaaauuagaagaacggccucaccugccauccaccuucaacuacaacccugcucagcaagccuucuaaaaaaaaaaaaaaaaaaaaaaaaagacuucccuuuucuugggguauggcugucucagcacaauacucaacauaacugcagaacugauguggcucaggcacccugguuuuaauuccuugaggaucuggcaauuggcuuacgcaaaaggucaccauuugagguccugccuuacuaauuaugugcugcccaacaacuaaauuuguaauuuguuuuucucuaguuugagcagggucugaauuuuuucauuuauuuccuuuuuugccagcagacagacuugagucuguaaagacaagcaaauacacugacagaaguuuaccauaguuucuaaaauguaaaaaagaaaacccccaaaagacucaagaaaauuagaccacaaauuuugcauuguucauuguagcacuauugguaauaaaauaacaaauguuugugcauuuuuaugugaagauccuucucguauuucauuuggaaagaugagcaagaggucugcuuccuucauuuuacuuccccuucuguuuuugaaaggcaguuucgccaagcuuaaugcaagaauaucugacuguuuagaagaaagauauugccacaaucucuggaugguuuuccaggguuguguuauuacugagcuucaucuuuccagaaugagcaaaacacuguccagucuuuguuacgauuuuguaauaaauguguacauuuuuuuuaaauuuuuggacaucacaugaauaaagguauguauguacgaauguguauauauuauauauaugacaucuauuuuggaaaauguuugcccugcuguaccucauuuuuaggaggugugcauggaugcaauauaugaaaaugggacauucuggaacugcuggucaggggacuuugucgcccugugcacuaaaagggccagauuuucagcagccaaggacauccauacccaagugaaugugaugggacuuaaaagaagugaacugagacaauucacucuggcuguuugaacagcagcguuucauaggaagagaaaaaaagaucaaucuuguauuuucugaccacauaaaggcuucuucucuuuguaauaaaguagaaaagcucuccucacugcag

SEQ ID NO: 16396 - RNA, 85974 nt, Homo sapiens
ugaugcaacaggacaauuuaaaaaauauaccaucuauugguaagaacucuuacuauaagaauucuuacuauacaagccuuuaacaaaugcuagcucauuaaauaccuagaguacccucuaagguagguauuaaaaauuuuuuaacaaauuuauaauagauuuggcacaaauaauaggacaauuaaaggcuuguucuucaacccggcuuaaagugaauucauccuaaacaaauagguguucagugagagucaaaguaaguaguaucaaauauugaaaguaauaguaucaguguauuuucuccuaacacuccuaacccacacauuuauuaugaaaauguuuguuguucuaucucuuccaguaaaauacucaagguaauaaaacucucauaucagacuuacacccucuggaagucauuccauagagguauauucaaucuuuuaacacaccaucuuaugguugaagauguuaacaugagaaggaggagaaagcaggaagaggaagggacuauuugcagaagacggggagaaagaaaggaaagacacuaguauguguuguuccuccucgaauuuuccugaagugaaaaaaaaacagugaaguagaguguuugaugaaaugaauaaccaagcaaaacauuuucuaccuacaccaguaccacuaggaguugaaauaaauucacacaaugucugcugauaugucaaaacaccuuaccuucaaaaacaugacaguuaccuuuuauuuuauaguaugcuuguguuucuuccuauuucuugcuuuugaccuucaaugauaaauguaaacuggauuacagugauucuuuuguaaguaaaaggugacuuuuuaaaagaaacaaccaauggaaauagaaauuuuauuuacuucaaauuaacuguacuuuacucaaauagaaaagaauaauuuucacauuaugaagcuacacaauuccaaaauacacaugcugaggcucuuuuuaaguccgaauugucuaguaauuacaaaaaagugaagaguuuacagauauacaaggaaauaaaggcgaauuauugcaaagaaaacaaguuuaauuucacuuugaaugacaacgauuuuucuggaaagcagauacuucacuccuuuaaguuuccacccaagccacaauaauuucaaacggucuugcggaugacccagcuggucacucuuguuuauguggggacuggagguaaugagagccaaaaaaagugcuauaaaccuaauuuggcuagagcaaguucacacgacacgaccgugcuuuaaaaacuugcucuccauuauguacuuccuuccaucagguuggggaaaaaaaaaugguggggauggugaguaaacacaccagugguuucaucagaggggaacucacuacucaggaggugacggugacguggugccggucccugaaguacgcgcacaagcuccggagguugcgggagcugagggaggaaacagggacacgaucagauucgcuccagguggcgggagugaggaggggaggagugacgaggcggacgugcgggggcggggguguccaacacaaacacaaacacaaacacgaacacgaacacgcucagcguccccggggagggcggacugaagccaccucaccauucaucgccccuggaccccgcagucccccucggacucagggccagagccuucugcgaagcaaccuagccccagggaaacgguagcggccgcagaagccccgcucucuguaacggccgcggaggagcagcaagccucccugugagucggugggagacaagacggagcggcgguaagggcgguagggaagugaagcgccucucuccaccuuguuagaagcgcgcugaaagcggccugccuacccaccccaucgcugccguuuugcagucgucgcucccaccuuccgcugccgccuggagggaagccggagcgacgggggucacggcggcggucagaggguaaaggucuugcucccagcagccuccgcgguggauacgucgccaucuuggauccgcgggacaagaaaauucaugcggugaguuuuugguaaauuuucggaagucuggcagcggggcgcgcggcgggggcggcagauucggggcccccgcaaggcgggggaaugccccggggccgguccggucgcgcccaggguccgccgguagcgucccggcccaccgcuucccguugcuuuugucucggcuccaaucgagagacggagagcggagcgggcggggagggggguggcggcgguggagggagggaggggguguguauggggguggugguggaccggacguaaagcgucgcuguacucgggccgcugcagcagcagcagcuccagauccuaggcccggucccauccgcgagugguggggcuuccccagacuccacuccccuaggcucccgccagcgcggaggagccgcugccgccgcgcugcuuccugggggagaagagaaggcggcagcggccguggccguggccgacgagcucgagcccgcuuuagacggcucugccgccuucccggcagcuggugcugucuguggcuucuuaccuucucucaauacacguauaucaucugccaguuauguguauuucuguuaguguguuugcaagugucagaugggagacacuggacuggcuaacgggugucaggauccugcaggcccugggauaccgaaggcugugcaugguggagggagaaggaaugcaacugcgaugccgccucugccaccgcaccaggaaggugaagcuuccguagugucguagacugaguccggaugauccuggggcggcggaggaaccacagacgcuucugucugugaaguugcaaguccuggguuucuacuuccgcaggggccucuccaccuuuugcugucguaggucucgcuuaaaaguuuaacagaagaaaagaguaggguuaaaagaggccuuuguaguucuucauugaagcacuguugucuguccgggugaaagcugauaacucuugguaacugugguccuuagcaaaagagaauuggaguuuucuuuuauacaaaguauuuccaagguuuuagaccuuauauuuauuccaggccuguagguacgguauuacuaccacaaaagucuuacauuaaggguaccacccucucagagggaaccuaaacaucaacuuccuucgaauccuuggagacaucuucacuuuucaacauccggaagacugagugcaacauauuuuguuucauuuucauaaaagucuuggucagagaaucccacuccuuuuaaaaucguuugggcaauuccucauaauuaaguacacugcuuugaacccuuaguucuuggcgaaaugguaaaaaguacucaguuaaaaucaguucacgagggaggccaacuugaauuuaagguucaaaguugaacauauuuagugucaugcuuaauauuaggaauuuuuagagcucggaaucauaagugugacuguugauuucccuuuugaagcaauauaaauggaaagaauaaaguauggggugagggaugagauagaaauuuuaaaguauccauuuacaugcaagguugauguugaguuugggaaugcuuggcauaauugacaacaguucuuuccaaacgucaaugaauaaaucucacaauuuuguaagguaacuauugcagauugaaaggguuaagaaucauaguuggcugaaaugguuaagugucuauauucacaucccaguucauugaaauguuuuauaauggaccaagauaauuaguaagcucuguauguugaauuuguuuaguuuguaguucuauuauaauguuaaaucuaaagaaaaaaauacaaaauacacuuaaagacaaaacauguuccacucuacucacuuauuucuugacuuuguaagauccuuacuguaaaaaagguacuuuucucucauauuuucugagagcuugaauuguaauaauuuuugugaauacuuuguauuuuagagaggaagugagaaacugcugaaguuuuuuuugcaucuugauuagugcuuuaucaauacaaauaaguuaauguaaacauuuguuggcaggaaucuuuuucuaaguauacaauguagagauaucuguaaccuaaucugaucucagggaaugagaauugccuguuuaaccaagcaacaaauacagccuauacaauuuuucaauuucuauaauacuuuaauuuacaugguggaaaaaugagggcaaaaugcuuguguaugagugauuuauauccccaaguaccugcucuugaagauaaaacucagauuguggcuuaucuucugaugcugggcaaaaaacaaaaacaaaaaaauucagaaugauacaacuucccauauaccucccuacaagaacuaauuaccuuuguuuuugcuuuauaacuuuggauguugcacuuuuugauuuuucagagaugcuuuacaguuauuguaaucugaaaauuauuuguucaaaaguaaauaaaauuuucagguguaugaauagauuuuauuagaagugauucuaacccaguucucauuuguauuccuuuaguagauacugguguuaaaaguaccuguauuuugaaagaccauuacagaauuuuuuacaaccuguauaaguuauaguuuuaucuuuucuagugacagacuuacuucauaagauuuucugauaauaugaauaaaauguaugcuucacauguauauaugaaauaaugaguaagcauuaauagaccaaugaaaagaacuuagcuuacaauuuauuuucuugcucuuuaaaagcagugguaaauaauagcuuuuuuuuguuguuaaaauuuguaacuguagaaaguucauucuguugggaucacauauuugaaggcaaacuaacaaugccaugugcuugcuugaauaggcauuugaggacagguuauuuuccugagauuucaggaaaauauaccaccaaacauuuaugauguuauuuguuaccuggaucuguaguggauuuuguaacacaaagaggcagaauauccaggguaccagguagggcaguuuaggggcagaguuaauaugagguguacuguaauguuugaguggaauuacauacaguguuaaucaagagaucuagugcuaugguagaacuuauucugcuugaugauacaggugacuguucuuccuuacuaagagcaguuucuaccugugauacuuaaagggauugaauuucacugugacuuauaucagauauuuugaaaagagcugugcuaaaguugaugucauuguagaaaguuugccuugaaguggaaugaaaguuagguuuuuauuucuuugguuuuucuguuugacauccuuugauuucuauuuuagaauucaacucuuaugacuaaucaugcugaugugguuuguucauuuauuuucuuugucuauacuauuaggaauguccuggaaauagaauuuguacuguguuuucugagagcuuguucucugaaauacagaugcaaaucuguugguaucuguugguauaucccuugggggugugcugcauuauaaaguaauaaaacaguuuacaauguuugcuuuuugucaagagcuuaugacauauaauauggaaauacaaaaaagugaauuauuuaggaaaaaaugggaaauuuuuccuuuucugggcacuucaggguuuuguauaugcguagacucaggaucuaaguccacuuagauauauaguuagauauuuuggacuauuugccacuuaacccugcacauuuucuuuuccuuauucuuuuuuuuuuuucuuugagacgaaguuuugcucgucgcugaggcuggagugcaauggcgugaucuuggcucgcuaccaccuccgccucccggguucaagcgguucuccugccucagccuccugaguagcugggauuacaggcaugcacccagcuaauuuuguauuuucaguagagacaggguuucaccauguuggucaggcaugucucaaacuccugaccucagacgauccgccugccucacccucccaaagugcugggauuacaggcaugagccaccacgcccguccuauucuuuuuauucauguguauguuauugcauguauguguguggggggcaggugguagugcauauuuuauguaucuuucacuucucuguuguuugaugaacuucuuccauacuccucuuugguaucacuuucuucauaaaucuuuccugacuccccaaauccuuugcuguauugcuuuuuacucuucaaacuucuauuauagaaugucacacuguauuguaauuuacuguccaucuggacugggagcaccugagagguauggccuugacuuguuuauguuuauguuuugaaugccucuauagugcauaauacuuaauagguucucaauacguaucuauuaaacugaacuguugcuagauugucauuugacagugcuguuucacaauccacagaucugaagcaacagauuggaaaagugguggggagaauagcuuccuguauuccuucacuuccuugaauccuuucuuacaguuuugcuucuuaauuacauauggaaaaauagauaacuagcuucuuagggaaguguguguaaaguuaguauggaauuagggaaggauguuaguaauagagugauuaauacccuguuuugcuucuggcaggauguuuagaucuguauuucuugcauuucucgcuguauuuuguaugguuauggcuauuaugugaaggagauauuuuguauuugucuuuacaagguaucauguuuaccaguacuuacccaugagcucauauuagauuuggggcuucugaagauagauucuguuuuucucaccuuuuuccuccuaaugccuggcccauugguuaguagaaagcaggauuucucuaguuugaauaaaauugcccuuauggaaauaaggugagaugugucuuauuggagguccaaaauuuaaaaagcucugaaaguugaucauuucuuuuguuuuguuuugaauaagcaaggugagaaaauaucaacuggaauuauaccugugaauuugauuauuauuaucuuucuuaaucugauuuuccuacauuuucauauggaaauguucacguguuugacugcagguguugccauuggcagauguuacaucauauaugauacauacaacauuuuaccuuucucaaaucugaaacuguguuuugagaaacaucuggccuuuauagguuuguuuaagagauugugagccaauuuucugcccauuuuagagauguagaaaucaaaacaggauagaugacucucagaauugcauuuuaguagauaugcuaauauugauaaugauuuuaggaauauuaugucuuaauugccuguauauguuccagagaccuuuuagugacuaagagcugccaaagauacagaguguauauuuuuaaaaagggaguaugauccaguacucaggacaccaguccuuucucugccuuuucugaauggaaaugucuuuccuuauacgugaguagaugaaaaugcacauuuaguaaguuuuuacuaaaacuuaguaaaaacuaaugauaaaaugagugagggaaaauuauguauccuggcaauuuagguaacagugaguagacuugcuuguuuuucaaacauauugauauacuauuuuuccauuuguguauucagauguugaaacagcuccaguuuguauuagcaucuggacaaaauguaaugacugauuauguaauacaauguguuugagagaggagcauuugguuuugugucauaucuggcaagaaugugcuuuuguauuacuuucuacauuguaaauuauaaugccuauccugcauacaaauuuuguauuuaguuuucugcuuguaagaaucuuucauaggucaguaaaauaaaauauuaaguuuacuaugccauuccaagcaccugacuacuuuuggcuuugcuacuuaauauuuuuaaaauguuuuacagcuugcagagaggacuuuuauauacauuaucuuaauuuuauauauauuaaaauaaguuuaaaacuuagcauuuauguuuauaaacaagcuauuuuggucaauaagaaaauuagaaguugggaauuaugaaggccguuuucaucuucagacuggacucagagucuaauuucuuucucauuuauuuuagcgcuacuuuauagagaaaaucgugauuuauuaaaucaaauagauguuaauggaagacuuguuuuuguuugcaucugaucaucuugcagauccuggauauuuaaucaaauugaugcagaaguuugaaagacaagcagcaguaggaaauuuuuguuucaagcuugacuuuucugacaauauccaacagcugcucauauuuuuaaaaauuagaaacauucacugagaaacguuaaaaacuuaaaagcaaauacuguguuauaaugagaauagguaauaacauaucauugaugcuacacuuuacauauuauugcaccauuauucugagguaaucauaugccgaacagauuacugcacaaaguaaugcuuuagggguguaguuuuuaugggaaugaacaugucuggccugaaauuagaaaaaaaauuggagccauaaucuuucuaaucuaugcuugcuuaugagaaauucuagguauauuuaugucaggccaaacuauuugcuacagcaaaccgguuaaccugacaucugagauagucuuuaaaguguuuaaguuugguauacaaugcacuuguguguguauaugacucauccuaaaauggauggauguguguaaaaaaauuguaauccaaugcuuaaaugaauuugugaagcacaaauaagugaaacacuaagauguuucagagcauaguuugaaaaucccugugcucgaucaccaaagucacuuccaacaguaaaauucuguguauuuuaaaaguucuuuuucuauucccugcacaugcaaaauucauauaauuuagcugcuuuuuaguaguauuuggauagaaauuguuuauuaaauuuaaaguugaggcucugcugguuauauguuagcacucuagauguuuucaaguaaauccuuuaguaauaugaguguuuagucucugcuugacauuguuauuggauauaugacggugauccagacaagucuccaccuucauuaauguaacauucuggaggaggagacagacaguaaacaaauaaauaaacauaauuucagguaaugguaacuuaggaaaaaauaaagggggauaaagguacagcaauugauuagaaauggaaaaaagauuaaguagggugaugagagaagacuucuguggagguaucaguugagcagaaaggaguaagccaugcagaaaugugguugaaugguuuuccaggcagaaguaauagaaggcccugagauagggucaaguuuuguauguuugaagauaagaaauuucauaaacaauuacuuagugcuuucugcauaaauggggguaagcucuaaaggggagaagaggugauuaaagcauaaugaucugugucuuucacuucagaaaauauugugguggacccaguaaucuguaauagguuuuacaaagagcaauaggaaggagggauuauuuuuuauuaaggugccuugaaauuguuuucuacaucagaugaauugcagggguugagggguggucugucuggaguacuggaaaaugacauaggaaagcaaacugaaaacuuuccuuaauucauguguuuauguagaauaauaaaaccuauacuuuucuuagaaauuaguaauaaguuucauauuuaauuagauuuucuuguacaguccaauaaauguuacuuugugcugugcacuauuauaguugcacugcguaauuccucaaguuaaauuuuugucauacuguagaaacauccuagaguagaguaacuuuguuucagggaguuaaugaguuggcuucaaggaggugauaagugagcucuggguucugaagggugauuuguaguuaacuaggugggggaggguagggaaucagcauuguaaaugcacaaauccuaggaaaauguucuagauuuggagaauggugagguaauccuccauagcccuugauggaauucugggaccucauaggagaaguuaguugaaggaaugaaguagccacaguaugaggucuuaucuuuuaugugaugagggaaccauuaaccauuaggaggggaaaaaaaagccagugagauugauaagcagauucguguuucaggggaaaguuuagauuccacagucgauuuacaauuaaaauuauaagcuuaaugguguauguuuaugacauuuuugaaagauuauuuucucuccauuaaacaaauugaguacuuugcauucauauaagcaggauuuuuauuuguuaagaacuguaugacuuugaaacucuguagucuaucuuuuagagaacuuguuauauauguaaaugaaugccaacuguucaagauuuuuccguuacugggguggaauuuuuguauacguuuuggggcaggcaaaguuugaguauuaucaucugauguaauguguuaggcaugagauuuaacauucuuggauaaauugaaauaauaccaagaaaaucuaaaucagugauaaaaucccuacauaggugcugauauuuauguuauguuacuagaagugcuuauuuuacaaugcuaugauauguguuuguguguuucucaaaauauauaacacuuggauauauuagguugcuagcauuaucuguuaauugacaugcagaaacaaauccuaaauuaauguuuuuaaagagaaagaauugcuucucugagaauguaguuucagcaaguuauuuuuauuuuuauuuauuuauuucuuuuuuugagacaggucucacuuugucacccaggcuggaaugcaguaucaugaucacggugcacugcagccuugaccuccugggcuuaaucaauccucccaccuaagccuccugaguagcugggacuacaggcgcaugccaccaugcccggcaaauuuuuguaucuuuuguagagacaggguuccuccauguugcccaggguggucuugaacuccugcgcucaagccaucugccugccucaucuucccaaagugcugggauuacuggccuaaauuauugcuuuuauuguaugcauuauauacuauuuuaucauaacaaaaguuaaugguucaacuauggcauuuagagcugcccacguagccugauugucuauuuaguucacuuuugacugaguaaaauggagcugaucuaucugcuauuaaagagaguuauauucugaaauuuuacaugauguucauaaugccuggaacuaaccagccugaaauggaaucaccguuguacuguuuucaauuggcuaggugacuuauucucccuauacuucaguuuucucauuugaaaaauguagauaaaaauaaauaaauaaaaacaaagaaaaauguagauaaauaacaauacuuacccaguagaacugauguaaggauuaaaguuuuuuguggguuuuuuguucguguucguuuuggagugggacuuguuagguuaaagaggagcuucugggguauacaagaauuagccacaauuuauuucauagagugcacuauacucuuuuuuguaucagauucguaaauguaaacaagaaugcagucuugcucuuagagucuaaacauguuuuuccuaccaggaauuuuguuuagaugaccuucugugaaguaagauguguaauauuuugaguaacauaaauaaaucgucauauugcucugucuguaguacuuggcaaagcacagggcacauaauaggcauuuaauaauuccuguguuaagugggauaaaucuaauggguuaggauucagacagacuggugucuaccuuuuucaaccugaauagugcagaguuaguuaccuguaguaguuuuuucuucugugccuguuuucuuccuuaaaauuaauaaaauauuuucuucccuuaaguguauuuaguagguuuaaauaugacccuguaaaacuccugacaaguagguauuuacuguuguugguucccaugccauuuccuuuauuuagagcaaaaauugcaaaaauccuggaaguucagaagaaacacuuagcaccuuuuauuuauuuuuuugaaaguugagaaauguaccauugaguacgugcucaucuuuaaugaagagauaauauauuauuuuggaaagacuucacacuuugauucagaugauggguuccagucugggcucuauaaacuuacuagcugugugccuggacaaaucaauuaguauugaagagccucagcuguuugauaauuuauaccucccaguguugcugauggcaacucagauaaugaaagaaaaaguguuuaacuguagagcaugucaaaguaucaugauaauuauuccugauuauuaguuacuguagugaaacuaguauaguaguuuccccuuaauucaaggggaaauauguucugagaccccaguggaugccugaaacuacagauagcacugaaccuuauauguacuguuccccccuauacauacauaccuaugauaaaguuuaacuugcacauuagguacaauaagagaugagcaacaauagcuaauaauaaaauaggccaggcgcaguggcucacgccuguagucccaacacuuugggagaccaaggcgggcagaucacgaggucaggagauugagaccauccuggcuagcacgaugaaaccccgccucuacuaaaaaauacaaaaauuagccgggagugguggcacgcgccuguaguccuagcuacucaggaggcggaggcaggagaaucgcuugaacccgggagguggaguuugcagugagccgagaucacgccacugcacuccagccugggggacagagcgagacucugucucaaaaaaaaaaaaaaaagaacaauuauauaauauaaaaaaguuaaaugaaugugaucucucucucaaaacaccucuuguacuguacuucuugugaucugucagucugauaaucaagauaguuacuaaugugaauaagggguggguagcauauguagcaaggauaucaugucccaggugggauggagcgggaugucagaaaauuucaucacacuccucagacuggugcccaauuuaaaacguaugaauuauuuauuucuggaauuuuccauguaauauuuuuguacugcgguucaccaugaauaacugaaacugaagaagaagaaaccgcggauaaggggagaacuacuguaguuucuuaaguuguaugauugaaugauucauucauuuuuaccuggugaugcugcugcauuugggugcuuugcccuuuaugcauuuuuauuuaaauagauaucugguuuauuaggcuaggcgcaguagcucaugccuguaaucccagcacuuugggaggccgaggcggguggauuguaaguuuuaggaguucaagaucagccuggccaacauggaaaacccugucucuacuaaaaauacaaaaaauuagccaggcaugguggcacgugucucuaauccgagaugcuugggaggcuguggcaggagaaucgcuugaaccugggaggcggagguugcagugaguugacaucaugccaguguacaccagccugggugacagagcaagacugcaucucaaaaaaaaaaaaaaaaaagaagaagaagaaaaaaagaaaacuggcuuauuggacuuugggaggggaguuuggagagauugugggagugguaaaaaaagauucugcuauguucaucggagcaggccaguuaauugaguauuuuugcaugcugagguccugaugcuuucucuauguaucuauagcaggaaauuuacuucaucuuaacuccugcuucauuaggguaaaauaucaugauaaucuuugggguauucccauuuuuguaacuguauuuguguccuuucucuuuaucauuguuagccaaguguauuuuuugugaacaucgugucuguuuuuuugaaauucauuuuuaauuuauaguuagagcauugagaaugucagugcaguaguuugaaacucuuguguauucuugugcauauguguaugaauaacuuacgcuguucuuugucccuuaaaucuguaagaucucuuggguacugagccuuuugaagcauuaaaaguaaauaccauauaaggcaagcagaauaguacuaaauagcugcaguagcaaagcaaggaaagugaaucacagaguaaugaauuuggaaaaugacugucgugcauuguaggaaaaggcauugcuuuuacuaucauccuuguaaaaucuaguugcugacauuaaguauuuguuguaugugcugauuauuuaaucguguacuguaacaaaggcacuuacaagcaaaauacuuuuucuucuaaaaacauauacugaaacucuagaaauuggaguacagcuacccuaaauccucaguuaguuugcuauucaauucuuucauauuaacuaaggcaaauaauuuaaaauugagcaaauaacucauaucuaaaacuuauuuauaaaacauauuuguaauauaaaacaugaacuucuagaagaucuacagauucuggucaagauaugccccuuuauaauuucaauaguuuaaauaaugauugucaggcacagcaaaauacucaggcaucagauacucaguuaacucuguuauguuugcuauucuuagaagauuauuaccacacuuuagaacaguuuucaauauccaaggcuguuugcuuauuucacuggaauuaacuaaaaguaauuagggaauucauuccucagaauaauuuauauccuaagcuuuaugaugaagaaggcuuuuauuucuaauuguauauuccagccuuggaccaaaaauguacaugcuaaaauaucaagacaaggcaaagauauauuuuugcuuuucugucacuuaauacuauuucaaaauaguuucagauuuaucaauuggcccagaaaaagaguauuuaauuccuuugauuuggaacaucugauucaaauuaaugauuugagaaguuuuuaauauacuuugggaacuucaacuuggaauucugagguaaauuguuuuaaagggaagauucuuuuguaauagaaaguuucucuauaacuuaccuauuuuguaauuuuggauucuuguauauugauauguauuauuacagcauaccaaggaaguaauaguguuauuuacugguuuuuaaauuuuuauauggagugaauuaaaugugagguucugcugaaggagaccuguggguaaaaaaaaaaaaaaaaaaaaagugguaauagcauauacuuauuacagaaaaaguagaaagguuggugagagaagaaaauaaaaaucacuuccaagccuauaaccuagagaaccguuguuaacugaggcaaacauugccauuuccuuugcaugcauguguuuguaagcucuacagucucucguuuuucucucugauuauuaagguaauaugggggaugugaaaaugcaggagaguuguaauaaagagaggagaaaaagccacucagagacauccaugaaaguuugcauuuuugugaugaagaaauuggaguagacaugguaauuuguaaccuguauugaaaaaacaaaacugacaccauaagcauuuuccagugucauauauuuauccaaaacaggauucuuaauggccagagcauaacugauuuaaugauuguguaugauugaacauuuuauuuuuuuuuuacuuuuauaaauagcacugugaugaacauucuuguaccugaauuguuuguacauuuauuucuuuagaagaaauuucuauaaguacaaucauuucaaaguauaugaauuuuggagguaagcagguccagugcuuagccaauugcuguguccuuagugagauuacuuuucaagccuuaguauucucucuguaagaacagguauaauauacuuaacucagagguuagaaggaguaaaugacaacauauguauagcauuuagcacauccgauaguauacaggauacucucagugagucuuuccccaacuacccccuuuuuuuuuuuuuuuuuucuuuuugagacggagucucgcucuuucgcccaggcuggagggcaguggcaccaucucggcucacugcaagcuccgccuuccggguucacgccauucuccugccucagccucccaaguugcugggacuacaggugccugccacugugcccggcuauuuuuuuguauuuuuuuuuuuaaguagagaugggguuucaccguguuagccaggaugcucucgaucuccugaccucgugagccaccugccucggccucccaaagugcugggauuacaggugugagccaccgcgcccggccccaacuacccuuuucuuaaguagacucuucuucccuagcaucuauuguaauuagcuauuacgcuaaaaaaauuuugucuuucauuccaccacuagaucaugaguagggacaaguucagucuaguucauuaauguauauugaaaacucguacaggccuaacaaauguaaauauguuggauguaugaaaaguuaucuuccaaagcuuuuaauauucaguugcuuuuuuucuuacagcaaagcugugccaguuuacauucucugcagcucuguguaaauuguguccuuuuuaauuuacugucacugauacugaguauguuguguuaacaaaaaguucuaaauuucaaaguuauaaacugauaauuuuaaaaacuuguauuuuuuggcuuuuucucugaagaagcaauauuuuauauucacuucuauuuucacguuuucuguuuauguuuuucauucuuacuaauaagaauaaagacaaaauaagaguaauauguuauaguccuguccgugguccccucccaagcauuauuccauacuuccugggaagaaaaaguaaauagcaucacacaauuaugagacaggguuaauauacagaaguaccauaucaaaacugaucuccaagggguuuaaacuggauaaacuuacggugaaaaaguuuaaaagaauuuuugccuaauuuaauuuacuguauuaacacugaaaauguagguuaagauguuauguuaaaaucagauuguauuuucaguauuaagcuuauguuuucuggagggcuucaaaaucacuuucauaucuguggauguauuugaaaauaguauuuugcuugugggaaguaggcaaagacaaguaauauuuagguauuguauuagauauuuuauguuacucauucauuaauuuaacaaauauuuauuuaacuccuaccgugugccccaagugcuauuccaaaagaauauagcaguguacaaaauaaaaucuauauagauacauauaaucugacagauggugguaaggauaaggaggaaaagaaacuaagggaaaguauggaguguguaugaggugcagauuuaaauaggcuggucagggaaguccuuucccacugauuuccccucaaggcgugagccuguggugagggagcaauccugugcuuguucaggagaaagggcuuucaggaagggacaacaacaaagaacaaaaaaccugagagagacggauucuugaugucuuaugauuaaaaaauugcaaagcaguauguguggcuagaguguagugggaaaggaagagaaugguagauggguacagaaaagggcaaaugaggaaagacuuugcuaggcuaccauaaggacauuuuuacuuacaguaaaauauaccuuguauauacucuucacaguuguuacacgagguuagcugaauuuuucccauuuuacaguugaguaaauaagguagguucuagcauauaacugguaauuaacuucuucaaggucacauaagcuagccaguaagauccagagucaggucuuugacuucaaaaccuccugaauuuuuguuuguacuguucuuguucaagcauacuuacagagccuuucacuuuuacagugaaauucagaccgggcuuaguuuuuaguguugaucuagggugaguuuucaugcagggcuuauuuuuuuuuaauauccauaggaacuaauaccauucuuauuuuuaaaucaacuuugucaaggaaguuuacauauaauacaagguacccguuuaaguguccuuuuuuaaauuaguuuucacaaauuuauacacccguuuaaccaucaccaucauucagauacagaauauucccaucaacccucaaguucacugauuccauggagaccccaaucauggcccuggcaaccacagaucugcuuucugucaguauauuugagauuuuuucuagagauucgaacaaacggguuuguagguacugcauuguuuugugccuucuuuugcucaacauaauuucaugacuuauuuauguugcauguaucaguuguucacuucuguuggauauuguuuuguuggcuaguacucuucuaacuggugccugaaacguuuguugaaugaaugcauauaauaaauauccucuucccccaguuuugccgcuuuccuuuaucaugagacugcuaaaaccucuucuagauuuuguauguugcuagacuuaaauuuguguauagaguauuugaagagauaauagugaaaaaugugcaugauuuggagcucaguauuuguuaaaaagacuguuuucucuauuuauuuaucuuaguacccuucucuaaaaugagcugacuguauaugugaagcuuuauuucuggacucucaauucuguuucauugauugguaugccuauccuuaugccaguaucccuugauuacgaucugcaauuuugaaaacaggaauuuuugagaauccuccaacucuguucuuuuucgagauuguuuuauuaguaucugcuccaugaauuuccauaugaauuuuagaacuagcuugcuaauuucuccaaagaaaccagguggaauuuugauagaauuguguugaaacugaacaugggaugucuuucuauuuauauaguuauuuaauuucuuuuuuuuuaaucaauugaguaccaaaauagacuuuaauuucuuuuaagaauguuuuguaguuuuuaugguauguuuuguauuacuuuuguuaaacuuacaccuaaguguuuuauucucuuggaugcuucagaaauggaguuauuuucuuaauuucauuuuuggauuguucauuguuauuguauagaaaugcaauuaauuuuggcguauugauuuuguacccugcaaccuuguugcacuuguuuacuuaauuauuauaaaacauuacuauuaauaaaaucuuaaguauuaaacugcuauguaaacuguuguauauuuucaagucuccuguugacuuaucuuguaucuaguuguuguauucauuauugacauggaguauuaaaagucucccaaccacuguuguugaauuggcuauuuucucucuucaggugucaguuuuugcuucauucauuucggugcucuuuuguuagguuuauguguuuauaauaaucuuuuuaguggcuucuuuaggauuuucuuaucuaugauaucauguaaucugcaauuagagguaguuucacuucuucuuuuccaauccagaugcauucuauuuuuuuuuuuuuugccuaauuguucuggcuagaaucuuuaguacaguaugaaauagaaauggcaauucuguuuaguggacaaccuuguauuaucucugaucauauaaggaaagcauucagacuuucaccuuugaguauauaccuguguuuuuguuuuuuuuuccauggauaccuuuuaucaguuugaggauguuccuuucuauuucuaguauguugagugcuuuuauuaugaagggcuguuagauuuuuucagaugcuuuuuuuggugcaucuuuugagaugaucaugugguuguucuaauauguuguauuacauuauuuuguuuuuaugauguugaacaguucuugaauuuuugggauaaauccaacuggucauguuguauaaucccuauuuugcuguauuuguuuucugguauuuuguuguggaucuuugugccuauuuucuuucuuucuuuuuuuuuuuuuuuuuuuuuuuuuuugagacggagucuuguucuguugcccaggcuggagugcaguggcaugaucucggcucacugcaaccuccaccuccuagguucacgccauucuccugccucggccuccugaguagcugggacuacaggcgccugccaccaugcccagcuaauuuuuuuguauuuuuuaguagagacgggguuucaccauguuagccaggauggucucaaucuccugaccucguuguccuccugccucagccucccaaagugcugggauuacaggcgugagcuaccacgccuggccaguuuuugugccuauuuucauaagauauaucagucuguaguuuucauuucuugagauuucuuugauguuguuaacuggauaauaauggucuuguaaaaugaauuaggaaauguuccagguuccaaaacucuucucuguuuuagaagaguuugugaagaauugguaucaguuuuucuuaaaauugguacaauucaccagugaagcugccugggccugagauuuuuuuuuuuuuuuuaugggaaguuuuaaaauuacuaaugcaaucucuucacuuguuacagguuuauucagauugucuguuucauccuaagucaauuuugauagucugugacuuuguaagaauuugucccuucccuuuaguuauuuaauuuguuaguauucaguucacauuauuucuuuacgauccuuguuaugccuacccuacaaaguuguaguaauguacuguuucuuuccuguuuuuaguacuuugaguuuucuuuuuuuuucuuuucuuggucaguuuagcucaaaguuugucaaucucuuuaucuuuuuagauaauaaacuuuaaaaaguauuucucauuuuuuuauucucuaguucacuuauaucggcucucaucuuuauuauauccauuguuugcuuuugguuuaguuugcucaucuuuuucuagguuuuguuuuguuuuguuuuguuugagacggagucucgcucugucgcccaggcuggagugcaauggcgcaaucucggcucacugcaagcuccaccucccagguucacgccauucuccugccucagccuccgaaguagcugggacuacaggcgcccgccacuacacccggucaauuuuuuuguauuuuuuaguggagacgggguuucaccguguuagccacgauggucucgaucuccugaccucgugaucugccugccuuggccucccaaagugcugggauuauaggcgugagccacggcgcccggccuaauuacauaauuauuuuuaucagucugucaaguuugcuagcagugaauucugccaauccaucuuaaucuccaaguuuauuuugccuuauuuuuuuuuccgguuauuuguguuuuuugcgauggagucuuucucuguuacccaggcuggagugcaguggugugaucucggcucaccgcaaccucuaccucccggguucaagcacuuccccugccucagccuccagaguaucugggauuacaggcgccugccaccacaccuggcuauuuuuguauuuuuuguagagauggaguuuugccauguuggccaggcuggucuugaauuccugaccucagguaaucugucuaccucggccucucaaaguacugagauaacaggcaugagccaccacacccggccuauuuugccuuuuuugaaggaugguuuugcuggauauaaaauucuuuauugacaguuuuuucuucauuguuuugaauaugucauccuacaucuuucuggccaccauuauuucuaaugaaaaguuaguugugacaagucacuuuucucuugcugcuuucaagagucuuuuugucauuggcuuccaacguuuugugcuaugauguuucugggcaugaaucguuuuguuuacccuacuugguaacucuucuuggauguguagauuaguguuuuucuucaauuucagagguuaucagccauuauuuccugaaauauuuuucuguucuuuucucucuccuuucuucuuacucccauuacacauauguugauucacuuaauaguauccuaugcuuuuuuuuccugagguuuuguucacauuuuuuaauuaauuuuucucugaauugcacaacccuaugaaucuguugucaaauuuacauucuccuuguucuccugguucagauaugcuuuugagccccucuuauuuuugagccucugaauuuuucaguucauuuuacuuguuaacuacauaauaucucuuuuuuucuuaucucuuucuuaaagauaagacauugucacaucacacuuuccuuuacgucuuugaucaugauuuccuuaaauuauugaauauauuuuuaacgacugcuuugaagucuuuauuaagucugacaucuuggcucuuaaacaggcaguuuucguugacugcuuuuucacccuguguaugaauuacuucuauuuauuugcaugucauaauuugugggcgagaggcuggacauuuuacaugaacuuugcagcaucucuggauacugaucuuucuucuccuuugugcuuguuugcuuguuuaauggcuuggcugggcuuuuucaaugaaguuuuauauuucuugccgugugaagugccugaugucacccaugagaggguacagccuuggacaugggcaauuauauugggaugacagugauuuuaguaggaccauuuccgauugucuuuuucacuuauauauaucuguuaaaaccucugcuucuguuggugucacacccagauaugauagccuuuacuaacugcuggugacugcucuuuuguuauuaacaguucucuggagcauaaauuucuccacagugagaucaaauuaaauuuuggccccuuuguaggggcauuuuuuugaggcuagucuucaguguuuguuaugaacugcggaggucuguuccuagcuaucucucuucccaguucucuuugguacacuagcuagcccgugguuuaacuuguuccugucuuagagcuaccagcuuccuuuuaguugcuuacugcccaaaucuccauauuuuugaggguacccuuaggcuugaacuucucuacacucugucccaaauaaagucuuuucuuuuugggaggcuuuuagaguucucugcucuuaggucugcuccugcucugcagcagaaucucugagccacuaccagugggcagggugguagccucuagucuuuuuggcuuaccuaucccuguguguaaccacggucuuaugagugagauggguugaaggcaaauggggccccuguguucuaggccugucauguuuacgguagagccucugccuguguuuugaggcugguggcagaagugagggaguugaguauaagaaauucuguuggccugucuguccuggagagauacucuaacccuugacuggaaacuaggcagggagagagcccugucuugaccccaucugccaggauuagaaauuucauuaugcugagcgggcagagggaagaaaggggcaguguggcucagauacuauagauucuugcuauuucuauugagauuuaguagauuauuuaaaauaaaauaguuuuucguuugcuguauucccuuagaacacuccccagagcacugaguuuuuguuuucuuuucaagcaguuuucuccaauuauguuuuuuuucauugauugaauuuugacaauuaagucagucuuauuuucucuggauaaaccuuacuuguucguagaucuuugggcauuuuauugaauuugauuugcuaauauuuuguugagaauuuuugccuuuauauuuaugaggaauauuggucuuuaauuuuuuuuuguuuguuauuguuuucuuguuuuuaguuuugguaucaguaaugccucaaaaaugacuuaaguguuuugugucccauuuucuggaaaacaugucaaguugguauuacuucuucuuuaaguguuuugguagaguucacuaguaaaacuaccaaaccuggaguuucguuuuguuucuucucuucucuucucuucucuucucuucucuucucuucucuucucuucucuuucuuucuuuuuucuuucuuucucucuuucacugugaguucauuuguuucuguagguguaagacuucagguuuuuugaggaauaggugcauuucaucuaaguugcugauuuuauuuuuauagaguuguucugguauuauuauccuuuuaaugccuguggguucuauauuuucucuuuuauuccugauagugguaguuucugacuuuuuucuuugucagucugccuuagagguacaucaguuuuggugauuuuccuuuuaaagaauuagauuuucuguuuuguuuaauucuuuuuuucaauuucuguguuuuuuccucucaucuuuauuuauuauuuuuguuuacuuuugguuuauuuugugcccuuuuucaagguuuuugagauguaagcuuaggugauugaccugagagcuuuucaaagauaagcacuugaaauuauaaauuuccccuugaguacuaauuugguuacauccuacagauuguauguuuuauuuuuguuuucaaucaguucaaaauauuucuaaauuucccuuuauaauaccucuaugaccauggauuacuuagauaugcacaguucaauuuuuauguauuuggagauacuuuccaguuucucaugucacuuuuuaguguaauucucuuauagucagaaaauauuuguaugaauucaauucuuuuaacuuuuuuuuuuuuuuuaaaagaacuaagaugcaacuaauuugaugaauguuucauuuucuccuuuuaggaauuuguaaucuacugucguugauguuguauuauuauuauuauuauuauuuuucagacagaguucucucuuguugcccaggcuggagugcaauggcgccaucuuggcucaccacaaccuccaccucuggguggaggcugaggcaguaguucaagcgguucuccugccucagccuccccaguagcuagaauuauaggcaugcaccaccaugcccagcuaauuuuguauuuuuagcagagaugggguuucuccauguuggucagacuugccucaaacuccugaccucaggugauccgcccaccuuggccucccaaagugcugggauuacaggcgugagccacagcacccggccguugaaauuauauucuauaaaugucaauuagaucuaguugguuaaugaugguguucuguuuuucuguauccuugcugacuuuuguuuacuugcuuuauaauuacuuagaggaguauugaaauuuccaaauguaaugcuggaauggucaguuucuccuuucaggcuuauuaguuuuugguauuuuuaacuugaagcucuguuguaagugcguacacauuuaagggauauuaugucuuccugguaaguuggccuuuuuaucauuauuuaacauacauuucuuagcccugguaauauuuuuuaauugcucugaaguguacuuauucugaugguaagguagccacuccagcuucucuuuguuuacuuuuugcaugguauaucuuuuuucaccuguauguuuccuguagacagcauauagucuuuuuuuuguuuuuuuaaccauuuugacaaucucauucuuuuggacuaucuauaucuaauauaauuauuguucuauuuggauuuagauaaacccuuugcuuuuuuaaauuuucuguuuguuccauuugcuuuuucacucaugugauugauucuucuuuccugccaucuuuuggauuaucugacuacuuuuaauauugcauuuuacuuauugaguuuuuuaguauauucuuuguguauuuuuuuuuagagauuacuuuagggauuacaaugcacauucuuaacuuuucagaauuuacuuauuaugucaguuuccuggggcuccuauaauaaauugccacaaacuguagcuuaaaauaccagaaauuuauucuuucaugguucuggagguuggaagccccaaaucucaagguaucaucagggccguaaauccuuugaaggguauagagaagaaaccuuccuucuaguuuuggugguugccagcaaucguguuccuuggcuuaucccugcaucacuccagucucugccucuguuuucacauggucuucuuucucuucccacuguguuucuguacuuaaucgcuccuuucuuuugugaagacacaagucauuggauuuagggccuucauaaauccaguaugacuuccuguuaauuuggugagauuugcaaugacucuguggccaaauaaggugaaauucagagguccuggggguuaagucuugaacacaucuuuuuugaguacacaacucacugcacugcacuuauaucacuucaaguggaauguggaaaccuugucagcauguaguucccuuuacucauccccuuuuauguuguaguuucauauguauuacauuuguauacuucagauacucgucacacagugaggucacuugcuuucaacuaucaucauguuuuaaaggauuuaagaggaaaagaauagucuaucacagggauugcaaacuauggcugcaggccaagucuagccugacaucugcuuuuuguaaauaaaguuuuauuggaauacugccacauuuguuaguuuauauauugucucuggcugcuuuugcacuacaaugcagaauugauuaguuacaauggagacuguuaggcuugugaaacuugaaauauuuucuaucuggcccuuuacaaaguauuuacuaucugacccuuuacgaaaaaguuugccaacuccuggucugacauguacacacacauauuuuccauuuuuuucccauucauucauaaaacucuaaguuuucuaccgguauuauuuucauuuuguccaaagaaucuuccuuucuuuauagcaggucugcuagcaaugaauucucuuaguuucuuucauccgaaagugucuuuauuucaccuuuguuuuugaaggaugcuuuugauccauguagaauucuggguggacaguucucucgguagcaauuagcuagaguagaguagcagcaacugccuucuuuagguggucuguggaccuuccaguuugccauacuuuuugauacuuucucuugucucuuugacauugauacccacugccauucuugauauuuacuauugugccuauguggugguuuuucuuaucaaaggaucagaagaaaguaaaauuuauuuguuauuuucugagacagggucuuguucuuuuucccaggcuggagugcaguggugcagucagggcucacuugcagccuugaacuucugggcucaagugauccucccaccuuagccucccaaguaguugggacuacagggugcgugugccaucacgcucagcuuauuuaaaaaaaauuuuuuuuuuuuugguagugauggggucucacuauguugccuggucuggccucgaacucugggcucaagugauuuuuccuacuuuggcuucccaaagugcugggauuacaggugugagccaccacaccuagccagaaguaaaauuuuuacuguacuccuguuucuauguagugggaaaacaaaaucauaaguccguguuucaagaaaugugggagaaacaauaauuuuuaauggcauuuggaauguuuauacauguccgguaugcaaaaaggaucauaccuguuuucagacuugucuuuuuaaacacuugaguuggcaucuuaugcugcaacauauauuuucaaaaugcuuuaacaucucacccaucauuuucuuuuucaaaguagcacuuuuuccuguauaauuuaugucuuucccuaauaacuuuuuggcauauauuuucagugucuuugcccugucuugcuuucuuauagccaagucacaucaaaguugauuuagcccuggguugugaaucagaaaugcuggauucuguuuucucucacucugucacuaauuagcuguguguaugagaccuugaacaagguuaggccuaccagacuacaauguaucucugaaacaagguguuuaaacucaauuucgcucugaagcuuuuuuuuuuuaagcuuuuuuuuuuuuuaaggucuuuacuauucgaaguuacucucugccaacaaccuuguucaugcugugauauucucauccagagguuauuaauauuuuuuguuccaugaaccuuuuuggcucucuggugaagaauguggaccccuucucaauaauaguuuacaugugcaaaauuaaauacauaugcuuaugaggucaccaguuauauuggaguacaguuuuuaaaauauugacuaaacaaacucaguaacaugcauaucaacacgaagucuacugguauauaguauuaauaacuuuuagacuugugaugaauauaaaugauaauuugagauuugaagcaacuaaagugauaugaaaauaucugugguuucuagugguaacaaaaaucaucacaggugccucuagcaccacuguggcuuguuaccuacauuuuaaauuaaggaaauacuaaauuucaguuagagguuuguaaaauuaaagcucuagcuuuuuuaccccagccaaguuuauguaccuucugcauucagucaaaagacugaagauuuauagaaccugguuaagaauucugucuuuuccagcccaugagacauuuggcuuagugccuaauauauauuaggugaacauaaguuauguguaauacauaugaaauacauuccucagugaaaaaguauugcuaauaaagguuuuaauauuauugccauuugugaccuuguguuaauuauaauuagugcuuuauaaauccauagagaacaauuggcaaacacagaguuuuauuuacuaccuggcauauaguagggcucaguauuuuuggaaggaaguuagaagagucucugauuauuaguaucaaugauuuuugaccauuuuauuuuuaaauacuuguuucaaaaucucugguaaauuucugugugaaauaauuuguuuacuuuaguauuucuugacagggaauacagguauccccuauaaauggcaagcugcuauaguuauccuuaguauaacacaugauaaacugaaacuuaguucuuagauaaauaaagcaaacaauacguuugucugcacugccugaaaauuuugaauugcacaauuuuucaaauauucucaauucaguagcagugaaacaacacauauugagguuaaaguucuuuacauuaauaguauacuaccacuguucuuagaguagacucauaccccuacuucuuugauucuagguuuacucuaauuuuaauguuucuccuggaaauguaaguccuaaguuuuuauagggcuuuuuaguugccuucuuccuccucauaggaaaauauccauuuguuaaauaaagauauuaauauauacagaaauauguuuguaaccaauauucuuaaaccuacacuuaacugacccacucuuuuaaacaaaccauuauuuuagauucuuaguccugaguauucugagcauuuauagcuaguaaacuacucucuaguuuacccuuguacccuuuucuccaccagguuaguuauaugccuaacaagaaucaguuuuuaugccaauguuaauguaauuuuuacuuuaaaugugaucuaagugaauaaaauaugagcacagaaagauagaacuauuguuuuaaugaaaagcacggugaaugguucggaaggacuuauauaaaguucuuuacaaauugcuaaaggauuagguguggauaagcccagagguuuaggaaacuuuugguucaauugacuaaacaguauggaaaacuauuuucucacauaucuggaggaauggaagcuuuugugugguugguuaaugcagugguuuaauaauuaauuccagggucagauucuuucuguuuguucugccauugucagagugucagcuuguccacaggcuagcucucuuuaugguuacaagauggauauaguagcucuaguugugcuauucugauauaacaacaccuauuggggaaagagggucuguuuuuucuuucuuuccuagaauccuaccaucaguuuuucccuuaugucucacuagccaggauugguuuaaaugcccuuucauaaaucaauuacugacaagagggauaggauuaccaaauuggcuuacacugaucacauuuccuuuuuuuuuuuuuuuuuuuuuugagacaggguuucuugcccaggcuggagugcaguggcacaaucucagcucacugcaaccucuaccucccagguucaagcgauuuuacugcuucugccuccugagcgacugggauuacaggcacccaccaucacgccuggcuaauuuuuguauuuuuaguagagauggggugugccauguuggccagacuggucuugaacuccugaccuuaggugaucagcccgccucagccucccaaacugcuaggauuacaggcgugagccacugugcccgaccagcauuuacucuugaaccaugugggaaaguuugaauauuuggacaacuaugguggucacagauagaagggcuuuuagagugucaaccaggaguguuugcuauggugagacagcuauuaaaaaauuagaaaguauuuguuaaauuucagaaagauucugcuauuuauuugccuuuaaggucuuguucaacuuuaaacaaaauugaaacuggacaucuuaaaagaugcauuauagaugugcauuauacaaaaaaugaugugaaaaguuaauuacuaauccuacacucaaaagcuuguccuacgucagacuaucaagggggaauaaauguccauuuguauuuuaaaaguauuugauuuggcaggaacuaacuuuuaaaauuaaccuuccgguugcuggucuuuuucuuacuagacaaggugcuucugcugcaguccuuguaaggaaaaugauguuuccauaaaauuaaaguuaguaaaggauuuaguauauuucuugugcuucauuuauucaguaaaauguaucuguuauguaucacuuauuguagguacuugugauaacagugauaagcuuaauagacaagguucuucugcuuaaggaacuucagggauacagacagaaaacaaaugagaacaaaauucagacuguuggguguucagugaaggccuuucugaaaagagauagucaagcagacauguuaacgucaagaagcaguuuggcauuuggagauuugggguaagaucguugaaaaggagcagcaaauauaaaggcccuaaauugagaacugacuggauguguuugagaaacacaaagaaaggcaauauggcuaguacuuacugagauauucucacuucuuuucuuacucuuuguuuucuuaccuaucauuaguaaucacuauauugcuuauaccguuaagucuguugcuucucucaugcuucuuaauacucacaacuuuugguuaagucugcuucuaccuauacuguuccugcaucccugcaguuguguguggcuagagaacaccagccucccauggguccuuaguacuacuuggcaauucuaccuacugucguuccucuaaucccuucacucucccuuucuuagaagaccuuuuccucccuccucagaccuguaacacuuccucccauauucuuaugcucacccgauaacuucauuucuuauuuuacuaagaaaacagaaacagcugaaugagaacuuccauagcuuuuauuacuauggccuaccugaaucuguuccuguuuacuaucuuuguuucuguuucuauugaugauauaucuuugugccuaucuaaggccauucucuuauuaaugccauccacaucugcucagagucauuacuccaguaauuucucucucuccaucuuguaucaucagcauuucccucugugccauaauuuuuccugucuuuaaaaaaagccuucugucaacgcuaaauuuuuucagcuauuaccauuuuucacuuuuauggcaaaacuucuugaaaaugaugucuguacuuugucuccaguuucucucuuccuguucucuugugaauccagucuaguuaguacauuuauuucaccaaagcuaucuacgaagauuaccaaguaggugaucuccaugcugcaauccaaagauuaauucucaucuuuuuuuuuuagucaacagcauuuugaaacaguugauuacauucuuccuugaaccacuuauuccaguuaacuuucaagauaucuaccauacucucuuugguuuucaucucccucgcuggcugcuccuucucuaaaccaugaacuagaccaugcagauauauuauuuucauuuauaauaggaaauuaaaucacacagaagcuaagcaacuuguguaaacagauguacuuuucgggcagcaggaagacuagaaacagccccuguugucugaauuucagaccccaguuuuauuuaagcccauaucaaaugaagagcuuuuaauuuucaagccugugguucagaaauuauugaacuuuugucguuuaagaucaguaggauucccuuuauaaguauucacuucauuugaaacuuuuaagccacaguagaagaaaauuucugucucgagauggugggccuuuuagauagaccugacucucuacuuauaguaaauuuuguguaucagauguguagaauccuccuuggaguauggaugugagacaacuguacaguugaguuaaaaguaguaccacuguggaaaauggaagacacauacaacauuguuauaaaacauuaugacaaccagagagcaaauucauuucaauagauuauuguuaaguuguauuuguuuuucuuuguagauauaggcaacuuuucauuuuacaugcuaauuauaggucugugaaacccauauuacuaaaauacucagagaaacuguucuuaguuaauauggcaauuuucccagaccagguaugguauucuugaguuuuauuuauuuuuauuucacugaaauucuugaguuuuauuuauauuuauuucaucuguccaucaacucagaauuuuuaaaacauccaugugaucaagcaaaaaauuaguucauaagggcaaggaaauauuuaugugacugcagucuaccuauuaagaaaacauugcuugauguaguucuagaauuugaggaacccuuauuuuaaagauaauggcuaaaugcauuuacugcauguuuuauugagcuccagugaaaucggucacaucuuguaguuuguccuaauuaauagccaccccagaauguaaugucuucuguuaaaaaaagagaaaaccuguucagcugguucagcugucuuaaccuaaccaaauucauauuuuaacuuugaguaugguaaugacuaccaaauuacagauauuuuagauacuauuuucagcuucuaaaagguuugggcauuguuuaaauacuauugaguaaugaagugggaugaggggaacauggggaagguuuuuuaaaaaguuuaaaagaagaaaaaguuaaaaaagauucaucuaagucauuuuauuuuauagcuuaggaaacuaaggccagagagaaguaauugaucuauuuuuuggguuuguaauuuugccuuuuccauaaugucauauuaauggaauuguucaacguguggccuuuggggucugguuuguuuccuguaauguagcaaaaaugcacuuaagauucauccaucuugcaugaauuaacagcuucuuccauuuuguuguugagaguauucuguuguguagauacucuguuuauccauucaccuauuaaaggacaucacgucuucacuggaaugaaguacaucuucauacauguacugguuuuggugugaaccuguuuucaguuuauacugguaaauaacuuuggggcauaguugcugaguuguaugguaagcuuguguuuaccuuuauaagaaacugccuaaccuucuaacauggcuguacuuaccuucauuuuugaaagauauuuuagcugggcuuagaauucuuuguagauaguuuucuuuucuuuucuauacuuuaaauauauugaaccacucuccucugauuugcauuguuucugaugagaagucugaugucauuccuaccuuuguuacucuauguauuuuuuuccccugcuuuaagauucuuguuuauugcuguuuugcagcuauuuuacucugagauguugugaucaugugguuuuguuuuuguuauucucuuuagagguuguugaauuuggaucuguggguuuauagugcucaucaaauauauuuaaaaaauuuaguuccaguuuccccuccuugugcuucagccucaaaacuacaggcagugagcuggguguacuacguuuguucuuuuucuugacgaucucuguccugagaagauuguugugugaugucuggaaaccauuguuucauauauuuugucuaguuuucuguuuauuuaagguagaaggguaaacauagccuccuuuuuucaucaugaaauacauccuugccuuauagaaaauuucauuguaguuuugcaaauauuugucuuuucugaauucuugaauauaggacuuggugggagaacaguguauaaaccuuaauaaauuuuggcaccuagggugcaugcugucucucauacuuguuccuuuucacagauugugucucucuuugacguauuguacauccuuucauuuccaauaugaagguuaucaacagaauuuauugcugaauauuuuuauuuaauauaguacagugaagauaguggugacagauguuaacuuuucauguuuauuuggaagaaaauacagugucuucagucauuuuucuuuuuuguuuauuaaaaggagauaaugauucuuaguucacuauagaauauuagcucccacauugauuagaguauauaauggcuauggauugaaacuccaggccaugaaauauuuccaguuauccccagaagaggaaacaaagcaaauaauaaauagauuuucccuuuauacaaaaauccauaauucuucaaagugaacuuguaucugguaaauucuuacagauuaaauauuaauacguauuguugugguguuagccuauaaauuucagucauuauuuuuuguauauaauuagguuguauuaaagauguauacagcauuaggguauugaaaauuaucuuaccugauuauagauuuccaacauucuuuugcugacauuaauauaauuggagguaauucguagacccuaaauauuauauaagaaggaaaacauuuuauucuauaaguacugacugaaauuuugcauuuauuauccacugaauucagagucaccauguauguauuaaugguaaggcauguacuacuuuacaauuuaauauuauacaacacuaauauuaaaacgguuaauauuuaggggaugcauaauaaaauaaucuugcuuucuuuuugugacaaucgugaaaauuugaguuggagccaaaugugcgucauuuaacaauuccugaauauccaauucauuuguaacuuuccuuaugaauaaccucauugcuugcuaaaugauaaagauuacauuuauaauaguaaauaugcuuuaaaacuuuacuccuuuguuauuuuugaaagagauauuuaauuccaaagguauuuauaaauuugguaaucaauaauuacaauuuugucauacagccugacugaaguauuuuggcuaaacguacacuguaagauagucagacuuaaguaaaaauacaacucccacuaccuuugugaugaaacauaaaagaggagccagaagauagguuuuugucaccuggguucuuuuuaaaacuuaaauuuaguaauauucauuuuuaauuuuuuuuuaaauguucugcccguauagauugcuuuuuagagguacuccauauauauguguacauguguguuuguugguuuuaauaauucuaauucacucuccuuauaaauuauagauuagauguuaucuccucacaaaauguuuguugauauuaaauaauagcucugaauuugaauaccaauguuuaguggcuagcaagauuauuaguucaguagguaugcauacuacuuccuuagggagaaugcuuaacaaaacuuagguaagagauaucugucuugaaaaugcauauuuacaaauucuuuguagacccaccuuugaauauuugaacucucauuuucaauauucauuuuaaagacagcauuucuugugacugucaccucagcuucagugcuuuuuuuauuuuuauuuuuuauuuuuuggugggaggugguaccuggagugcaagucauuuugacuuauuuauaucucugcaguuuaagaaaucauccccauuauuuuuucgcccaauguaaaaaagugaauucccuauuggaguaugcaugaaauuggaugacugaaagacaaaagcaucaaaggaaguugacauuuuuugcucuucuuuuuggaguaaaguuuaauagauuauugaguuauguuuguaucucuuaaucguguuaagaauauauguugcauucucauuuuguugcaugggaauaaaccuacacagaaugaaucgguagcugugugaauaacuuguauuucuaucuaucauauauaaucauuuggaggggaaggauuuauaguuaaaugauugaaugugaauuguauauuuuugagauaacuggagaagauucauguaaaagaaaaaaauaugucaguugugggagggguaaacuuuuuuguccacuucauuuuuuauucacuguaaauuucucccuugugugugaugucuggcagacagucuuaauugaagaaaguagaaguggguaggaagaauguuucauauuuaauaauuucuguugcaaauaaaguaugccagucuagcccgcgaaaaugguuacgaggaagacuagaguauagaacaauuacuuuuuguuuuuuguuuucuguguaucauauugaauauuuuugcugcuguugauauauuuacauguuaguaauuuugauggcuuuuggauaauuccacucuagagggagacguggugggcgguccuuccugugacacgacccuugagugacaguucuauuugauugccuccgguacugugaggaaaggacacgacucuauggugaggacugauggacauacauuaucugagaaaagaaacuaccagguaagaccagucuuucuucuuuuuucucuauuggucuuauagcuacauugaaacuguucaaauguguuauauguaauuggaaccagcaaauugguuacaccucaauuugaaaauuuggguuuauaauuuuaaauuaaguacuggauuugauaguugaaauaguugggaacacuuuucaaaauaaagcauauucauaauguauauuuuuuagugucaaaucagguuuucugagauauuugucaaaacuuagauuauuugauauacaaguuaugacuucaugacugaauucaaaaugguaaaaacaaaaguguugauugcuuuuacguauauuauuccuggaagacuaaacccgaagucuugugcuauauuuuggauaacaaaguauauaucacagaaauguagacaaaauugaguagaguauagaagaaauagaaaugagaaacccagggugcuuagagacccaaauucuauugaauuuguuauuaguuugcuguccuuaaaugcuagauucuuguuuucucauuuaauaaggugguuaauaauauucauuccuuauucaguguguaggaaggcuggaagaauaguggaaauguaacauugcuauuucugagcuuugaaaagaaggugaauuuuaaagauugugcuauuaaacagugauuuaaagaaaaccaacauauuugaauuuaguuuuuuaaaggaaauauccuuuauucauuugauagugaucuguuaucacauuuauuuaguuauccagaauacagaauacuuuaaaguuugaguacaaauaaacuuuuaggcuuccugcacagauauguguccaaccuccccaccucccacacuuccuuucacucaucaguucauucccucuagguugugaaggcagcuaguaugauagcagcagcuuugguuaacuaacuguuuaucugcuaaccauuuauuuuagcccaguuaaucuuuucuucccucaaauuggaaaaguuagcaguggagcaaauuguaaauuagucuuuuugguguaugguauaacaaagaggcuuugauuauaagaucuggguucugguuuaggcacuguuccuaauuaaaaauaaugucauauuuaaccuuucuagaauuucuucuaacuugguaucuaaaguuucuugccagaucuuuaugauuuuaauaagccagagaaaacugaggguaugcugaaucaguuuucucuguaaccuuucuucugaguuguccucauagacuugaccaacauagccuuugcuaaugaucuguacucagguguagcuccugcuucccacccacuuccaauuaccuugacucauaagauuuuaauuggucacacuucuuggacuucugcaucuuuugguagguucugccaaauuauuuuaagaauuuugugauucugaauuauauggcuuuucagugcucauaauccaauuuguaaagugugaauguagaauuuuuaugugauuacacacuauaguuaauuugucucauggaaccacauuaauauagaauuccaaaauuuauacuuaagaaagaaaacagaauuauguuuuauacaugaagagauuugcuuauucuugcucuuucuacacuaaaaguacuccauuguuucagucauauuauuuacaaauaauccagguuuuugagcauaccuggaaaaugcauuuuugguuauggguuugcugccucaaaauguuuucccuuuucucucuucguuuauugauacauaauuguacguauuuaugggguacaugugguauuuuguuacauguauagaaugucuauauaagaauguaugggaaauucaaaggaauguucaucacuaaaguaacauuuauauuuguacugguagucuaagaauuuuuauauucuuaauauauucaucauaauaccaaacaggaaauuuuguuucuauacaugugcuuuucagaguaggguucaaaaauaaaauaauuuuacaauccagcuuuaaacagcuguuuccaagguauacuucaauaugcauuuagcaucacuaaguaaaaacaaaagagaaaagggacauagagggauaaauucuaauguuccauagcagaguagggugacuauaauuaacaagaagguauuguauauuucaaaauagcuagaagagagaacuuaaaucuuccgaauugaugaaaaugauuuuggauuuuuaaaaauucuacuuuggaggaaauuuauguauuuuucauagauaaaguagaauuucuuugugucuauguuuauaaccauuuucauuuaucuuugagggcuuuugcuuuugagggacacuuaauauuuuauauuuauuugaacauucugauaauaggcuaauauugaagaguuuaacaagaauuuuuguaaaauuuauccaggucucauuuccuuacagaccugauuaaagccuuaggaauuaaguuuaggaaggugcauucccuuggcucuauacuaaagauagugacuuuuaaaugggcuugguuugaaguauugauuuuuauggugguaucuacuuuguguguuuucuuucuuacuauaaguuuaagcccaguuagguauuuggaguuugaauacaguagcugaaguuuauuugcagagauagacuggcauauuaguucagauaaaacaauuuauuauauggcucaugguucauuuuuggauugucaagcuuuuuccaaggaaaugcaccuucaguuuuuguaaccauuuucuuaucuuccucuaauuuagacuaacuuacccuagcuaugagcaugcacaugcacaaauguaaaccaucuuaauuaccaauuuaacuaaucaauggcuuucccuuuuuuuuuuuuuuucuuuuuuuuugagacggacucuugcucugucacccaggcuggagugcaguggugcgcucacugcaaccuccgccuccuggguucaagcgauucuccugccucagucuccugaguagcugggauuacaggcgugcgccaccacacccagcuaauuuuuguauuuuuaguagagauggaguuucaccauguuggucaggcuggccucgaacuccugaccucgugaucugcccgccuuggccucugaaagugcugggauuacaggcgugagccaccggugcccgauccggcuuucccuuuguuacauaacauauucaagcuucuaaacauuaccuuuagacuuuccaaauucuggccuccuuacauccauuuaccuuuccaauauaucuccuguuacuuuuuguaguagauuuucccauuuaauaauacaacacugcuuuuaaucucccugccaugcaguuucacacccacagggguuuacuuauauugguuauuuucauguaaugccucaccuuuguucacaugauucaagaauuaaguaucaguuuuuccagacgucacccuaugguagauucaguguuccuuucccuuucuuucauagccuuuacauacuucuaguuuaguguuuaccauaauacauuguaguuguguuuauuuguccuugucuuccuauagacuugugcaguccaaugccguaggaacuagucacaaguagcuauuuaaauuuaaacucauuuaaauuaaauaaauuuaaacucauuuaaauuaaauaaauuuuaaaguucauuggucacauuaaccacauuucaaaugcucaguggcuacaugcugcuaauggcuacuguauugaacaguguagauacagaacauuucuaucauugcagaaaaucguauuagauaauacugcuguaucuaauaagcuucuugaaaacugggaccguaucuguuuauuuugguacugccaauaccuagcuuggugcuugguauguagauagguguucaaugcauguuguuccaauaaaauuaaauaaaacagugaaagaagggaaaggaagaaauggaaaguauacuggguaacauaccaguguaagugguaugggaagguagagguauuugcaagauauuuagauguuacuuugaauggaacuuuucaguaugaggucauuggucacaucauaugcuagcuaauucaaugcauuaucuacaaacugggucuaaugcauccuauuccguacguuucugaagaaugauucauaaucuaaaacauuguauuuuuguggaauauaguaugucagagaacuguaaaaaugauuguauugccauuuucuuccccaacauuaaauaucuuacuuccuuuuaauuaacuuuaaaaaucacagaugccuauuaccaaaacguugaagaaaaauacggaauauaaaauacagugugaaaguuugccuugacaacuuuacucuuaacaguuugguguguaccucuucagaucuuuacuagugacuauauaguguagaugugauucauugucuuugucucuaacaaauguguauuuuucugcauuguacuuaauggagcuauuuccguuucccauucuuuccucugcccucuuccccagaaguaaucaauaguuuuaauuuuguguuucauucuuuauauuuuuauaacuuauuacauauauguuuuucaguauauugagguacaucuuuuuuauguauuguguggcaauuuuuuggaaaguggugccccauauuuuauuauuuugaguaggaaaaaucauaauuuccagcccacuuaagacccuaaacaauuuccuagauauagcuaaaguacucaacaccuacuugauaauucaccaaggauuucugcauaauacagaguauuuaaaauacaaacuacuuaauauaaacagaaacaaaugaaucacuaaguauauuuccauuuaguauguacuguauucagauaauacuuuuucuuuuauacugcaauaaaauuguaauuguaaauaaacaguuaaguguauuuccuuucuuuuauuguuaaguggcacauuauugaacauguuucucucucugaagucaggaugcaucuuacagcugauggugacuucaagucauaguugugacaaacaguaccagcaccaaagcaucuuagaaucuaugauauauaguauguuaaagauauauaaugaauauaaagaacacuuaauaaaauaaaaucauagcugaguguagugcugugcaccuguaguccuagcuacuggagaggcugaggcgggagauuagcuugagccccagaguuugaggcugcagugagcuaucaucacaccacugcacuccagccugugugacagagcaagacccucagucagucgauugauagauagauagauagauagauagauagauagauagauagaauuuuauuaaauuaauacuuaacaauugaaaaguugucagaucuggugcccagagaagaaaaauugaguuuguaguuauuauugcugcuugguguuaggugaagaugaauaagagcgaccuaaugaaagaaugaguuuaaaaaaaaaaaaaaaaaaaaggaaaaaagccugaauccaaugaauugguucaguuuccucuucuuugcucuugaaagccuugcaaccagauggcugugacauguuaucacuagccagagauaaaguaaagggguagaaugacuuuuuaugugcccuuuacuugcauuuauacagcugcuuaagaugaaguugcucuuauaauuacauuuuugauugugaaagcucuguucaugucaugaucacaugaucagcaacggaagucacuuugacuucaugauguaaauuuuuuuuuuuuuuuuuuuuuuugagauggaguuucgcucuuguugcccaggcuggagugcaguggcgcgaucgcuggagugcucaccacaaccucugucuccuggguugaagcgauucuccugccucagccuccugaguagcugggauuacaggcaugugccaccaugcccagcuaauuguguauuuguuuuuugguagagacagaguuucuccauguuggucaggcuggucucgaacuccugaccugaggugauccaucugccucgaccucccaaugugcugggauuauaggugugauccacuaugcccagcuuuuuuuuuuuucuuuuugagacagggucucacucugucacccaggcuggagugcaguggcaccaucuccgcucacugcaaccucugccaccuggguucaagcaauuuucgugccucagccucccaaguaguuagaacuaccuacacgcaccaccacauccgacuaauuuuuguauuuuucgguagauacaggauuuuaccauguuggccacgcuagucucaaacuccugaccucaggugaucucccugccuuggccuccccaaaguguuggaauuacaggcaugagccacugugccgaccuaaucuaaauuuuuaaaaauaaaauuugaccuuuuuuuuuuuuuuuuuuuggcauucauggcuucucuuuguccucuuucucaggccaaccaguaaugucaaaucaaguuaaaugaauucccaaguuccucauugguuggcucauugccgugugaugcuaaguguuaaccuuucuuugaaugcauuauacguucugauacuuuuuuuauuaucaucugaaaucaucaaauaaggugacauuuguuuuccaaaaaauaaguuucaccaagacaccugguuuauagcacccuuagugaauugguaauuuuuucauagugcccuugggccaaaagaaacucugcuaaauaaguaauuagguccaaaucacuuauauucauaugauuaucugauagauauugcuguauuuccuaagaagauauaaaauaucuaguagcaccccuguguguucgcucugguguuccuuuuggcaacguaugacguagacuuuauauaugaaauaugaaguguucucuuucagaaaaauaguuuacauuuaagugguuugccuuaaucaugaaugugaaauguguacucauuaaaucaaaaguuaagacauuaaugcggauauuucugugaaucagagaaaauacagaagcaagcaaaguuauguuuugauuuuguuuuuguuuuuguuuuuuuuuuuuagacgaacucuugcucuguugcccaggcuggagugcaguggccugaucucggcucaccgcaagcucugccucccagguuuaugccauucuccugccucagccuccugaguagcugggacuaaggugcccaccacgacgccuggcuaauuuuuuguauuuuuuuuuuuuuaguaaagacgggguuucaccguguuagccaggauggucucgaucuccugacuucaugauccgccugccuuggccucccaaagugcuuggauuacaggcgugagccaccgcaccuggccgcaaaguuaucuuuuaagagguuaucuuaggucuugcguggagucuaggaugauagcacugaugguggcagguuaguuuuuuguuuuuuuuuuuaaaucuuucugaauuuccacauaaaaauagaaccagcuagacagcaaaacuaaaacucgugaaacauaacagaacuucuugacaaaguguccccaugaaccccaauauaagcagaugagaacuaagaaaaagaccuacaguuuucaguuuuuaugcauaaaaugagacccauugggaugucugauggaccugagaguggaggcacccaauguagucaacagguauucacugguaaguacaauuagccaguuugaaauugggagagauuuugucaaccucauaaggugagugaggaacccaugguaaggcuaaagugauuggagcagcuuagcucucugaccucuugagagugacccaccaguguguccuucuaggauuccacugaggagaggaauuaaaauugagcaggaaagggacaacagugacauuggaaagagaagguccagauaaaaaugggagaggggagcagaaccaggaaaucucaguaaauaagcgaucauauuuucaaacacuaugugaaaauaacagaagagagaacuuuaugacguuagagaaguuuaucugaacaaagcaguauucuaaaacuucaggaagauuacauuccuaagaggucuucuaggaauguauuugggaguguuuauaccaauuuugagccccaucaguaguccucauauucaucugacauuugauaauuucagaauuaaaauuuuuuuccaucuauugagguuguguuugagauauauugagauauucuucauagucuuuuaaaaaagauuuuuuguuuugucuuccauauuuaaucuaccugaaauugauuuuuguacaugguguuagaaguacaguuuccuuuccccugcaccuaaauuaucauauuagcauuguguaccaauuuauucuaaccuccuuaacuauucaguagugcuagcucuauuguaaaucaaguuucucuuuauaugcauggauuucuuaugucucuguuaccuugauguguuugucugugccuauaccaauaucauguuuucuuaaauacuaaagcuuuguguuaaaucuucaugucugucugucaaccuuuuucuucauaagagucuugacuuggccuuuugcucugugacaaauuuagaauauucaugagaaugcuccccuccaacacaaaaagaaguauugaguuuguaaguggaauugcauugacuuuaguuuucuuuguggaagaaucgauaaguuuauguauucuuucauguuuucucucaaaguuuuauauuuuuuucauaagggacuuagaaaucuuuaguccaauuuaugacuacuuuuguugcuuuucuugguuguaaauuaaaaaaaaauuuuuaguuauagguguuauugaaauauaguugacuuuuaaaauugauuuuuguaucucaauguugcuaaacuuuuuaauuuuuauaauuuaucuguaggcuuuuugggggguucauauaaguaaacacauccuuuggaaaugacaguuuugaaauugucaccaguuuugaaguugucaucauuaaauaauauuugauacaggauuuuuuuuauagauauacuuuaucaggguaaagaaauuguucauaaugcuaccuuauauauuuuuuuccucuguagcaucuuuuucuucuuaagguuguuuacuaugugcguuuuccccuuauuuggucagacuuacuagugauucgucaguuuuacuaggggucaaauuuuagccuuuauuuauuucuaaaauuuaauuuuguuuucuauucaucaguguucuuuaauguuuuccuuucacuucuuaggguuuguuauacuguucuuuaaucuuacguuuuuaauuuuccagguaauuaucagguuugucuaguuaucuuuuuguugcugauuucucauauaauuccauuuugguucaagaauguggucuguaugauacaauuauuuguuuauguguuugaacaaaauguauauuaaccaaauuggcagguguauugcuuuguuucucuccauuagaucaaguguuaaucuuauuauguacaucuuauguauccauauaaucauuuaucccuuuguuuagaucuagauuccaauauaucuuauuucuuuaauuauuuuauaaauuuuuguguuuagccugugauaaauccaacaauuggaaguugucacauauuaugcuaauguuuuuguuucugcugguucucauugugccuuguuuccuuguguguauauuaagcuaucauuucauguuucuuagaacucugggaauucuuugagcacuggguagaaggggacauuucucccaaggggauuuucacuuguuuuugcuaagacccuaaggcacuaccaauccagaaccaauuccaaauaaaauauuagcuugagguugcaguccacauaggcaaugugaauuuaugcuuuuuuguggcuauaaauuuucagagcauuccuucaccacuuuuugcuuaccauaaauaacaggaacaucaagauuuuuugcuguccucuuuacuaagggguuauuacaauuaugguguagcucuuuuuuuuuuuuuuuuuuuuuuuugaaacggaguuucgcucuuguugccuaggcuggagugcaaugguacgaucuuggcucacugcaaccucugccugccugguucaagcaauucuccugccucagccucccaaguagcugggauuacaggcaccugccaccauguucagcuaauuuuuuuuguauuuuuaguauggaugagguuucaccacauuggccaggcuggucuccaacuccugaccucaggugauccaccuaccucggccugggauuacagugcugggauuacaggcaugagccaccgcucucagccaggguguaacauuuuaagguacaugauuuauaaaaagcuuuuuuaaauagcuucuccuuuagggauauaagcuuguggcuucucuggaauucuagcuuuuacucucauuuaaggguguugaauuucccuuccucccuugcagguucagcuguacacuuaaaaauguaaccucuguuaguguuuauuuuguucauugcuguauccucaccugagaauaaugucuggcauguaguaaguauuguugauuggauaaaguuaguauuuuauggagugauuuuaguuguuauuuaguggggcauucuggguucuuaguuguacuaccaaacaacaucuauuuuaauuauucuuuagaucucagcugaaaucucacuuccuaagggaaacauuuucugcuuagacuucuguuacauuuucucauuguucaugguaauuuuagggauggugguaauguuauuucugcguuuuauuaucauucauaauggaauagguuuguugacucuuuuucucuuuuucuucccaucuuuuccuguuuuuacuucuuaucccuuucuucucuccuuucgcuuuuuuuuuauucccucccuugcccugcuuuauuuucuugcucacuucucuuccuuuuuucuuucuucccuucuuucuucauaauauuuuucuucuaccuaaaggauuaaaaaauuuuuuuucuaaggcacuucuaguggugaugaauuauuuuagguuuuguuugaaaagucuuuauuucaccuuuauuuguaaauauacuuucacugagucugaaguucaaaauugacggguuuuuugcuuuuagaauuuuuuaaaugaugauucgcugucuucuuauuuccuaugaaaagucugcugucauucuuauguuuagucuuguguguauaauauaccuuuuucucucuggcuaauauuaagauuuuuaaauuugucacuuauuuuacacagcuugauuaaggucuaugucgguauaauuuuuuuuaugagucuuacacgugggauuuguugagcuucuugaauuuguauguuuauacaaauuuaggaauuuuuuucauccauuauuuauuugaauauauucucugucuucacuguccuuugaggacuccaauuacgcauauaccuaauugccuggaguugucccauagcuuacugaugcuuuguucauuuuuuucuuucuuuuuuucucaccaugcuuuaguuaggauaguuuuuauuacuguuuuuuuaaguuugcuaaucuuuucuucagcaugccaauuauucugccuucuuuuacauacaaaauguaauuauaacuccuugcauaucauugucuacuaauucuguuacucauguuuacuaauagaaacuaugucuguuucuauugaguguugguuuuuuuuuccuccucauuaucuguucucuuuuagggcuucuuugcauggcuggugauuuuugcuuggaugccagucuuuggaaacuuuaucuuguugagugcuauauaauguuuguauuucuguuaauauucuuuagauuucuugugguugcaguuaaguuacuuauaauagaagccauuugaucuuugagacauccuuuucuuuuuuuucuuuuuuuuaggucuuguuuaacagaaccagaguaaucuuuaggguuaauuuucuuccaacuacuuaagcaauucuuuucugaauuauguaaauuauguuuuucuacucuggcucauaggaaaauaaaugauucccagcccugucugggcccuggggauuguuuucucuguuucuuucagguggccuuuuuuuuuuguuuuuuuuagcuucugguaguuuccuuccaugcaugugcuaaucaguacuuagcugaaaucucagaggaacccucugcauauuuucagagaucuuucucugugccagucauucuuguuuaguaucccagccuauucuggcugccuuuaauugcccucuucuccacuuccucaauucacaaagauugcugggcuccaccaaucuggaaucccucucccucacugcacacugaaaauucuuucagucuuauaagcaaggguaguuguugagcccucaaugauucuuucucuggucucaaggauuauuguccugcacggccugauauccugugucugaaaucaauuguuuaauauauuuuguccauuuucaaguuguuuuaggugggcugcugcuacaacuaauacuaccacacuacucucucgguuggaagugaaagucuuaauguuucauuuuuuaaaauuauuuuuucuuauuaaaauuuuuuuuauagagacagggucucacuauguugcccaggcuugucaagugauccucccaccucagccucucaagaugcugggauuacaggugugagccacugcacccuuauuucauuuuuaaaaacuauauuuugguugagaagaugaaugaaaaccaucccugauaaagagaauaagcuuuugugucaauauucagauaaggcuuggaugcuuucucuuguauaaaauacuauacagugugcaauauacacaaauuucagaccauuucucagcauuuaaggucauuuagaaugaaaaauaaaacaguacaggucaguaaaugaauuccaguucuuauguagaauugucauaguccugauucaauuuaacuuaaaaauuggacuguuuccucugaauuuccugauucccuuaagauucccuagaauccaguaggcccauagauacaguggucauucauuuucucagcugucagguaaaaauuuuaccaauaagcauuucuuacuuuaaaaaaaucuguguuguauagcauaaaauaguauauuaucucuguauuguuuuaucuggaucaguaaauuaaagacauuauaauaaaugugcuaaugaaaauauaagauguuuucaaggaaaaaggaaagacccuuauuagggccaaaaaugcuaccggcacaugaaauuuuacaccuauucuuuucuaccaaggcacuuuucuaaaggcacugugauaaaacuaaaacaaaugugcuugguagagugaagagccuuuaguuugagccacuagucuucacauucuaccugaaucacuuggguccauuuauguaaagucuuugacaccguguucauaguuaacagugaaaccuuuaaaagauuugguuugcuuuguuaaagcauuuccauuaaauagagaaggaaaguagaaaauuaccauuaaaacaccaugguaggccaggcgugguggcucacgccucuaaucccagcacuuugggaggcugaggcgggcagaucaccaggucaggagaucgagaccagccuggcuaacacggugaaaccccaucucuacuaaaaauacaaaaaauuagccaggcgugguggcgggcaccuguagucccagcuacuugggaggcugaggcaggagaauggcgugaaccagggaggcggaguuugcagugagccgagaucgugccacugcacuccagucugggcgacagagugagacuccgucucaaaaaaacaaaacaaaacaacaccacgguaauagauacugcgagcaauauucacggaugaaugcuauaaggaguggacagaaauguaagggcagacagguauuugcauguucucacaguacuccaaaacauuucuuauuuaaaaagagaaaacuaguaguuuacaguggagaaaacuuccagaugcaccacuucaccuguaauaagacauauuaacaucauaugcacucauauauuggaauauaugcaucacauaugaugcacuugagaagacuacaucagcucuguggugauguggcuuucagaaugcauaacuucagucuaaugagaaaacaucugacaaaccccaacugugggacauucugcaguguguaugauauaacaucaauauuaugaaagaagaaagacuaggauaagucucggauuggagaagacuaaggaaauguaaaacuaaauguaaggggugggggacaaaguguuguaauuuuaaauacacaaggaauuccuuacugagaugacuucacaccugaaguaggugaaguaggaagccaucuggaugucuagaggaagagcauuccuggaggauaacaaaggcaagggcuuggagacaggaguauguccgauguguuugaggaauagcaaggaggccaguauggcaggagcacaugaagagaaggggagaaugcuaacaggggagauuagagauaacaaagaguaaggucaugaaggccuuggaggccuugguaauggugcaggaguccauuguaaauguguuucaccucuauuccguuugauuucugauguucuuuuauucugagccugaaggggauaaaguguauaaguauaaaauguaauaccuaacaucuagcacuguguguaguagaugcuaacucagugauuauugaauuaguguacauggugagauguuuagaaacauuuuaaagaucaugucuucccuugcuaaaggaauacuuuucauuuuuaauuacuuccuguaacauaaauuaggauucugauaccucuguauauuuuuaaaauguaaagguuuuaaaauaauuugucaccuucaauaauaucuauuuaugcuauugaacagaugucuuaaauaagcuucuauuuuuauuaguuuuaguauuuguaauagaguuuauuuuucuuugaaaauaacucacuuuuuauauuuucaaggauucaacauuuuuguaaaagugaauugauuucauaucuuuuuuuuuuuuuuuugagauagaguuuugcucuuaucacccaggcuggagugcaguggcacgaucuaaacucaaugcacccucuaccuccuggguucaagagauucuccugccuccgccucccgaguagcugggguuacaggcaugugccaccaugcccggcuaauuuuguauuuuuaauagagaaggguuucuccauguuggucaggcuggucucaaacucccgaccucaggugaucugcccgccucagccucccaaagugcugggauuacaggcaugagccacugugucuggccuggauuucauaucuuauuuaaauccuauauucagauuguuuuguuuuaaaaucuuaaaauuuuucucuuuauuaucuuguuugguuaaagugccagguuuuuuuugauggagggguccuuauuuguuuuuaucagcauggagcaguuaagaaauucacuuuuucccaaggauuguacuuauaucagaguuauguguagguuuuaaaaguucacugguccaccuuuacgaauuuuaaguacauccauauaguacaacuuuaauucugcuuguugaugguguuaauguguaugagagccuuagauuuaauguugaguacucaagagagcaagagaguguacaaggaguggauaggcacaaaguauuugaacacacugucuuacauguuuucauaauggccagguaagcucugucuuugcauuuucuggaaaagugugcaaguuuguggugagcacugcuuuuuuuuuuuuuuuuuuuuuuuuuuaaacuuaguacuuugaauuagucugaaagaugaaucuggguuuggccaguaaugaagaggugaacagggagucauaauguugaaacuggacauucagaucuuuauagcaugauuuccuuauuuuucaaagagcggaagaaucccaucguuuaucauguucugguuggacuuucuuacuguuugcuggaguugaacuucagagcuauggcgucaacccugcuguaauaucucaggggagcuccuaggguggggcuggugccauggcucacccuccaaccuuuccuucuucacuucagccuccagcucugagcuuuccaauccccagaguagcaaauguugaaagaaguugcacagguaaguaugugguggggaaagccgggggaaaaaugguacugucaucaguauuuugaggguggauguugggccauuuuaucaaugagucauuuuguuaguuuagaaauauaauguuuguuaucaauuauuuuucucauaaaacucauaaauuauuuaaaaaauagugaagaaauaauuuuaauucuuguuagaugugaaauaagaaaaaaaccuuaauaaacuauuaauauuauaaugcaaaggaagguucuuacauuuuuuuaaacuuuauauucuccacaguguauauagcagguccagaaaacccauguucaaaaaagaagcuaaaaaaaaaguuggggaaggccuaaguccauagacuauaauuuugccauauguaacuuggucucaggaggaggcaaguuuuaguuuucuuccacuagcuuuagaugugcuauuuuuuccugagguauuaggcagguagcuauguuuuaaucuuuacagaaauagaaauuucaaacaucuuuuuccuugaagucuugacaggaggacuggaacauuucuaccaaucucuagguuugaaguuaacaaaaauaaguauagauaucugguacguaauucagcaaauguuuguugaacgaaugaauaaacucaucagauccugugucgugugugugugugugagagagagagagagaugccaacacuccuggcauuuucuccuugucugccuugcacuggaaaucaugaucuaaacaucacagauuuaauuuuguagggauguagcucugggucuucacuaccuuacuuuugagcuucuucucagaaagcuuucaaaacguguuucuuucguucuccuacaucuaucccauauaauucauguucauugauuuauagauuuuugcacauacaagacauucacauuaaacccaagaaaaacagacucuuaagauggcccaugguugcuaaguuucuucagagaaaguaugugaggguuaaaagagauugggguucuaguguauuugguauuucaggucucaaaacaagucaucaaaauacagacuucccagcaguuugucucccuuuuuuucuugaguuuuuuagauaacuggacgcucuauauaaacacaucucccucagcaaaguacaucccguuuuuuucucaauauguauucauauucccuuccuuccucccucuuuaucagacccaucuuugccuaccgucuuuuaaggauuuaaaauauucucauuagaagauuuuccuucuguaugcauagaggauuuguuuuuauucuaaauguagagauuuucuacuguuauauguccuuccauuuguauuuuauaguuuuacauccuaauauuuaaagauaaaguacuacuuuaauuuuaggcucuauuaugugaguucucaacuccaacuucuuacugcucauaagagguacuaauuauauuuaguucuuuaguauauguguacuuuuuuccuauggauuagcacuuuuugaauaauuagaauuuugguuuuaggaugaugcacuuagcuuuuaaagcuuauauauuaauuguucaaaugugaaucuauauaaagcauauuggugcagcacauuuuaagauucuagaaaaccacaaaaucuguuuauucauguugaaacauacagaacauauucucccuagaucagagucaaacuuguggagguauuuguagcauuuugguaacacucccuagagaauuuguagacuuugggggugcauauuaagggauaacauacauggcuuuucagaauauuuucugaauaaagcagcuucagacaccagauuuuaguuuuuggauuaggaaagagugauguguuuuuccacccuccccucccccaccaacacacacacacauacccuccccaucuuucagauauaggccaucuuguuuuauuggaugagccccccaaaaauacacagaaauaugcuaaauauuucuguaaaccuuggaaaggacucugccaggauauuuaucuacucuccaaaauagugauuguggaaguguuuguauaggucccuagcuuucuacuaaagccuauuuccaaccagucauagauuuuuguguguguguguaucuacauguuaacuaucuuugguauucauugaggccuuuuuugcuuauuuaugguuauucugcauuggcuaaaacaaugaguugcucuuauuuguuuccaugcuaucgauuugaugauuuguaauucuagacuuuaaaauuuaucuauaucuucacuuuucuuagauccauccuaagcagauucaugaacuuuucauuauaccuauaucauauuaaaaauaugaaaccauaguauucuagaacucggaggacuugaauuuguuucucacaugaagaguuuuuuuuuuuuugguaaagauuuccagguauuaauaucuuuguucuuuaagaagcuagaauuuuuuugugcaguguaggugccuuucuguccuuuauuuaagccccccccccuuuuuaaauuguuuuucaagaauuaaauaaaauuagaauuauuuauaguaguugcgaagcaggauaagcaguuuaaaauccuaucacaaaaaauacuacugaaacaaaaauaucuuuguuaacaaauauuuccagguuguaacaauauaauauuugauauacgaauauucuacuuccauagaauuugggcagucugugagauuuuuaccuaucauguuuucccucuaaagggcaauuauaaaaacgcuagauuaucuucagguauuaggacuccucaucauugguuucagauguuaauuggcuacaccuugauaaaaggcagauaaguguuaauggcaguuggcugugauuuuauauuaaguuucugccuauuuuauagccaagaacuugugcauauuuguauauuguuuguugauauugaauauggaauucagagagaaaauaagaacucaaauucuaaauuacucagaucuccauuaggaaaacagugccugagaaacacuuuuucccccuucucagguacuguauaucuugcaguuagcagucuucaucuuguauaaugcaagcagacuacaaacucuguagcugggagugaaaauuuguuacucaguaugaagcagugaaugagacaauugauuuuaucgugugacaccuguaccaacauguuagcaguaaaacuccucccuacauuagagaaucuacaauaaaaaguugcuacuagggaauuguuuuuguuuuaacacaaguucuagaugugcccuacauauguaaugcuauaaugucuacauuagagcuauuauaaugaaauuaagaguuugguuauaauuauccuaauuccuugaaagguuaaauuguguucacuauacuuaaguaccuaaaaauguuaguucuuugggaacauggaaaccagguauauauagcuuuuaguaguuauuucuacuuaucugaagcccuccuuggauaauaauuuuuuuuuguuuucauuuuugagacguggucucacucugucacccaggcuggacugcaguggcgucaucuuggcucacugcaaccuccgccucccaaguucaagugauucuccugccucggccuccaaguagcugggacuacaggugcguaccaccacgcccaacuaauuuuuguauuuuuaguagagaugggguuucgccauguuggccaggcugcucuugaauuccugaccucaggugauccacccaccucaaccucugggaguugagugggauuacaggcgugaaccacugcaccugguggauaauaauuuuuaauugguauaauaguauuucuuuuaagcauaacuucauuuucaaauuaaugcaacuuucuguaaaauacaugugauuagucuuguagagacuggcuuuugucucacaugucuauaaucagucauaaucaguccauucuuguucuugugcuaaagugaucuuuuugacacacauaaauauucgauugugguauacccuacuuaccauuguucacaauauaaggaccuuccuccuccaaucggcuuuuuauuugcuccuuacugcuuuucccuuuacaaauucaagaacaaaacacacauuaaauuguuaguuguauauuugagagucaguguacuaucaugguuaaaaagggggacuccagcaaauuggucuggguucaaaacccaucuccgcauuuaucagauauauaaccuuaggaaguuaaccuaacuucucugguccuuagcuacaaaauagggauaguuaauuguucuuacuuucuagcguuaucuugauaauuacauaaauaaauuuuaaagcauuuagaauauucccuggcacaauaauuuauuauuauuuuauaguuaugauaaaguguuuucagagacuguauaaaacaagaguccuaauuuagugugaaaguuucaaagaaugggagaaagggcauuuuaaguagccguaucagcauaugcaaagaccgggacauggaaacuaacuucuguucugaguaacugaagguauggcaaggguuugguggugucaggggacuuaggagagaaguuagagguuacaaaacaucuuauaagccuuauugauuugggagugcuguugaggaauuuuuaucagaaaguccaugaagauaaauaauuuuuacuuuaaaaaaucacuuugaugugggagaguagaauugaggggaagaagaauagauuaauaaagaccuguuuggaggcuauuggaguggcuuguucuaguguauuauuaguccguucucaugcuaacaaagacguacccgagacuggguaguuuauaagggaaagagguuuaauugacucacauggcuggggaggucucacaaucguggcagaaggcaaaugaggagcagucacgucucacauggcggcaggcaagagugaaugugugcaggggaaccccccuguauaaaccaccagaucucaugagacuuauuuuuuuuuuaauuuuauuauuauuauacuuuaaguuuuaagguacaugugcacaacgugcagguuuguuacauauguauacaugggccauguuggugugcugcacccauuaacuugucauuuagcauuagguauagcugcuaaugcugucccuccccccuccccccaccccccaacaguccccggugugugauguuccccuuccuguguccauguguucucauuguucaauucccaccuaugagugagaacaugcgguguuugguuuuuuguccuugcgauaguuugcugagaauaaugguuuccagcuucauccacgucccuacaaaggacaugaacucauccuuuuuuaugacugcauaguauuccaugguguauaugugccacauuuucuuaauccagucuaucauuguuggaccuuucgguugguuccaagucuuugcuauugugaauagugcugcaguaaacauaagugugcaugugucuuuauaguagcaugauuuauaauccuuuggguauauacccaguaaugggauggcugggucaaaugguauuucuaguucuagaucccugaggaaucgccacacugacuuccacaaugguugaacuaguuuacagucccaccagcaguguaaaaguguuccuauuucuccacauccucucuagcaccuguuguuuccugacuuuuuaaugauugccauucuaacuguugugagaugguaucucauugugguuuugauuugcauuucucuaauggccagugaugaugagcauuuuuucauguguuuuuuuggcugcauaaaugucuucuuuugagaagugucuguucauguccuuugcccacuuuuugaugggguuguuuuuucuuguaaauuuguuggaguucauuguagauucuggauauuagcccuuugucagaugaguagauugcagaaauuuucucccauucuguagaagccuguucacucugauggucguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuagaguuuuuaugguuuuaggucuaacauuuaagucuuuaaucuaucuugaauuaauuuuuguauaagguguaaggaagugauccaguuucagcuuucuacauauggcuagccaguuuucccagcaccauuuauuaaauaggcaauccuuuccccauugcuuguuuuugucagguuugucaaagaucagaugguuguagauauguggcguuauuucugagggcucuguucuguuccauuggucuguaucucuguuuugauaccaguaccaugcuguuuugguuacuguagccuuguaguauaguuugaagucagguagcgugaugccuccagcuuuguucuuuuggcuuaggauugacuuggcaaugagggcccuuuuuuggugccauaugaacuuuaaaguaguuuuuuccaauucugugaagaaagucguugguagcuugauggggauggcauugaaucuauaaauuaccuugggcaguauggccauuuucacgauauugauucuuccuacguaugagcauggaauguucuuccauuuguuuguauccucuuuuauuucauugagcagugguuuguaguucuccuugaagagguccuucacaucccuuguaaguuggauuccuagguauuuuauucucuuugaagcaauugugaaugggaguucuuucaugauuuggcucucuguuugucuguuauugguguauaagaaugcuugugauuuuugcacauugaucuuguaucccgagacuuugcugaaguugauuaucagcuuaaggagauuuugggcugagaugcuggaguuuucuagauauacagucaugucaccugcaaacagggucaauuugacuuccucuuuuccuaauugaaugcccuuuauuuccuucuccugccugauugcccuggccagaacuuccaacacuguguugaauaggaguggugagagagggcauccuucucuugugccaguuuucaaagggaaugcuuccaguuuuuguacauucacugugauacuggcuguggguuugucauagauagcucuuauuauuuugagauaugucccaucaauaccuaauuuauugagaguuuuuagcaugaagagcuguugaauuuugucaaaggccuuuucugcaucuauugagauaaucaugccguuuuuuuucuuugguucuguuuauaugcuggacuacguuuauugauuuucuuauguugaaccagccuugcaucccagggaugaagcccacuugaucaugguggauaagcuuuuugaugugcugcuggauucgguuugccuguauuuuauugaggauuuuugcaucaauguuuaucaaggauauuggucuaaaauucuuuuuuuguugugucucugccaggcuuugguaucaggaugaugcuggccucauaaaaugaauuagggaggauucccucuuuuucuauuuauuggaauaguuucagaaggaaugguaccagcuccuccuuguaccucugguagaauucggcugugaauccaucugguccuggauuuuuuugguugguaagcuauuaauuauugccuccauuucagagccuguuauuggucuauucagagauucaauuucuuccugguuuagucuugggaggguguaugugucaaggaauuuauccauuuccucuagauuuucuaguuuauuuguguagagguguuuauaguauucucugauggugguauguauuucugugggaucaguggugauauccccuuuggcauuuuuuauugcaucuauuugauucuucucucuucuuuauuaaucuugcuagcggucuaucaauuuuguugauccuuucaaaaaaccagcuccuggauucauuaauuuuuuugaaggguuuuuugugucucuauuuccuucaguucugcucugauuuuaguuauuucuugccuucugcuagcuuuugaauguguuugcucuugcuucucuaguucuuuuaauugugauguuagggugucaauuuuagaucuuuccugcuuucucuugugggcauuuagugcuauaaauuucccucuacacacugcuuugaaugugucccagagauucugguauguugugucuuuguucucguugguuucaaagaacaucuuuauuucugccuucauuucguuauguacccaguagucauucaggagcagguuguucaguuuccauguaguugagagguuuugagugaguuucuuaaucccgaguucuaguuugauugcacuguggucugagagacaguuuguuauaauuucugaucuuuuacauuugcugaggagugcuuuacuuccaacuauguggucaacuuuggaauaggugugguguggugcugaaaagaauguauauucuguugauuugggguggagaguucuguagaugucuauuagguccacuuggugcagagcugaguucaauuccuggauauccuuguuaacuuucugucucguugaucugucuaauguugacagugggguguuaaagucucccauuauuauugugugggagucuaagucucuuuguaggucacuaaggacuugcuuuaugaauuugggugcuccuguauuggguguauauauauuuaggauaguuaguucuucuuguugaauugaucccuuuaccauuguguaauggccuucuuugucucuuuugaucuuuguugguuuaaagucuguuuuaucagagacuaggauugcaaccccugccuuuuuuuguuuuccauuugcuugguagaucuuccuccaucccuuuauuuugagccuaugugugucucugcacaugagauggguuuccugaauacagcacacugaugggucuugacucuuuauccaauuugccagucugugccuuuuaauuggagcauauagcccguucacauuuaagguuaguauuguuaugugugaauuugauccugucauuaugauguuagcuggugauuuugcucguuaguugaugcaguuucuuccuagccuugauggucuuuacaauuuggcauguuuuugcaguggcugguaccgguuguuccuuuccguguuuagugcuuccuucaugagcuauuuuagggcaggccugguggugacaaaaugucucagcauuugcuugucuguaaaguauuuuauuucuccuucacuuacgaagcuuaguuuggcuggauaugaaauucuggguugaaaauucuuuucuuuaagaauguugaauauugguccccacucucuucuggcuuguagaguuucugccgagagaucagcuuuuaguccgaugggcuucccuuuguggguaacccgaccuuucucucuggaugcccuuaacauuuuuuccuucauuucaacuuuggugaaucugacaauuaugugucuuggcguugcucuucucgaggaguaucuuuguggaguccucucuauuuccugaaugugaauguuggccugccuugccagacuggggaaguucuccuggauaauauccuccagaguguuuuccaacuugguuccauucuccccgucacuuucagguacaccaaguagauuuggucuuuucacauagucccauauuucuuggagacuuuguuuauuucuuuuuauucuuuuuucucuaaacuucucgcugcauuucauucauuucgucuuccaucgcugauacccuuucuuccagcugaucucauuggcuacugaggcuugugcauucgucacguucucgugccgugguuuucagcuccaucagguccuuuaaggacuucucugcauugguuauucuaguuauccauucgucuaauuuuuuuucaagguuuuuaacuucuuugccauugguucgaacuuccuccuuaguucggaguaguuugaucuucugaagccuucuugucucaacucaucaaagucauucucgguccagcuuuguuccguugcuggugaggagcuacauuccuuuggaggaggagaggcgcucugcuuuuuagaguuuccaguuuuucugcucuguuuuuuccccaucuuugugguuuuaucuaccuuuggucuuugaugauggugacguacagguggguuuuugguguggauguccuuucuguuuguuaguuuuccuucuaacagccaggacccucagcugcaggucuguuggaguuugcuggagguccacuccagacccuguuugccuggguaucagcagcgguggcugcagaagagcagauauuggugaaccacaaaugcugcugccugaucauuccucuggaaguuuugucucaggaguaucuggccguguggggugucaguccgccccuacuggggggucagggacccacuuguggaggcagucugcccguucucacaucucaagcugugugcugguagaaccacuacucucuucauagcagucagacagggacauuuaagucugcagagguuacugcugccuuuuguuugucugugcccugcccccagagguggagccuacagaggcaggcaggccuccuugagcuguggugggcuccacccaguucgagcuuccuggcugcuuuguuuaccuacucaagccuuggcaauggcgggcaccccucccccagccuggcugcugccuugcaguuugaucucagacugcugugcuagcaaugagccgggcuccgugggcguaggacccucugagccaggugcgggauauaaucuggugugccuuuuguuaaaccuguuggaaaagugcaguauuagggugggagugacccgauuuuccaggugccauucgucaccccuuucuuugacuaggaaagggaauucccugaccccuugggcuucccgggugaggcgaugccccgcccuguuucggcucacgcauggugcgccgcacccacugucccgcacccacuguccggcacugcccagugagaugaacccgguaccucaguuggaaaugcagaaaucacccaucuucugcgacacucaugcugggagcuauagacuggagcuguuccuauucggccaucuuggcuccacccucaugagacuuauucacaaucaugagaacagcacaggaaauacccgccuucaugauucagucaccucccacgggguuccuucugcgacacguggggauuauuacaguucaaggugauauuuggguucagacacagagccaaaccauaucagcuaggaaaugaccguagagaugaaaagauauugaugauauaaauaauuucaauaaauauauaggguugguuugaucagcuugaauuuuaauuguugaagaucacaaagguuacagacagcauuuuugagaguuaaagugacauuuuucagagauuaccaugaacaguaacaacugugaauagccaaaauuaagcugaaacauaagauuuguguuggguucuaagauaguuagugcugcaaagucauguugaggugaugaucucagggauuuuuagguguauccucuguguaucuucaggccugccucuuacuucguugguucccuaauugccauucauccugccuguaucagggaccacuuuacccgucuucucugaaguucuugguuauuuuaucugaaguuuguuuuuuuuuuuuuuuuuuuuugguaaauuucugugauuauucugauuuaccacauuuggcuuugaaauacuguauuuaaauguugagaaugucaugccuuaggaauucauagcuagucuaaacuaaauaaugaaggaggaauauacugggaaaauccagccaacuuaaguggcuccauuacgucuuccaguuuaauucuuuauuacuuucugagaccaauuccuuuuggggauuugguuugguacagaggauuagcuuacuuaucucuguauuuuuaauuuaauuuuauuuuauuuuaagacguagucucguggugucggccaggcuagagugcaguggcaugaugaucuuggcucacugcaaccuccaccuccuggguucaagcaguucucccaccucagccuccugaguagcugggauuacaggugcaugccaccaugccuggcuaauuuuuuguauuuuuaguagagacaggguuucacguuguuggccaggcuggucuugaacuccugaccucaagugaucugccugccuuggccucccaaagugcuggcauuguaggcaugagccaccauuccugaccucuguuuacuuuuuagaauaugcugcuuaguucuuaugaaaucaaaggaaagauuaaaugucuugauuaaacguuuuagaucuguguucaaaaaagguuuaagaaacauugguuuugcuacaugcauauauucuuuccugguaaaaaaaaaucucaauuugucuuagaaagucuggugugagugucaaguaaaaagguggucacuuaacaaaguauauauaagcccuugacuuguuugcuugaauaaagcugacaaauuguacacaccaaagauucuaaugcuguauauccaagaugaagucugauuuaauuuuaaacuacagccauaguuuaaacuacagccauaacaaugggaguacauucugagaaaugcgucaggcacuuuugugaauguggaccauacuuaaacaaaccuggaugauauaaccucuugcuccuaggcuauaaacauguacagcauauugcuauacgaauucuguaggcaguuguaacacauugguauuuguguauuuaaacauaccuaaacacagaaaggguacagugaaaauaagauacaaaacauuuuuuuaaaaagguuacaccuuuauagggcacuuaucauaaacggagcuugcagaacuggaaguuguucuggguaauucaguaaguggugugugaauguaaaggcuuaggacauuacaguauacuacuguggacauuggaaacacuguacacuuaggcuacacuaaauuuauuuaaaaauuuucauucucgaauaaugaguuaaccuuagcuuaccguaacuuuuuuacuuuauaaccuuuuuaauuuuuuaaaaucuuuuggacucuuuaauacuugacuuaaacacguacagcuguacaaaaauauuuucuucccuuauauucauacuuagcuuuuuucuauuugaauuuuuuuguuuuuuuacuuuuuagauguuuuuguuuuguugaaaacugauacacacacucauguauuugcuuaggucuaucaaggcaucacuaggcaauaggaauuuuucagcuuguuuauaaucuuacgggaccaccguuguauauaugguccaucauugacugaaaugucaugcugcacaugacugucguuuauuaaaauuuuuauuuaccaaauuaacuuuuuaacauacguuguaaccaguaauuucaauguauuucgauauaauugacauauccucuuugaaauuuauagaaauugauuuuuauguacccuaauuucucuuucagggagaagauggguauaguuuaacccuuucauaucauccauccauccauuccuacuaguucugccucagaguauauccuuuauucaacuacuacucaccacccuauuaggccaucauuaucuaucacuggccuccuaaugcauuuuccugcuuucguuuuauacccucuuuagcccauuccucauggaguagcuaggaccuuuaaaaaaaaaaaaaagccaaauuaaguuacucuuaagcuucgccuaaauccucucuugauuucccgucuaacaaagaauaaaauccaaagucucucaggcucucgagguguacuauauggucuagccccaaccagucucucugacaugaguuccuacccuucaccaccuaaguucaugcugccugagccauaccagugagggguuuacugacccucugaacugacugcuuuuccuucaagcauuugccuggucaguuacuucucugcuuguuuucaucucaguuuuauguucccugauuauuuuuaaauacuuccuacccuguuccaucauucuauguagaauaaaggacgggcacuuuaaaauuaaauaaaucuagcuuuaugaaaaaccuguguugucuuuuucucuugugauuuugccauggauuagaauugucucauaccagcacccaucucuggauggggguuugcauucaugggggagaguaaaacacccuuaccucucccucccuccaucugucuuucucucugucucacucucguuuuguuuuuuaauuauuugcugaagucauguaagaauaauuaguauugucacugauguguaauuucugugccagagcacacaaaacagaaauuaagcuuaaguuugguauauuuucucucucucucucucucucucucucucucacacacacacacacacacacacagugacucuugagaaaaucugguauugauggaaaaggaacauuucuucauuuucuuucgucuggaacauauguuuaauuuugccuucaaaccaaaccuuuuugcaagauauuaagcauaaaaauuuuaauucuauacaauuaauuucaauuuuagaauucuaggagucuauaauggucuugaugauaaguguuauacaaacagugucaaaagaagaguuuaucaauuugagcuuauuuauguguauaaaauuugaugagagaugccuugauauucaccugaaacuuuauugaauaauuauugaauuaugcauuuuccauguuuauucuuucuuagaauuagagcucaauaguaagaguucuauaaagauaauuaaauguaucuuuaacuuucaaaaaacaaacuucuaaaaucuuauguguagugaaucuuaauuugcaagcucuaaagugauuuuuugccacuguuuccuuuuugaaauuacucacuaagaaacaucuguuuucccccuaguagggacuacuuagggagcugguggauaggcaugcgggauccuggucugaaauaacagaguuacagaauagcauucugagauucaccaggagucuguuucccaaaaaaagauuaaguaccuguguucuaauaaauuguuagacccuuaaaaaauaucuuuguauauuucacaccucaagcgauuacuugccuaaaagcauauagcaaaguaauagguuagcuguccuuagacuuuauuuauaccugacugaauagguuuucagaccucaggaggaaagacagucaaauaauuaaguuuccuacauauuuaacagggaacuuaaaauauauaagaaauauuaaacagcaugggugcuuucaacagaguuacacguaaaguuuggccuucaaagucugcaacauaguucaccacgucuacugauauguaauagugacuacagcauuuuuugaaaugagacauggaaauuguucacucauuuauaauggaaggaaauauucuuagucauaaugaauguacaagacagauaucaaauuugagaugaguuuuccccaaaaauguacuugugaaaagacauagucaccuuguauucaagucuuuaaaaucucuuuucucauugacauugguuuaccuugauuuucaaaguacuguuaggagaaagacacauugaccuuaaauaacuuuagucaguuaauaguuuugauaauuuuauagaggucacauuuuaaaaauaauuaaaaauuaaaauuagcacagauuuuaauaauuacaguuggcccuucauacccauggguucugcaucugugggucaaccagcugcagauugaaaauauuuggggaaaaauaauggaugguugugucuguacugaacauguacagacuguuuuuucuuguaauuauucccugagcaauacagugacuauuuauauagcauuuacauuguauuagauauuauaaguaaucuagagaugauuuaaaguauaugaaaggauguguguagguuauaugcaaauauuauaaaccauuuuaugugagagaauugagcauccguggauuuuauuuuuuaauccaugaggggagagguccuagaaccauuucuucacagauagcaagugacaacaauuuauguuggugugagcucaaaauugcuaauguuggauguuacaaagacuggaaaaacaaaugaauaagcagguuauaucauugaaauaauaacuuuauaccaguaugaucaaugaaagauuguacuucaguuacaugaguggguacuugcuugagauaaaauucuaguaugccacuauauaugcacugauucaaaaaacgguauauuucaguaaacuuagauuguaaggaaagaugaaugcuugggaaaacagauaacugagaaaauaaggugaugacagauacacaaauguggaagaugcaugugaagauuuugaauaauuaaaccuaaacuuaauuuuuaaaaaaucuauguaugggaaaaugauauuggccauuuuugaagaguaagguauacuuaguuuuuuaaaaggaaauggaauuguuaagauaggcuuuaugugauucuccuacuuuuagggucuggaaauaaacaucuaacacuuuauuguuauaaucagauuuaugacuuuaucacaugcgccacuagccauuaguugaucaauuucuguaucuuagcaaugcucccuucauguucuguuuuccacauaggaguaagguaacacugaacauuuuccaaaguauuaccccugauaaaaguaauauuuuuguuuaggugacaaacagcauguuuggugcuucaagaaagaaguuuguagagggggucgacagugacuaccaugacgaaaacauguacuacagccagucuucuauguuuccacaucggucagaaaaagauguaaguuaaucaauuauguuguauuuuuucagcaauguaagucugugucuggguuccugaaaaacagcauaucaagugcagaauacugucugugguugagugacaaucuuuucagcacagugcuagucccuuuggugcuuguauccuuuugggauacaaagacaaugaauuuguauucuaauggggaaaauaaauaucccaugauucucaaauugggauaugguaauacugugauagaaguacucaaagacauggaguaaacaugguauaacuucuagaucacugauuuuuuuuguuuguucaauaugggaaauaacuuguuugauauuaaaacaaaugcagauauagaacagaaagcagauuuacgcagacuugaagauauaauggcaagcuguaauaaaacuuuaugcuuauugugucaucuagcuguaauucuggaccucagguguaucucuccucuguucagccauagggauacuauaauaggaaaaauuuggaagaacuguauucaaaaugugauggaugauauagagauaugaauuaaaugcuuuggaaggcuaauaguucaauaaucccauuugggauaaaaggauuuagaaugcaaccaagucauaauuagcaaauuuauaaaauacuuaaaaaugaauguaauuacuaaaauucuguuaagcuacuuuaaauuauacaauguacucucuagucacaccaguugcauucuuauacuuuguacaccugcccagcuuuuuuuaccuuucacacuuuauaaacuugcuaugccaaaucuccuuauguauaaaacaaucuacucuagcuauuaaccuaaugagauuuauacugauguuugaagcauuuauaaaguucuaagauauggaacaaaugcccuuguuuuucuuugaaguugaucauuaguaaaucacuuccuuugacuuugcagaauuuugcaaaucagcuuaaccuacuagguuuauguuaggauguuuguuauucuguuuuuguauuuuccuuuuuuauuuugauuugaacauucuugugucauuuugaaaacaaacuaucaauggcauuauugggcuuuuuucaacuaauguguguuguggcuuuguugauaauuaguguguaguuuaauagcuuauggaauaaugucaucuaauuuucuguuaucuuauugcgcuuuuagcuaugugcuauguaacuuauaauugaauuauuauuuacacagguuucuauuuaaguauugaccuuguaaauaaagaauuugggauauauuuuugguaguaucgccgcagaaacgaaaaccuacaauuuguguguauugcugugauuauauaaugaaaguuaaguuugcuuggaaaauguuaaugaaauauuuauuacugaugaaaugcauuuauucuaauuaggaagauaggaagcuuucagacugaaaucuaaaaguauauaaagagaaugaaugacaaagagauauaugucuucucaaaagcagaaauacuauaugucuacauuuuaaaaucagaauuaguauauauacuuacacacauacucacaaauguuggccaccauucugauccagcugguuggcacagaaguaacagaaugguuugauucacaaaaccuuuuuuaaaaaaacauuaauuaagaacauaguauggcauaggaauuaagaacuuggacucuaaagcaauacaaauauguguguuuggauccugacuuugccuguuagcaagaacuucuccaagucucaguuuccuuuucuguaaaaauaggaguaauaauauauuggcuaccuuauacauuggcugcuguugcuguuacuuuuuuaaaauuacaaaauagcacagguaaauuauacaaauuuuuaaaaauacacuugaagaaaaauuaccuauaaugcuaucagaaauaauugcuaaaauucuaauuuuaugcuuuaaauauuuuuauugaaaaauacacaauuauuuaaaucuucuaggucauacagacauauuuuccaucaaaaaguuuguaccaguuuuuacuguaaucaccacucuccaugccaacaagaauaccagcaauuacauuuaagucuuugcuaauagacaagcuuauuguuuucauguacauacaguaaaacaucauuaauuuuacacacacacagugugaugggucuuuuccauauaguuauuggucauuuguauuucuuccuuuguguaccuuuuuugugucauuuucuauuucucuauugagaucuuaagucuuacuaguuugcauucuccauguauugaggauaacaaccucuugucauucauuacaaauauuuucccaguuuuucaccuuuaauucuugguauauguaguauacguauauuugucauuuuaauuaaaugugauccaucagucuuauuuuuaaauggcuucuguuuucgagaucauacuuaggaagacauuucccaauuacuuucuuauaauacuuuuauguuuuguucuucacauauaauuuauguccauuagaaauguguuuugguuuaaccugugaauuguaggguuccaaauacuuuuuuuuucuacaagcuuauccaauugcaccgacaccauuuaugcuuuaaaucacgggucagaaaacuuucccuuaaagaaccagauaguaacuauuuuaggcuuuguggaccaagaagcaaaaucaaggauauauauaaaaucaaaaccuauuuuguauaauaggccuuuauauaaccaucuguaauguaaaaacuuucuuaguucauguaucuuacaaaaacaggcagugugcuggauuuguccugcaggaaauaauuugcccaccccuggguuagaucauuaauuuauggcuaauuaaaauaucccuuuauuauaugugcuagugucucauacauucuugggccuguuucuaagaucuuguucuguuuaccauacugauccugugucagaacuacaacauaauugaauugccauagcuuuguagaccacuuuaacaucuuggguaagaaucuuugacauccuuuguuuuaaaaaaaugguuuuugauuguugcacauuaauaucaauauagaugguuuuucggaaggauauuucucccuuuaaucuuguucuuuaugcguuuuaauaggguuuugcaguugccauuuucauugcauuuuucagauugguuuuuacugaccuauggaauacuuuguguaguuauuuuauaacaaacugccauguaaaagucuucuauuaguuuuuggugauugagaauguaagcccuggaaauccuacuauguaaguuuuuaugucagcuaccugauuugcuagcugugugucuuaggacaucagucucugugugucucaguuuucucaucuguaaaauaggaacaauaguaccuagcucaugaaggauuuuuuuuuuuuaagugggagaauaguuaguguuugugaggggggcacugaagugacugcuguaauuaagacagacuguagaaaauagguuagcaaugaauauugaaaaccuuuaaaauguaaacauuccuugagucagucauaugucuuuccguaaauuuguacuucagcuguaaccugacauucagacaauauaauauaaugccauacuuguuuuuaacaaaaaauuugaggcucaaguguuuaaggaauuaaguacauugaguauuacacuauuuuucaaauguuccuuauguaagcuuaagaauauuuuaaugaaaauuauuugaaauaccuaguagaugcauaucaucaguuaccugauuuguaagcuacccuguucugugacuuaaugacuauuuuauuuuacugucugccuccucccuugccccuuuucucuuuuguucuuguuuguuuguuuguuuguuuguuuguuuugggggauauuuugagacagaauuucgcucuuguugcccaggcuggaguguaauggcacgaucuuggcucacagcaaccuccgccuccuggguucaagugauucuccugcuucagccuucugaguagcugggauuacaggcaugcaucaccacgcccggcuaauuuuuguauuuuuaguagaaacgggguuucuccuuguuggucaggccggucacgaacuccugaccucaggggaucugcccuccucagccucccaaagugcugggauuacaggugugagccaccgugccuggccuuguucuuuuuaauguauuaccuucucauaguuuucuuuuuuugugccuguuugcuagauuucauuaguuucauguuuuaaguuauccguuuuccaauuuuaaagguucuuuagcuucugucuagaucuggaacucuuaugugugugcaugcauaugcuuucuuccuuuuucuuugucucuuuuucucuuuguagauaugguacaguuaaaaagucauaauucauuugugguuuuuguccuggaauaauaacauagugcuaggaauuauauuaucaccauaauuuugaguauauuauacagagucuuuuaaaaauaauauuuuaaaacuuaaauaucauuuuuuaauugcugucauggucauggaauuuuuauuuaacaaaauuuuguuguauuuccuugcaacaauuuguggauuucuuugacauucuguauauuaaaggauaaagaaguucugugaaggguuaggggaauaaccagaaucacauuacuguuucuucuaguugcuuccugguuuuuauuguuguuguuugacugcagugugcauuguagauuucugagagauauggaagaccugauuauuaugaugauuuuagagugugcuguaacuuguuguuuucagcauucuauuaaucuuuuucuaccguuugccacucuuaagagcacaaguucuaugccuuauuuuaccuggaauuugugaagauaaacuuucuuuagccccuugggcaaaaaguuauauaaauuaaggguauuauuuaauacauuucucaagagucugaaugcccccucucacuccuauuaaugagaguucugcaacugaggggaagauuagauuauuagcagcugcugcuaccauuuauugagcacauacuauaugccauaucuuauuucauuuaaccuauacuucagcucugugagguagguaguuauuuucauuuuauaggaaggaaaccaaguauugguuguuccauagguaaguggcagaaccaggauucaaacccagauuauuucugacuccaaaacuagacucuuuuuacuugugcugcauccccuacuguaauguguuucuugaucuaaaguuuuauauuuuucuaagaaauuuaccuuuauauuauuaacuuucagaauuuaaaaaauauauacauuuuguuuucugcuaauaguacuuacuguucugucagaguauauuucuugugcauuuucuauacucauaaaaagcauuucugugacauucacauuucuucacuguguauuaaauccauuuuuagcaccgauuuguuugaugaaauauugccuucagaauuuaaaaguacagguucuuagggauagacuuuauaagaaauuagauauuugcauuuuugacacauuuugaggcaguaauuuuaagauaugucuguauagcugaucgaugcuuauuuuacaugaauguguugaagguuacaaacucuuaaauuuaacauuaaacuacuuuuauuauuccuguaaagcuguguuuacuaaccaccuucauguaguggcacauagagaaaauuguauauaauauuacacacugugguaagugaaucagccuacgguucuugaucucaaguaauuggccuagggaccuaccaccucuuuaccuucaugcucugcuuccccucccuacuuacucccuccucccauuuugagagggcagguagauacccaggcauaucuguaacucauggauguauaaucagugugagaaaguagacuaaaauguguguugucuggaguuaacuauucaauaaacauaaauaucugaugaaaaauguuuuaaguguuuuguuugacaauauucacauuauggauuguucuaagucaugcauuuauguuggccagcaucuuauauuugcagccuuuagaaacaacuguacuuuuucauuuauagcuuauaaugacagaaaaucaugauucuuaagaauuuuauauaaaucuuuuaccuccuuuuuuugaugguugauuuguauuacuauuaggaaaaccagauuuuaagauaucaagcauuauuugggauaaagaaggccacuacauaaucauaaaagaaaacuuacuaaaaaggauaaaacuuccuuuuuuauuuuuuaauuuuacuuuuaaguuccaggauacgugcgcacaacgugcagguuuguuacauagguauacaugugccauaaaccuuuuaccuucugugaucaacuaaagcuuuauuauauauucuuguucuugcaauuuggaaaugaacuuuuaauauaccuacaaaauauuuucaguuaaugcaguaacaguaaucuauaauaccuaagaaaagaacuuaucaggcaucuuuugaucuguuggguuauaauugggaaagaauauauaguuuaauuguauagauaaaggauguuaguuuaauuaucuagguugcacaaccucuggauuugggagggaauauuuauaagguuugauuuuuuuuuuuuuuuuuuuuuuuuuagaaaaaucacuacugucguauuaauauuacuguuuucuuuagagugguguauaacucagcccuaccucaagaguuacugauguguaccauuggucuaaaacuauaguauaaaaaauuuugcaaacuuuaguauaauugaaacaacuuagaauuuugacaugaaaauaguaugaaauguauauuguaaaaccucuacccuuuaaauguuuuaccucagcaccacaagacagggugagaaaauagaaaaaaaaacaaacaaaaauacauguuucacuucuugguuuuucuaacuguggucagugucagcaugauuuuucaucccuggaaaccacagaucagccucugauaguucucucuuuugugagucuccauuaaccuccuuuucccguuauaccccagcuagucaacaggacauaaaauaacuguuacuucuaccaccagaaugcgucuuauuuuuagucucacuucugcuguugucguuuaguaucucagcauaucccauuucugcuauuagagguaucuucccaaaacccauuuugauugccaccuucuugcuuaauauuauuuuucuuuuuauugcuauaguugguagccauucuuguaugacauuuauuucgcauucuucuaugccauaacaugggugagcuuuaucuccaaauagagaugaacuuuaucuccuuucauaguuauccuaucaccacuguuuauguucucuaauaauauuacaaaucuuuauuuuuuuuaacaacuggauacuggguuuuuguguucaauuuuuaaauuuuuguucaauuuuuuugaauuucaauaguuuuggggguacaggugguuucugauuacauuacuaaccuuuguuacacuuauacucacugcauauucuugagggaagaccccuucauuguauguaccuaaauguuaccacucuauagaguauuccugauaccuuuguguagcuccagugauguuucauguuuccuuuagagcauuuaccacacugugccuuaaaauauaaugaguuguauaauucauucucuuuccccacuagauuguaagccccuugaugacauggcucaugucuuauuuaauuaggauguuuugaugguugucuaauauaagacaggaaauacgcaaauaugcacacacacauauuuucauuuacucagcuucaguauuuacuuuugaguauauaacacugcuacauucauuucuaugaggauauauauaaugaauguauguucugugaacauaucuucaaauaauuuacaucuacaaggaaaaaaaaauggauaaauucaaaggcauuguacaagugccaugaaguucacaucacaaauacauaaauuauauaccaugucuauauaauuuuauuuuuuuaacuugcuaagugaaagaguagugcugcuguaacucaaguuagugugacuuuuagaaaacuuauaguauuaaaaauuaauuucauuucuacaguuugguuuuaucgaauugugauauucucuuaagaaacauggaauauauuauagaauguuuguuuuauguuuuucugaagaaugagaaaauguuagauuuucacauuuaugguaugauuuacagauuuguggaguguaaaugcaaugcucugcucuguuuucuuuaugcucuaauauaauuaauuuguuucuagaugcuggcaucaccaucuacaucaggucagcugucucaguuuggggcaaguuuauacgggcaacaaaguaagaauuuuguauuuauucugggauacuuuauuuaaagagaaaaauaaguaacuaccaaauaaagaacaaccaguacuuccuuuguggguuuauuguaugacuuaaaaggaaaaauguuuaauuuucagaguuuuauuuuacuuacauagcaaaaccucauuauuucagaccuuauugauccuaugguugcuauuacuuggauauagcauagauugaaauuuauuucaacaucuuuuacaucuguaaauuuuuugcaguauuuuugaagaauuugcuaaacuaaaaauagacauucucuguguuuucaauuaaaggaaguuaaaagcuuuuuuaguuuauuugacuggcuacucuguguguguguguguguguaugugcacgccuguuuauuaaguaaacucauuacuuagcaguuuguaaaauguucuuuguuucacaaguauuucuuaaauauuucuucuuuugcuuuagcucagucuggauauagaaucuagauuuuugacucacgguuuaaugcuuguuccguuuugcaggcuucuacuucuauuuuuuuaaaguguuguaauacuuuuaaagcgcuuagcacagagccuagugcauaguaagugcucaauaaauguuagcuauuaucacauaaaauuuuuauaaaacuaaacaauaaaauaucuuuauauuuucucaaauuaacuucccaaauuguuaaauauuaguaugauuuuaucaucucuguuaaugucagaucuguugaucucccauuucuguuaauguaaucucuguuaauagaagaagggaauuaaaaguguuauaaauucccaucagacauuauaggauaauugaauaacugaagaagacaucugaugacuauccuaaccaguuucaaguaaaaaucaauaauuugauuuggaacucucccaguauaaugaaaagcaaaguuuugacagguaucagaauaguuugucauaacacuuuaccuuccaaauugauucgaagugggaggaugaaacuaauuuuguauacaagcaugguuuccauuuacuuuuuucugucuaucuuuuguggcuuuucucuuuuuugcuauggaacacaauuuuguuaauauagaauuaguagauaaaaguuauucuguauuaacaguuucuccaauuaaaccaagaaacguauuuccaaagcuuauuacauaaaaaaauuguuuaucuacaaauauuuauccuaguuguugaaggacuauuauuagcuaguaauuuauucugcuuacccuguguuuuaguguggcuuucacccuucugguaacccuuacuauagaaauaucuagcuauuuuaaagcuaccuuuuauuucuucagagcaacugcaaagaacuuacuuuaccuuuuggaagaccaccguuuaucacagcagaaaguagauauggauuggagaaaaauuguauuugagaaacuaagguuauuuuguaaaggauaauggcaauuacuauacuuauaaucagcuaucuggauuuuuuaaaauucuggucuaauuuuuuuagccuacaaaucugaaauucuaacugggcuaagauauggaauggguuauguuuaaaaugcaguuauaucauugguaugacagacauuuauguuuuuguuuuuaaggacauacaaagauuaauacaugagaaaauuuauuuucauuagaaaaagaauuuuuaagguacuuacuaguuuaaaaagaagccauguauggcaaacauuuuccauuggaguucaguauauuaaauaacuauauuccuguaacauuggugaagcaacauuuugaauguauggcuuacucuuuuaaaaugacauuuuaaguguuagauagaguacagaaaaauugaaucuuagaucaacuggaacuguaauguuucaggucaggguguaauuauguuuuuccaagauaucgaucuagaagcuauaacuaguggaaaaagaaagagucuagguugccaauuucuaucuguuaggacagacccgagaaggccaaauaggucauucagcugguagguaaucugaacaaacaccuugucagacagcagaacacaagcuaccaugugggucuugaggguuaagguuuuaauaauuuaagucagaaugacaaaacuuaaggaacugaguuaaaugaaggauggagagauaaggaauuaguaggugaguguagauuagagauauuauucuuauggcaacuuacuguaauugcacauugagauugguguaacuaaaaguucguuucccaagugcauugaguaccacuauuaauucuguucaguuggcaaacuuuuauuguaauuugugccauuaaaaaugugagaucuacuaucuauuguauguucuugaugguuagaaagguuagagguggaagagauauagaaggaagagugcccucucuagaaguaagagucacugagauuaaacaagaaagggaguuugucuuggaauagauacagaagugcuuaaacuuagauuuggcuagauuuggguggaagugauuaugcagugccaugagguagccagaaaaugcuggaacagagaccuguauggucuucaguucuaguauaguaugauuguauccaaauauguaaauaauuggacuuuucauccaauaauucacgugaauacuguacauggaaugauaacuauagaaaccaaugaacauacucuuguauucaaguugcauaauguuuccuauuuguuauauuugagugugugauaagcuuucaggugaauuaaguccucacuuaacauaaguuuuuugaaacugcgacuugaagcaaaacuacauauaacaaaaccaauuuuuuguucucaucaacauuacaauggaaugaaguugaaugaaacaacacuauucaaggaccugcuguauguauuuuugccugaaaucacaguuuccaagaaugaucaguggcauuaagugaagacuuacuguacaccuuauaagcuucaagacccaugagcucccuuaagcugucuccuagauuagaaucaacagggaaccaggaauuaauuucuccuggauagucaaagcauuggaauuaagugguugauaguugcauuuaccuuuucuuaguuaccaacaggaucuaggaccuuguaagauuggagaaaaaggaaacugucauuuacugagugcuuucugugugcauauuaucuuauaggcaccuagcuuagcaaaauaucugggugaauucauuauacaaauuugugucugaauucucagaggacccaggcaucuagauggaagaagagcuaaaucugucagaauuucuaaguucuggacuccuagcuugagaacaaugacauagucucaugcuuccagcagacauuucuuuggccuccugcuuuaagaacaccuaugugaaagcuacuuguuucauagagaacccagagcacagguggggugguucagaagugaugcuaucagcuauguaaauaggugcaugacauauuuugguugcuuucggaaauuguaggaccauugaacagauacuaaaugcuuaguaauaaguacagagugcucuaggauuucuugcucuuuugaacacauguuuuauaguuggggaagauaggacauauuuauauguaaaauauuaaauaacagccugugaugcuaacacauagauuaaaagauaccaugugcagaaugguguagacagacuuuuagggagcaaauucugucuauaccauucuccuugaggagaaccaaaaaaaaagggaagcuauagugguauggaaaaacuucaaaaagcagguaggaauuaaaguugacaaauacuuaugggucccuaccauacauguugugccauucuagauacugcagaugugugguagaagagaucauccucauuuaugccaucucugcauaguguaccuacugcuaugguguugcugcauuauuuauugcauguccucauugccuuuguauccucuguaccucgcauaugacaagcacucaguaaaucuugaaugcaugaugaacaagaagcagucucauauaaucuaguaggauaaguacacaaaugauuuuacuauguaguagaauaagaaguucgagguuauuuggauguuucagaugagauagggcacauucaggaugguacggcuguagacuauuuggauauuucaaagacaggaguaaucagguaucuuggaaaaugauuaggaaaagaauuuacugaugagauuauauuugagauuagcauugaacagacugugaguaaaguuguuuuagcagugggaauaacauccacagcaugggauagauuuaggaauggccuacuuuaucaagacaggagacaccuguuaggcuguuauauugauuucagcaagaaguacagucuucacauuucugagagauuuauuucaagaucauugcuacuuuuaaaguucaagaacacagcuauagaauaacauuuuccaccauaaaacauccuuuuugugugugugaaaaccaucacuugauuagacuaucuuauuuuaucuucacuuuugguaccaccuguuggcuuucuuuucauaaguaugacacacgcacacacacacacacagagcuaauauuuauugaauauuaucuacuguguaucagaugcgauuuuaaguauuuaugugaauuaacucauuuaaccuucacagcagcuccacaagaguuuaaggaauuuguucaagguuacacagauuguaaguaguagaaccaggauuauauuacuuuguaagaguaacuaugugaacaugagcugaaaacaucaguuucuuugauaccugaaugccaugacccuagaaagccauuuguacauaguagaaacuaccaguguuaaauccacaggugccaagaaucuguugaauuaagacauugugauagaauguauucauucuaauaauuauguauuuauugggugccuacaaugaaugagguauuauuucaagauauagauaagaauauagcaaauaacaaauguccuguuuuuauggagagagagagagagaauguuaguaauacugcaguaguccaggcaaaaaaaaaugggaugacuuggacuaguggagguguugagaagugaucagauuugguacauuuuguagauagagcuaacaggacuugaugauguaggagugaaagaaagggaucaagaaugauuucuaagguuuccgaccugcaaaccuuugugaaugagugccacuaaucuagagcagaaauuuagguugaggaaguguagaguguacuugggagauccacacagcuauuccacagguaaagauucuguggcacuccucuaaagauccagccagauguugagacucucagcugauucgagcacagcagccacuucucauaguuguggaagccacuuagcuccauccauguuucuugucuuauacauucuuagcaccuagaaggcaaagccuguuccuccgccagguguauaacuuguccucauuuucauauaucucgucauucucucagacugaacuauuguaacauuuauacccaccugacuccccaccacugccaccaccaaacaccuggcugagucucauauguuauuuaauucauauacuaucuucugucuccuccaggaaaauuuuucugcuuccagacucacucuauucccaagucugaguuaguguggucccuccuacaagcagucaagcacgcuaugucuacugcauguaaacaccuuggucauagcacuuauuuauuuuuaaguagucuuuuauaucucuagaacaagagaagggaaaguauucuugcugaggaguuagauaugaguaguaaaggacagauuugaggaaaggaauagagaaagaagaaagaagauuauaaaucagauauguaguguguaaacagaguaaaaugcuuguuaagguuagaaaacaucuuugggucuugacagaauuuuaauacucuagaacagugguucucaacccugacugcacccauggaaacaccuggggaauuuuuaaaauuccacugccaugauugcccaaaaucacaauugcuggagaggagaccuagacauuaaaguucccuggaugaugcaaacauuauuaacuaccauuaaaaaauggaaaaugauauugguugcaaaaaaggcauugaaauaggagucaagaaauuggaucauugucuuuaaugccucauuacuugugaucuugagcaagucacuuaaugccuagugugaauucuuuaucuguaaccuacuuggauaaucucuggagucuuuucuauucuaaaauacuuugaauuuaaugaagaaaauugcauaaggaaauaauuuuacaggaaucauuaaccagcuaagugcaagacagguugaagguaagaagccauugagauaaagcaccauuuauguuguccuuuuuaguaugggcaugccagugaguuccuagaggaagcuggcugcuuugcaaauggaaaaggggacacuuuaaggcaucaguuaaggacuacucucuccugccccuauaaagauuuuaggggacuuuauuuaaguaugaauauucagggauuugguugcuaugauuuuauuuuuucauguaacuuaauauuuuuuauuucuagcaaaaaauugaauaaagaaugacguauuuugccauaaguguuuaagugaugugcuguuaaucaguuugugcaguggaaauaauuaauggaauaauuucuuagaucauauucuuuaaggguuucugaaaaaugaucaauaaggaauuugacuaacacccugccagauaagagguaggaaucuauuuagaauguguucguauaguccuccuaauauuguguuguuauuaucaauuguuagauugaaagaaaaauuugacucaaaauuauaaccuuuuaaacuuuuuuuaaaauuuguuuuuauucuuuguaaaaaggugauaaccuuuuuuauaagaugauuauaagaaggaauugagaggaaguaguauagugcuuuguugauaagugcccaauaaauuuuaauuuuacuguccuuccagucaccugcucauauacaagcucauuuauacauauuuauauuuuugccuguuuuaguuuuuuuaugccaagaaaaacuccuugaguucuucccauuuuucuuuuuuuuucuuuuuuucagcuguauguccuauucuuggcauaauauuuuagagaugauuuuucugugauuguuucuaauuauacuagugagagauuagauuuuuuuccccuugacccuauucaguuguguuaguuugacucaagcaacucaaaguuaaugacuuaguauauuuaguuuccaaaaaacaaaucuuuauauauaccuuuccagugccauucuuuauguuuuaaagaaauucaguuuuuaaaauaaauuuaaaguaacaauuauuaaguauucagggguugaugauccaauuugaagugauauauucuuuuuugaucuuuuuauacuacuucaacaaaauuaaacuuagacuuuuugaauuuauuagcuguuuuugugaagauuaauuuuagaaagcuaaaauuaaacacugaaaguaaguuacuuuauuccauacggucucuguccaguuuuagcacuaaaaucaguucaaggaugccaaucccuaauuggccaaauagccuuaccauucuuguuuucuucuccaaauuuguuuuuuugcuggucagauaacuuccaauuucuaaaauauuccugaaaugauaaauuuuuaugauacagcauagaauaauauguauguggagacuugaaggagucaaaucucaaugagccuuuuguagggcuuaacgauuguuaaaagggggccaaaagggcacuaauuuuuggaaaguguauguuuguuuaugguggugaauguguagagagggugaaaaguaaaggaaaaguagaacaagaagaaagaaaacugauagguaugacgaugagagagaaagaaaauggaagagagcaagacguggagauuuagaaaaaagguugagggaaacauauucaaaagggaaaaagaaagcagggggaaaauacauuagagguguugaaauuaguaggcacucacagaggugcuaaucgagaguucuguugggcucc

SEQ ID NO: 16397 - RNA, 1426 nt, Homo sapiens
gaaucugacugauugccuagguagaaauguccuuuucgguggccucagugauacauugauacuguuuauggucauuuacaguaaagaaaauauguccugcaaagagacagaccaccagaauauuuaguucuauggcaaauaccuuauuugaggagcucaugagcuucaugaccagucacuucuggagagugcaggaguucagagugucccagccccuuuugcucuucaguguuucaaaauacauguguggagaagcuguuuucuugcaaagaaguuaugaucucuggauugucaugccaucauuggcacacaacuccccucuggaagaggagcuguuugccagaaauauuuucucagugugauuuauggcauuccaccuggcucucuccaucagucucuacuagcagagccacucccaaaugacccagagccauccuuuccacuccaauggagaggcuuccagaacaugcugcaguuggguccuuggcauugacuugcaacugaagcuccucaggaguugguaggaggaaguagagggacuggugccuguagcuccuggcuuuccucucugaccaacgcauagcgccuggcuuuucuagggucgggcucuggcgucuccucugcccaucuccccacacggcgcacaccuuuggccaccuugggugcguuccugcaaggauuguggucauagaugaccagcuucagacuugacaggugcgccaggcuggggaaguaacggaugcuguuccaguccacaucaaucaccuccaggaagggcaugugaagcagcacagugggaaagucaguuagccgguugcccgagagccagaugguccucagcuccuggaggcgccggagcuggccuggcagcaaacgcagggcguuggagccggcaugcagagucuuaaggagacucagcucacagaccacauccggcagcugggugaggcaguuggccucgauccacaggguccugagguucuggagcaggcucagcucacuggggaggucgcagaguuuguuguugcccagguagaggaugcagagcuguuucaaggugcacaccaccuggggcagagccuugaaguuguugaaauccaaggccagaaucugcagguucuguagcugccccagcuccggaggcaggcuauugaggugguugucgcucagguagagcuugaccagcucccugaaggagcacacgugcagggggaagcggcguaacuggcucccacucagauccaccaucuuguccagcggcaucucacggaggucccugaccacauaguucuggcaacggucagcagggaugaaggccacgagggcccugaugguguuccccaugcggaggcugggggcauggcgagccccagaggacagacucacugagcggggcuggcucagcugacugcucuggggccuaucc

SEQ ID NO: 16398 - RNA, 583 nt, Homo sapiens
guguuuuucggacccagacuuuuuuuuuuccuguuugauuuaucucucuauuauuggagauuuuacuuuuucuuccugguuugcacaugcuggucuuaucaagagagaaguacuucugucccauguucaccacuuccauagaaacaauucucuccaaucuuucuaauaugagaaaagcuggaagacagaaaugaaaaaaacaauuuaaauuggaauaaagauuuuuguuuuuuuuaaaagcgcacauccacuucagcugacaagaugauuccugaagaaaucagaacagacaaagaagcaagacagagagaauagguaagcuaguauuaagugaaagguugacagggaagucaguucucuucggagcaaagcacacccuggcagagaugagcgggcguuuaacucuccaaguccacacccaguggagugcgucacccaggcucuuaccuuucguagcugaagaacgccuugugcaaugaccugugccacagccagcuaaugacaugcagcaucaggcaucugagaaauaauuaacugccugcccuucauuuucagccuacaauuagacaacuguggcugcaau

SEQ ID NO: 16399 - RNA, 22492 nt, Homo sapiens
ggacgugcugcggcguccuagcuggcuuacagggcggcggcgggguguguguccucuguuaagagugcuacucgcccgggguugaucugugcaugccacuccugggucagacggugaggucggcgucugcgaggacgcggcgguggaguagaagggcagccggagacaggcccggcgccccuuccgaggcuagacggccccagcuucgcggggaucauggcauugcugguggaccgagugcggggccacuggcgaaucgccgccgggcuccuguucaaccugcugguguccaucugcauuguguuccucaacaaauggauuuauguguaccacggcuuccccaacaugagccugacccuggugcacuucguggucaccuggcugggcuuguauaucugccagaagcuggacaucuuugcccccaaaagucugccgcccuccaggcuccuccuccuggcccucagcuucuguggcuuuguggucuucacuaaccuuucucugcagaacaacaccauaggcaccuaucagcuggccaaggccaugaccacgccggugaucauagccauccagaccuucugcuaccagaaaaccuucuccaccagaauccagcucacgcuggugaguagcuucagcuucccaaggcgccgcucucccgacccaccuccugcacuggccccgggaaauucgaacgcacacuggucuuucccuucaucuugaaauccacaaaugagucaucugugggcaugugaacuuuuaggcuuauuuuagggagggggaaaaggccaucuugucagcccagaagagugggcaugugugaauuuuaguagcugccauuugauggaaaucguuaaaugcugugaucgauaagaaaaaaagcuguauugggugguacaguccaguguuaucagaauaucugcaaaagcucaaacaaaaacagccuuucucccccaggggaaucaaaucguguaugauaaaacgugaaaagauguagcauaaaguaggucucaaaacgucugcagcaccauacuuuagagcugucugcaucuuuaaauaaaaggagguggacucaauuuuagcacuuaguaacuuauuuaaggucuuuuucuuuuuuuuuuuuuucuuuuugagacggaauuucacucuuguugcccaggcuggagugcaauggcacgaucucggcucaccgcaaccuccgccucccggguuuaagcgauucuccugccucagccucccgaguagcugggauuacaggcaugcgccaccacgcccggcuaauuuuguauuuuuaguaaagacgggguuucuccauguuaaucaggcuggucucgaacucugaccucaggugaucugcccgccuuggccuccgaaagcgcugggguuacaguggugagccaccgugccuggccuuauauuuaaggucuuuaugcuuuuauuguuuuauauuuaugcuuaugcuguuuagacacuaguuuggggauccauuuacucaccuuuguauucaugugguauuuucuugcaaagugcaauauauuuaccacaaauuuagaauggaauuaaaugugaauaucaauauagauuugucauauuucacguuuaggaaauaggauuaacaacuaguuuucccaagucaaaacagaaaacauuuauacagguucauuguuucccaguuauguguuuaucauuagccuuguaagacauugugaaaggaauacuaaauuuuugucucuugaauuuaaucugaacaacauuuaccucuuuuucguuacagauuccuauaacuuuagguguaauccuaaauucuuauuacgaugugaaguuuaauuuccuuggaaugguguuugcugcucuugguguuuuaguuacaucccuuuaucaagugguugguaauuuuuuuuucuuuaugugccuuuuuagcagauuucauaaauuuugaagcuguauuccaagguuuagaaaauacaguauagagacaauagacuguugggaagaaagcauaauugcauaaguugucugacucaaggugaagagaagaaaggagacagagaaacuugggugugugaugcucaccaaauaccuaccuguuuguaaguguauaauauccaugcuuaacagucucagcuuggggugaaguuauuuucugggaaaucuuuacaaaauaccuaguaagacuuuuuacuuccuaaguuuguuauguuuucuguuuacucuuuacuuuuaacauuguugugaaggagugaguauacuuccagaaaucugaacaguaaugaaaaauuucagauuuuuagauguuuuugccucaaaaauuauacugcuguuacaacuuguuuauuggcuuuuaauaaugugucuaauauagauuauuacaauauuauacucuauauuaauaaauauagaguaauuuauauuaaugaauauuuuuccauuugugcaagcgcagugccuugccuauagcagauauucauuaaaaauauguucauggauucacuuacuucauuaccauaaaauccuaacaaguaugguuuuugauucuuauuuaguggagaaaaaauaacuugcuguaggggacagugaaacgguauucucucuauacugaaaaccuuggucuggaaauucugggugugccugcauggggaaucaaagccaaaauguguaaccaauuuuauuuuuuucacaaacauccacugguuauuaaacuaaggcauucuuguuugaaauuuuaggaguucaguaauagagcccuggcaucuuaaacauucuaguagugaucaugucagagacaguauuugaaaauauucugcagugaaauacauuuucuaguggcagagaagcaguuuaaauaaaagaagaggcuagugaacauuccuauucaucuuucuuguuaaaugcacuuguuuuugccuaguauaggcaauuuauuaaacagagcaaguaauuguacuccuuauacguaauagauucagaguacucaccaucucugucacuaugaccauuuuuguucacacaagucucaaaauugcuauagauuagaaucaaaggauucuauaucccuaagguagauauuugacaugagauugaccaaggaaugauuguagauuaauggacaguuucuuaucaguaagugguaaagguaccauuacaaaauagguauauucccaaaacauuccucuuaaagaaaguuguaucugcccacaguaucuugggauaauuucuauguuguuucucuuauacugcuggagacauuaaaaggaguuaaaagacaagugaccagcuauuagcuugaguuguagaaagaugguugacucauucauucguucagcagacaucuuuucugcauuauguucacccuugaggauacaaagaugaaaagcagcuacaguccagcaguguagaaacacaaagagacagcuggucacaguagcauauguaccccaagguaggaggaaaauucugaggaacaccaaggaggaaguggcagcucuuaaagaggggcggugagguaagacuuuacggaaaaguuaacaauuuaaauugaagggcacacagaaaugagcucagcagggaaggacagcuggucuuuuccuugcagugugugugaaagucuggagcauuuuuggagaacuugauuuguuuggugaggcuaggcaguaggugcauugugagaagacaaggcugaggagugggugauaccagaugucagggucgugaagccaugcuaaggaaguauaucuuuauugagcacgcaccaggagaggaguucagacagggacugacuugaucauuccccugucuuuagaaaaguaacugauggcaaugaaggguggguaagagggaaggaaggguaaaaggcagagcagucaggaaccuaccuguacuucacaggacaggcaggaagggccugggcuagggcggugggaauggacagggaaagguuaaaaggcacuccaggggcguuuuggggaacauaggagaaccugacugaaugugagagagaggaaaguaaggcucugaucccugagggagauuauaucaucaauuauuggaaacacacaagaggagcccauuuguagaaaaaaggcaccaguugauuuuaaacaaguuccugcagauuauauaaguagagauggccaggagacuggccaauauaagguuaaggaugcucaagcgaugagggaagagcaguagaucucagcaaauaguaaaagacaucagucagggcgaugaaagaggaaggcaggcaucugccuuaaaaacuguuaagugcaggaggcagugagggaggaguacaaaccagaggguaguucuuccaagcaaaacuugcagguucugcaaagagggcucgcaggaagggccacagggagucuggacauguccauggagaucauagugcccuuaggagagcauuagaggggugguggcaggagccaggcugugcugcauugagggacaguggaggccugagagccccugcuguuccaggcaguccuguggcgaagacacgcggcugccugaagaggcugcaaaaggaaaggcaggugagcacacacccucuguauccguuuuugcuugcugcugugccccaaggagcaggcagcagaagaaucaguucuuuguccuucauauucacagaggacucuuaguuaaagcuggcaggaguaugguucaaauucccugcucuucuauuuuugucuugauggauuucuauagacuuagaguuuauguaacaagauacccagaccuacaggaacaagaaguauguagaagucauucaaaagccuagcuguucuugccagaucugauccaaacaguccuguuaaaucuucuucaaagccuuuuuuucaguuauauuugugaaguauuuuguggacgaaugggauuugaggucuugagauguuguuucuacugaaugguaugguauuuuaggguuagugauuauccaguguaucuagguguauuggugggggaugaggaauaguauccacagaaaagucauccagagagaggaaaaucucuucuaccauugauuggguuuuccaaagcaacugacgagaccacauaccuuuucaagccacacacauuggcaaccaucucuaaccugcccccaugccccauugucaucguguccccccaaccucugucuuuguuuuuuuuuuuuuuuagacagagucucacucuaucacugaggcuggagugcaguggcgcgaucucagcucacugcaaccuccgccuccuugguucaagcgauucuccugcucagcgucccgaguagcugggaccacaggcgcccgccaccacgcccagcuaauuguauuuuuaguagagauaggguuucaccauguuggccaggcuggucucggacuccugaccucagguuaucugccugccuuggccucccaaaguacugggauuacaggugucagccacugcuccuggccccggucuuccauuuuuuaaauuuugccauuuuuagaaagaaaugaaguccaacacugcaucuguauuccuaaucaccugaauuucuauuucucccuuauuuucccaagaucuuuuauccuuguaggcccuuauaugcauuuauuuuucccuauuuacuaggaucagguagaaggaaauagaggacuuuucuccuccuucuaagaauugagaagaagcuagauuaucagaaauuaaauuuauagagcuauuuucauccauggugcuuaaagggcauucauauagcuuacuggucuuugaaaucuuguagaauaauuagacauuuuaucuuccccuagucuauaccccacauucccaucuuugugacucuaguugucgcaucuuugauuaugugauacuauuucuuuugugccagacauguuuuaucuccuaauuuucaguggguaggagccaaacagcaugaauuacaagugaacucaaugcagcugcuguacuaccaggcuccgaugucaucugccauguugcugguugcugugcccuucuuugagccaguguuuggagaaggaggaauauuuggucccuggucaguuucugcuuugguaaguucuaauuguuuugauaucuaagaaacaguauaauaauaacuccuccauuauuaauguaauuuuuaguuuucagagcacuauguccgauccauucucacauuuaucgucauaaucaccauaaaaggagguaagguaaggauucuuuuucagaugaagaaauugagguacacaaaggugaagggacuugccuagagugaggcagcuacucaguggcaaaagcagaacuacaauuaaugucuuccgaugccugguuacuguucugaccaugucaagcuagagcccacaaauaauuuggacauuuagauuaaguuaaauuuuuuuacaaugaaaacauagcuuuauaaucacuauuucgauuuugaacauacguaaaaauauaaagaaagugaaggggccaggcacaguggcucacuccuguaaucccagcacuuugggaggaugagcugggcagaucguuugagcccaggaguuuuagaccagccugggcaacauaggaagaccucaucucuacaaaaaauuaagaaaugggcagggugugguggcucaugccuguaauccugggaauuugggaggcugaggcggguggaucacuugucaggaguucaagaccagccuggccaacauggcgaaacccauucucuacuaaaaauacaaaaaaauuagcugaggcugggugcgguggcucaugccuguaaucccagcacuuugggagaccaaggcaggcaaaucaccugaggucaggaguucaagaccagccuggccaacauggcaaaaccccgucucuacuaaaaauacaaaaauaagccaggcgugguggcacacaccuauaaucccagcuacucaaggaggcugaggcacaaaaaucacuugaacccgugagguggaggugcagugagcugggaucacaccugucucaaaaaaaaaaaaaaaaagaauuagcuaagugugauggcaugcuuccuguaaucccagcuacucaggaagcugaggcaugagauuugcuugaaccugggagguggagguugcaaugagccaagauugugccacugcacuccagccugggccacagagcaagacucugucucagaaaaaaaauaaauaaauaaaaaagccaggcaugguggcacaugccugcagucccagcuacuugggaggcuggggugggaggaucacuugagcccaggaggucgaggcugcagugagccaagauagcaccacugcauuucagccugggcaacagagugagacccugucucaaaaaaaaaaaccaaaccaaaacaacaacaacaaaagaaagugaagggccucuggaacccuaucacacuaagguaauuaccuuuaccauuuuggugaggaucauuucauggaucucuuuuguauaaacacauagguacacaugcauguguguauaauuuuagauauggaaugauaucauagaugcuguuuuuauugcagauuccuuuuccccagccuuccuagccacacacucuuccacauuccauuacccccuaaucuuccacauuccauuacccccuaauccgugccccuugaagucauguuaacuuucuaagugcuuguucuuccauauuuuucuccaugccguauauauccauacacacacacacacacacacacacaccccaauuaaacaucuauuucuuuucuuuuuuuugagauggagucucacucugucgcccaggcuggagugcaguggugcaauucuuggcucacugcaaacuccgccucccggguucaagcgguucuccugccucagacccuagcugggacuauaggcgcacaccaccacgcccagcuaauuuuuguauuuucaguagagaugggguuucaccaucuuggccaggauggucucaaucucuugaccucgugacccacccgccucggccucccaaagugcugggauuacagucaugagccaccguguccggccacaucuguuucuuugacaaaaguggaauccuauuacauaugcuuuucuguaucuugcuuuucugacuuaauaauaucuccuaaaaaucucuccaaagcauucuuuccagggucuauuuuguuguuguuguuguuuuuguuuuguuuuguuuuguuuugagucagagucucacucugucacccaggcuauagugcaguggcgugaucucuguucacugcaaccuccaccuccuggguucaagugauucuugugccucagccucccgaguagcuggaauuagaggugugcgccaccaugccuggcuaauuuuuuuguauuuuugauagagacaggguuucaccauguuggccaggcuggucuugaccuccugaccucaagugauccacccaccucggccucccaaagugcugggauuacaggcgugagccgccgcgcccagccggugucuguguaauagccccucugcauauucacuuuuuucccaguucuuuaccacuaugaacaauauugugauaaacauccuuguacaucauguguucucauguacugauaacuuuuuuccuauggaaaugagucccaggaguggaauuggcaaaucaagggcauauguauuuuggggacuuuuauuuuuuagagacagugucuggcuauguugcccaggcuggccucaagcuccugagcucaagugauccccccaaccucagccucccaagcagcuaggacuaaugcguuggggacauuuuaaguuagaauguauaauccuccuaugucuuagucaguucaggcugcuauaacaaaacuacaauggacuggguggcuuaaacaacaaauacucauuucucacaguucugaagucuggaagucugagaacaggcugccaguaugguuggguucuuggugaaggcucuuuuccugcuuuauagauggcagucuucuugccauauccucaucugacaacaaggaagaggagaagcaagcucucuuguaucucuucuuaucauagggacuaaucccauucaugaaggcucugcccuuaugccauagucaccucccaaaggccccaccucccaauaccaucaccuugcgggugaggauuucaacauaggaauuuuggggggacacaaacauucaguccauaauaccuuacuuaucaggaauuccugcuucccacaagaguucccacaacucuuggaacacagucagugggaauaucuuuuuuguuggucgcaucaauuuaucaagcaccuauauagcccuuagucuguucccagcacuauucaaagcacuauguaaauauuaacuuauuuaaucuucauaacuuuauuagguugaugcuauacuaauacuauuuguauuaguccauuuuaugauguuauaaaagcauaccugagacuaauuuauaaagaaaagagguuuauuuuggcuuaugguucugcagacaguacaagaagcauuagugcuggcaucuacuucuagugagggccucaggaagcuuacagucaugguggaaggugaagggggagcaggcaugucacauggcgagagagggagcaagagagagaggggaggaaaugccagucucuuuuaaacagcuagcucucaugagaacuaauagagcaagaacucacucauuacccuggggagggcaccaagccauucaugagggauccagccccauaacccaaacaccuucuacuaggccucacuuccaacauuggugaucaaauuucaacaugagauuuggagggaacaaacauccaaacuauauuaccauuguuauuauuuuuacugaugaggaaaccgagagauaaagaguuaguaacuggcucgcaaucccacagcuaauaagcagaaacacaauuuggauacaugccuucuggguccaaagucuguguucuccagugcuccgcucugcuuccccuaaguagaccaguaguuauuucaaauuuauauauuuuaccauauacacuuuuuuucuaaaguagaggucauuggaccaucuaucagauaauauuuccacuuugcaaaaguccuagccauccugguuaucugguuucaaaccauugcagccuagagaccuuauacuacaaggagagaggauuuuuuucguagccuucuaacagguuuuaaaaugaggacagcagcagaaaagccauuaaaaaaaaaaaaaaaaaaaggcaaagaaaccaagaccacagcaggcugaggccauuuagugugaaggaaagucaucuucauuccuuaaugucccuaggaggcauccuugacucaaaguagaggauugugucaacucaacuuuuuuuuuuuuuuuccauaugaagccagcauuacccuaauaccaaaaccaggaaaggacacaaccaaaaaagaaaacuaaagaccaauauccuugaugaacauagaugcuaaaaucccuaacaaaauacuagcuaacugaaucuaaugacguaucaaaaagauaauccaccaugaucaaguggguuucauaccagggauguggggaugguuuaacauacaaaagucaauaaaugugauacacuauguaaacagaauuaaaaacaaaaaucacaugaucggccaggcgcaguggcucaccccuguaaucccagcaauuugggaggucagggcgggcggaucacgaagucaggagauugagacuagccgagaccauccuggcuaacacggugaaaccccgucucuacuaaaaauacaaaaacaaaauuagcugggcgugguggcuggugccuguagucucagcuacuugggacgcugaggcgggagaauggcgugaacccgcgaggcggagcuugcagugagccgagaucgugccacugcacuccagccugggcgacagagugagacuccaaauaaauaaauaaauaaauaauggcaugaucaucucaauagaugcagaaagagcauuugacaaaauucagcaucgcuuuaugauuaaaacccuuggcaaaaucggcauacaaaggacauaccuuaauuuaauaaaagccgucuaugacagacccucagccaacauaauacugaauggggaaaaguugaaagcauucccucugagaacuggaacaagacaaggaugcccacucuuaccacuccucuucaacguggaacuagcuucuuuauauucuucaaaguccguaacaaagacccuaacaaaguagaguaauuguguuuuuaaugaugugccaaguaucaaguuuaaguuuucuuuggaacuuaaacuucuuaauaguuuauaucaugaauaucauuuuaucuaaauucagaaacaaaaugauucuauaacuuuuuggauaaaauuaugggauagauuugaacagaacuuuguauguguauauagugguccaacccauuugucccccugugcccagccaaguuaucuauaaaaaggaauaauauuuuuacaacuacuuuguggauguaugugaaaauuaaauaagugaauacauguaaaacagaacaauuauuggugcauaauaaguguuauguaaguguaagcagugaucaucaugauuuuuauuauguccucaaguaguuucuaagcucuuugagggcaggaacuuuguacauacugcguuccucagaaggccuggccuaacuuuguagauauccaaugaaugcuuauugaguuaaauaagaauaaaaaugaggccaggugcaguggcucaggccuguaaucccagcacuuugggaggccaaggggugcagaucaccugaggucaggaguucgagaccagccuggccaacauggugaaaccccaucucuaccaaaaaauucaaaaaaaauuaggugggugugguggcaugggccuguaaucccagcuacuggggaggcugaggcagaagaaucacuugaaccugggaggcagaaguugcagugagucaagauugcaccacugcacucuagacuaggcgacagaaugagacuccaucucaaaaaaaaaaaaagaauaaaaaugagcaauuuaauagaaaaagaucucggccgggugcaguggcucacgccuguaaucccagcacuuugggaggccgagguggguggaucaugaggucaggaguucaagaccagccuggccaagauggugaaacccaucucuacuaaaaauacaaaaaauuagccgggcgcaguggcaggcgccuguagucccagcuacucaggagaaugaggaaggagaaucauuugaaucuggaggguggagguugcagugagcccagaucgugccacugcacuccagccugggugacagagugaaacuccgucucaaaaaaaaaagaaaaagaucucgaaggagguaugccgagauguuaaugugugggugguugggauuauaagaauuccuuauauucuuuuugcuuuucuuuauugucugauguacaauaauaauaaugcauauguauacuuuuucuuuagauuaauaagaaaaaugaaccuggaaauucacaaucacagaaaggauguuauugcaguauuuuucguugauucuuguggaaaaaauuacguuuuuucuaaacacgguucauucugcuuuuuuacuugcaauucuuacugucucccaaccccaaauucucuuucuuuuuuuuuuuuuuuuuuuuuuuuuuuuuugagauggagucuuacucugucgcccaggcuggagugcaguggcgugaucucggcucacugcaagcuccaccuuccagguucaugccauucuccugccucagccucccaaguagcugggacuacaggcgcccgccacugcgcccagcaaauuuuuuauauuuuuaguagagaugggguuucaccauggucucgaucuccugaccucgugauccgcccgccuuggccucccaaagugcugggauuacaggcgugagccaccgcgcccggcccucucuuucuaaucuuauuuauuaaugguugauauuugaauuuuuuaaaaugccgaaugaaauguaucuuugcuugaugauuaugauugcagugcuuugcauuaaugguucuuuugguuuauuuguagcuuauggugcugcuaucuggaguaauagcuuucauggugaacuuaucaauuuauuggaucauugggaacacuucaccugucacguauccuuuucauauaacuuagaaaugcaucgucuuuuauauuuuccaaaacuuuuacauucauuaccuuauuugaaucucacacuaacuauugcauggccuaaauugaguagagagaguuauuuuuagccuuuuacuguaucuuuacccacuaaaggauuuuaaagaaauaugaacugaaggggcaagugugguggcucacaccuguaaucccaacacuucaggaggccgaggcgggugaaucgcuuaaggccaggaguucaagaccagccuggauaacauggugaaaccccgucucuacaaaaaauauauaaauuagcuggguaagguggugcacgccuguaaucccagcuacucaggaggcugaggcacaagaauugcuugaacuggggagucggagguuacagugagcugagauugugccacuguacuccagccugggcaacagagcaagacucugucuuaaaaaaaaaaaaaaagaaauaugaacugaggaaguggguuagcuuuuugugucaugaauguuucugaauuuucuuauguaauaggugaccuuuucccuuacaaaaauuaacucagaguaccauuucuuacagacagugagauuaaauauuuuuugaaugaauagugagguggagguuuggauuuucaaacaauuuucagguauuucuaguaacaaaguagaggaaugguuaacaaauaacaaaagauaauuucaggccacuggcaucuggcuauggaguauguguuuguacuuauuuggauaugggugugccuguuuuucucaauauuauuucaagucaagaaaugaagucauuggccgggugccauggcucacgccuguaauuccaacacugugggaggccgaggcaggaggaucgcuugagcccaagaguucgagaccagccugggcaacauagggagaaccuaucucuaccaaaaaaagaaaaaauagaaaugaaguuauauguuaaaggucaaauucaacuguccauuuguaccauucugcuugucauccuguuucucuucacauuucacucugcccccacccuuaggcaaaugcaacaaaugaauuuccccaggaaguaaacaaguaggauauuugccaacuaucaauaaaaaacaacaacgauaaguuuuuuagaaaaccaauacuuaacaaauauuuauuuugugucagacacuguuagaaacauuuuguauguauuaguccauuuaauucucacagcagcucugugagguaaagucugucauuuuuguuuauagaaaaaauagaggcacagagagguuaaccaacucacuuaaggcacacagcugacaaaugggauguccagauuugaacccaugcagucuaguccccaaauuuguacaucauacuacccaaucaaggcauccaaauaugugcucugauuuaaaacauuaauuuauucaauaaguauuuauugaauacccacuaaaccagucauugauauaaaaauauuuauauacugaacaucuacugugugccaggcacaggggauacaguaaugaaccacauagacaaaagucuuugcucucacaggcuugaauucuggugaggaagacuagaaauagaaaacaauuaaauauuuauauacaguguuggauaguguuaacugccaaggaguaaaaauaaagcggggaagagaaugugaaaugucauagacagcauugaaguucuaggcagggcuagucaggaaggcaucagugggaagacgacauuugaguaaagaccugaaggaaaugcaguugcuccaugcagaucaggaggaaagaacauuccaggcagaggcaacagcaggugcgaggccguaaaaaaaccaaggaagccugugugguuagagcagguugagcaaaggagggaaugugguaggcugagaaguaacacagaacugaauugaguagggcguuuauguaaggacuauuaaacugaguaagaugggaagccauuagcauuuugagcagagaaguaacaugauuuuacauacauucuaauagaagcacucagugggccgggcacaauggcacaccugucauuccaacacuuuggaaggccaagacaggaggaucccuugagcccaggaguucgagaccagucugggcaacauaguaagacccugucucuacaaaaaguuuuuuaaaauaaaauaaaucauagaaucacucaggacuccuguguugagaauagacuuaagaaggauuucucaaccucugggcuguugacuuuuugggcuagacgguucuuagugcaggccuguuuaguacacuguaggauguuuucagcaggccugggcucuaccaccagaugccaguagcauacauacccuuugcccaguugugacaaccaaaaaugccuccaaagauugcccacaaagcagaaucacccaugguugagaacuacuggacugaaagaggcacaggaaacucaggagacugcuacgauauucuaauuuagaaguaauaguggcuaccaguaugauagcaguggauauaguaagaagugauuggauucuggaaauauuucuaagaagagccaacagguuuugcugccgaguuggauguggagaaagagaaaacaaggcugauuuacaugguuuuugaccugagcaccugguagaauggaguugccaucaacuaagauaggauacccagaaggagguuuggggcuggggaggaagauaaggugcucaguucggggaguauuuuguuguuguuguuuuugagacagggucuugcucugucacccaggcuggagugaaguggcgcgaucaugguucacugcaaccucaaacuguugggcucaagcauucuucccaccucagccuuccaaagugcugggauuacaggugugagccaccgugcccagccaggugcucaguuuuggauaaacaagucaggguucaaaggugacgucucagcaggaggcaucacagggagugagcaguaugaagcugugguuuaaagugaugagacuaguugagauuaccaagcagacaaguagaagaaaauaaguccaaagacugaguguuggguuugaguccaguauuuggaauucagagagaugagaaacuagguggaggaugagaaggagcagucagagguggaaggaaggaggagacuggcacagaaccagaggaaggaggaggaggcggggucggugucugugucagaugccgcuggcaggccaaguucaaggagacuggucaccauugagggacugagugagguggagggcacuggguuugaccagaacauucugccuggaguaaaguggguugggguuggggugacagccugccuggaguaaagugcagaacuggaaauaccacauguagacugcucuuuuguuguugcuuuuacaaaaggauucauaaauaguuucuuuaaauuugacuuccuucucguauaaauauacuuaaaagagaagcugaggaguaaagaaauuuaaaguguuagagccagugcacaugaagauagcucauaauugaaaauaaaacauuaugacuauugccaacaaccuugggaagauccucugugucucaggaagucaccuucaugggaucaagccaccauaugccccuggugacgcagccugugcucuccugaggcacugcugcugcccagcgggaaccuccaggcugcuuaggugggcuuggaggucagacagguccaggugugaacacugagcucugccacucucugugggccugacuagugugggaacucucagggucucacucugaucacuuaugaaauguaugaaguggaggaaguacgaucuaugauguugggugguuguauuugagagaaugugucaagcaccaagcagguguuuaugauacauaaguacugcuguugguaauguuauuauagcuagcacauauggugcuuacuauaugcuagaagcuuuguguauauuaacuuauuuaauccuuacaauaaccgugggagguaaaccccuuuuauauagugaggaaacuaaugcacagagugguggcuguuucuaguguuguaguuaggaaaagcacauaggcaaacaucauacaucugaagaacaagagaguacucauuuauauagaaaaaauaguuauauuuaaauauaaguaauugugugugugugugugugucugugucugugucugugucugugugauggaguuucgcucuuguugcccaggcuggagugcaauggugugaucucggcucacugcaaccuccgccucccagguucaagcgauucuccugccucagccucccgaguagccgguauuacaggcaugcaccaccacgcccggcuaauuuuguacuauuaguagagacaggguuucuccauguuggucaagcaggucucgaacuccugaccucaggugauccacgccccuuggccucccaaagugcugggauuaggauuagaggcgugagccaccgugccuggccacaaguaauuuuuaaaugguguguguguguauuuaguuugcuuuuuaaaugaacaaugauuuggaaaaaucuuaauccaguggcauguuacuggcaguauuuuggauuagaacgugggcuuucaaguuaaauagacccauucauguuuggacuccaccucugcuacuuaauagcucuguaaucuggggcauguuacuuaaaaucucugagccucuacaaccguaaauaggaagagugagccugcagugaagguaaacgugaugccuaacuucgacgauuucauguaaaucgcccagcaugauguuugguguauaguuggugcucaguauuacucccucucccccucccucuuuucccuccuuaacucaaguuagcucuuugguaccuuacauaucucacuucauuucccaaggaaacaccacuguaaaacauaauuauaaauugcuguacaaaauaccuucccuggaccuuguuugaaggucuuuccuuuuauauuguaucccuuuucuuuuuuggaggucaguaggaaugguugaggcagucuugugucucugaugaaucaaucgcuaaaaccuaccugaagaaacuaagaaguucccauuauucucuuuuuuuagacagucuuguucugucgccuggacuagagugcaguugugcauucuuggcucacugcaaccuccaccuccuggguuuaagugauucucaugccucaggcucccaaguagcugggauugaaggcaugugccaccacgcccagcuaauuuuuguauuuuuuguagagacaagguuucaccaugauggccaggcuggucucaaauucccagccucaagugauccaccaccucagcuucccaaagugcugggauuacaggcaugauccaccacgccuggucccauuguucuuuacaucugaugggcugcuuuuggguuguuuuaugcagugcgaguguguguguaaauauuaacaucuaucuuguuauuccuuuuuauccuuauccaaaaaccucagcuauaacauguucggacacuucaaguucugcauuacuuuauucggaggauauguuuuauuuaaggauccacuguccauuaaucaggcccuuggcauuuuauguacauuauuuggcauucucgccuauacccacuuuaagcucagugaacaggaaggaaguaggaguaaacuggcacaacguccuuaauuggguuuuuguggagaaaagaauguugucccaagaagauaaaaaauauuguuaagugugcaaguuauuaaaaaaaaaaaauugggccaggcacgguggcucacgccuguaaucccagcacuuugggaggccaaggccagcggaucacuugaggucaggaguucgagaccagccugaccaacauggagaaacccugucucaacuaauaauacaaaauuagccaggcgugguggcgcaugccuguaaucccagcuacucgggaggcugaggcaggagaaucacuugaacccgggaggcggcgguugcagugagccgagaucguaccauugcacuccagccugggcaacaagagcgaaacuccauuucaaaaaaaaaaaauuggugacagacucaaugauggaaugauuugucggaauuaacacaaagcagauuuuauucauauaaugacuuuuuuuuaagagucucuuuuuuaaaaaaacuuaauucucuaaaaccgaaaugguucaugcuucuuuuuaaaaaugauuguauaaaauguauggaaugguuagccuggugugguggugcacaccuguaaucccagcuacuugggagacugagacaugagaaucgcuugagccugggaggcggagguugcaaugagccaagaucguaccacugcacuccagccugggcgacagagcaagacacugucucucucucucucuccauauauauauguguguguguguauauauauauauauguguguguguguguguguauacauauauacacauauauacacacacacauacauauacauguguauauauauaccaucccauauauaugugggauauauauauauauauauauggauaugguuauauauaugggaugguuugguuggucccagcaaaguauaugaaaauuaaaguucugugauaaugacaaaggaauugcuguuacuguacugcaaauaugcuguggguucucgguguucaaacucuucuaaggaaggacacacaguagcucucugcuugcugauagaugguuucccagugugagauuuguuauuuugaucagaguauucaaaucagaauuuaaaucuaguguuucuauuuuaguuuagcuuccugauuuauauaaaugaaaucucauuuauaaaguauaauaaagaugacuguaagacaaaauccaauucuaaaaguaugauuuuuuucuaguagaaaauugauguaagaaaucauacauuauucauacauuuauaggucaucucuuugaguuuucagugaacuauagaaacuauauggaguuaaaaaacaaaacggcagccaaucucaguggcucacaccuguaaucccagcacuuuggaagguugaggcaggcagaucaccugagguugggaguucaagaccagucugaccaacauggaggaaucccgucucuacuaaaaauacaaaauuagccaggcaugguggcacaugccuguaaucccagcugcucgggaggcugaggcaggagaaucgcuugaacccaggaggcagagguuguggugagccgagaucaugccauugcucuccagccugggcaacaagagugaaacuccaucucaaaaaaaaaaaaaaaaaauagcccuauguuuaaauggcucaaagaaaagacuauaaauggaauugaacauguuuguuagcuguuugagcauuuuauauugguaaauuuuuuauuuucuuauuuuuugucuuacagucgaccaggcuggaaugcaguggcacaaucauggcucacugcagccucagccuccugggcucaagcaauccuccugccucaaccuccccaguagcugggacuacaggugcacaccaacauaccuggcugauuuuuauauuuuuuguagagacagaguuuugccauguugcucaggcugaucucaaacucuugagcucaagccaucugucugccucagccucucgaagugcugggauuacaggccugagccaccacaccuggccaguaauuucuuaauccuaccucccugcuucuauugccuagcccguacauuugaggcuuccauggagcuuucugugguacugaaacacuuggagugaacugcaaacuuggagugaacuacauccaaccuuucuaagguggcuggggaaaauucuuguacagcaaguugggacaaaauagccauauagaaacagccauauaagaucccaauauagaaaaauugggauauuagaggaaauacaugauuuccauuuauggagugcuacauguuugcaaaauguauuucugcuuuucaucuucuugacaucugaauauuaaaagcaguuguugauaauuucauauaauaaauugagacauaucauuacucuuguaauaauucauuuucuaaauguuauuuaucaacuuucauggagaaaacaacucuuaggagaacaaagaccagcccgggcaacauggcaaaacccugucugcaaaaaauacaaaaauuagccgggccuaguggcacgugccuguagcuccaucuacucaggaggcugaggugggaggauugcuugagcccagaagaugcagguugcagugagccgagaucaugccacugcacuucagccugggcgacagacuggacucugucucgggaaaaaaaaaaaaaaaaaaagggaagagcgacaaaauauaccuuuugauaagacaguaaauuuuauguuuuguguuuuuuaacacaauaaaaauauauauacacacauauaauauaccuuugggguuuuuaggauuuuuuuuuccuggacucugaaaugagaagccucgcugaaaaucuguuuuggagaauuccaguuugucagucagucucuuguguaauuaguacguguggcuuccuucuuuguuuuaaauauucuuugguucuucucauuuuacaaagauauauauuuuuugugcuaaggacagagcaauuaguuuuuaccagauaagccucggguauuauguuugucuaagaaacauucucuguguauguuuaaauuguaauuauuucccaaaagcugaggaaaauguuucagcacagugaggauuugacgucugcacugagaacagcugaguuuauuugugccauuuagaaauucguaacuguaggcugggcgcaguggcuuacgccuauaaucccagcacuuugagaggccaaggcggguggaucaccugaggucaggaguuugagaccagccuggccaacauggcgaaacacugucucuacuaaaaauacaaaaauuagcugggcaugguggcgggcgccuguaauuccagcuacucgggaggcugagacaggagaaucacuugaaccagggagucggagguugcagugagccgagacugcgccauugcacaccagccugggugacgagagugaaacucugucucaaaaaaagaaaaaaaaaaagaaauuuuuaaccguaaauagaacuuggggaggguguuauauaauauaugugucaguaggaaggcaguaagaagauuggaguaagacaggaugggguuacauguauauaaaugaauaaaauaaguacugcuaaaacuugagucugauaaacuuuuuugccccgaagauaaucaucccacugaaaagaaaacucuggggaaaauaugccagauacuaggaccaagcacggagacaaaccagauacagugcuuucaaagaaaacaugcuugcuguccuuuguuaccaguguaauuguaauuauuguuuauucuguguuaagugacugaauuucaauuuuuaccuuuu

SEQ ID NO: 16400 - RNA, 38032 nt, Homo sapiens
cgacaggccucuaggcgggaagcgcggagugcgccggcgcguagucggggacgccgggccgaggcuuugcuagggaacacuguuaucgccccgcccccucggagcuuuuucuccaguuaacugucggaguagcgggggcuccggcgccgggcgacaugccggugcgcuucaaggugaggcugggguccccgggccggaauguggcuggggggagccauggccggggagguguggagcgccgaggucacgcugcuuuucugcgcugcagcccucugcccggcggaagcugccagccccagggccugcucgaggggccccagaaucugcccgccgccucuuaaccuaguucccucuccgcucacucacauuugcaagcugcagugugucgaagagucagauggugcgagacacauuuacuuagggggacucaagaggaguggagaugggaggaggucccuuugcgaagagaacuaaaggcgacuucagauugggacaccuguggcccauuuagcuuagcauuuaacccccauuaccuuuaaaacuuuaguguauguggcuuuuaaaggcuugagaaauggguucuuaguaaagacagcguauaaagaaauacacguuuuucaucguugugcauucuuagcguauguuaaaaguuccagguagcugguagcugucagggacuagcacccugcaacuucacagguggccacagcgucccacaucuccugacucauuuaucuuaaaggcguguauucagaauggaaggggaguuugccuuuuguugacuuuaucaaauagcaaaagguccuaggcaugguacauaauauuguguacucggugaaaaccugcgauaaaucuagaaugaugagaauuuagauugucauuaguuauccgacaagaacucaugcuuuggaaucagauaaucagugaaaggguaaccucugagccuggaauuccugguagcaucugccucaagugguguuguggauuaaaggauauaacacgugugaacugcuuagcacagggcugggugaauauuagcucuuauuaaggagcucgucuguguuuaauuuucagucuuaagucucuuuugggagguucagaaauuauuuuucaccgaugucugcuuuaaaacaucauucauuaauuggacuguacucaaaaguguacuuugcauuacaggggcugagugaauaccagaggaacuuccuguggaaaaagucuuauuuguccgagucuuguaauuccuccguggggcgaaaguacccaugggcuggacuuagaucagaucaauuagguaaguugagcaggcuaauagccauucuaaccugggcuaaguuuauaacuugggccaagccguuauaacuugggcuaaguaaaccuugggcuaaguuuaccaaaugauauauuaaaaguucaguuggccugguugauuuauucauuuauuaaucaaguauuuauugaagguuuacuaugagccaggacuauucccagcagcuaguguggcaggccagguuucacuaauggaggccuccaucacaacuguuucgguacugacugagcgguuaaguuaaauauugaaagcuaaaaaaagccagugcccuuacacaaaggcugggaugucacaaaagcccaucaagaguauugccuaggccuuuccugggccauaaagcaugacaaaauaaggaauucuuaacaggauccguuuaggauuaaacaaguuuuacugggggucugaagaaacuccccaggccuccacaaauuuauuggcggucugaaggaacuccucaaaccuccaugauucagcaggagacaagauaaggguaaucagcccagcaccuagacccauuuagauuaaguaaauuuacugaugcuccagaagaaggucuucaggacucagaccuuaguuauagauuaaaagaaguuaaucacuuauauccuuagaugaaugcacacuuacacguagacauauagcuuagaagguauauaagcucugaaaaacuuuguaauuugggguucgucuggugauaauuugcaggccuucuucccguaacugguuauagaaauaaaaacucucuuucucccuaguuuaucugcaucucguuauuggccgagagaaauagcagccugacccucaguuuggucugggaacacuagggauauagcccugaaccaaagucccuuaacuguggagagaaacaguaagcaagucacucaauaauuaagggaauuucagguuuuuauauaaaauuguagggaagugugauacauaacaugcgggaggaguggauuggagggaaaaugcuuuagauuagaugguugggaaaggcucuuuuugaggaggugauauuugagcugagaccugaaagcugaggggacaaugcuggggaagagugcucccaaggucuugagaaauggaagcuuagggagaugaggucgcugccccagcuuuacagcuaguaaguggcagaaccaugauuugaaaucaagucuguuuugugcaaagcauguaauuucagaggucauguucuuguuaucacacaugccuccucccugugucccagggaaggcagaguccugggccagaguuucccggagggugauagaacagaagggagacagacugaccucauuauaccugcuuauuuaauucuuccuuacuaguauauuagaucucugagaguagggcucugucuuauucaccacccaguaccuaacacaggccuuggaacauucuauugcuucuugaaacuauuuuuugaaugaaugaauuagccuaaauuugaauuauaauagcugugugauguugggcaaauugagcuaguuucaccaagugagauuuuaggaagucuguugcauaggauuacugggaggguuuaaaugagauguugccuauuaagggccugguuugaguacacagaucagugcuuagugucccacaugugaugugugcgagcauggcauguaagucacauaaauguuagauguuugaagccaggaaaagacuuauggguaggguaccaagccuggaaaguuaguaagacgacgagguauuuucagaauuuggucuagagaacaaagggaagagugggcaagagugagugucucuuuuagaguuccucugaagcaucaugaucugacccagcggcaaacuucagagacugggugucccugcuucuccggcagggugcuaggaaaaucccucugcucauaauccucuuuuuacaaaugaccagaaauuccacauauuugaaccuccauuagauuaagaauccaaauaaaucucuguuuaagcauagauaucccacccugcugagcgccuacagggcuauuaugacacuggaaaauucauuaaacuggguaguuguccaauaacauuucagcuuagaucagcugcauuugaggggaaggugaugaaaugagaccaugagagcaaagccaccuuagagcaugguauauaaugaaggaaggaauggacuaggggaggaacguuaguggggaauuuuaggucauggggagggacugagcaagaauuccagaaugcucagaaugggaggugggagguuagcaaaaaacaacagcaguguuaccgaggauggcugucccuucuuuuagaguaguguauuuuuacccuggggauuugcuggugcugggagacagcggcagaccacuugagaaucuucuuucauuuugugcuucuaccaaaaaccugccucuguguuaaagcagagaggagucuaauuggugaucuucaagcuuuuuugcuuuuauacuuccuagaaaaauuuagaaaaacauugugcuucgucacacauuucuaaauugcuauuuuuuauaauaaauuuuuaugaauaguuuugaaugauagaauuucugguauauugcauagugcuuauauauuuuacauauauuuuguaaaaacucuggaguugccaauuuagcccauucaauuuuuggaaaauguuuaucauacaauuggcaaagucaguauucauuggcaaacuaaccggccaaauuagaauuauuuucugugagaaagucuguuuaucuuuaauuaagguaaauguguuauaugcauauguacauuucacaugacaucccucucauaucugaauuuuaauacugagaagguagauggaaaauccauggagcuauaugaaauaagaugcuguugcuuuguuauuucuaaucucugccugcuuuguuuugcugucaaauauucucccucagggauaugcuuucuugaauugucccuuuguuuggcucccuaccccugagguuuuguucuaccuugggcggacgcacuggaguaaguuucaggcugguuaagaggugugucuuucuucucuaaagugggaaaaaggagauuaugaaaggggcggugggaaauggaacugcagauggcagaugcagcucucaggcagauauaucagcaucaggcaagagagcacauguggaguugaggaucuggaaaaugauucccuuaagcugcccacuucuguuuacccuccuaaaacaucuuugugugccuccagacagauauccacccagugagaagaccuguggucuagggaagccuuuuaaaaggauaaggacccggggugacauggccaagacaucuacaacagaggcuaaggagcccuggguuuuaccucaugcccaauuuucuuuccaccuucccuuuccauucuggucuuaaucuuccuucugcacccugcaacugucuuaaagaauggcccuaaacuagggcagucucucaguggcugucauucugcagagcugcucuuaccuucauagaagguuaaguuuuuggacauuugcuuuccauacagaaauauagagaaauuguaucuuagcuguuguuaaaagggcuuauucuuuuuuaauucucaggaaaucaaggcagauguagaaccaagauccagcacagugacaucucaucccuucucaucuuggucugcuccacauaagagaagcuuugugaaaaguuccaaauuuugacaguaccagggcccauuguucuguuaaguagcacaggaaaguaauuagaaacgaggcagcauguacugccuggccugccaggucuaucacguugcaauucuagugacuuuuguuaggauaacuggaacauuuugugacccccugauuuuuaauuuuuuguuauggucaaauuuuuaaugcuuuuaaaagcaaaauuaaauauuuuauguugaaaagcuguacuuuuaaaauccuauaaucugaaggauauuguguguauauauagguacauauaucugaacuaaauuuaaaauuucauuucuccuccacaaguguucuuaaaaguugucuuuguaacuuuuugcuuuaguagcuacuauuuuuguauaccguguuuuguaggcaucacgaaagagccaaguuuuauuucaaaaagaagagucccuuaccaugacccacagauuucaaaaucucuggaguggaauggagcuaucucagagagcaaugugguugcaucaccagaaccagaagccccggaaacaccaaaaucacaagaagcagaacaaaaggauguuacucaagaaagaguucacucacuagaagcuuccaggguucccaaaagaaccagaucucacucugcagacuccagagcugaaggggcuucagauguggaaaauaaugaggguguaacaaaccauacaccaguuaaugaaaauguggaacuggaacauucuaccaagguucuuucagaaaauguagauaaugggguaggcauauucacugcauuucuuuucaaaagcauagaauucuucauugguuucauugucauuucuguaauauuacauuuuguguuucagaauuuuccauuguuguuuucuugucuaaugucuauaagaauaguugauaacaggcuguugacuuuaguuauugugaauuaguucuauucugacuacucgcuauuuuguaguaguuguacuaugauaaucuguuuauuggauggaccuccugcgucuggauuuuauucaucauauauuagcaccugaguccuaagggagagaucaaguugagacagagaagggaaguaggcccuuacuucuggcagggugcugagcugacuucuaccuagccccuuuucaguuucuuaucguguacaagaagacaaacagaaauucaauugaugaaaugcaaaaggaaggagagcucuggcugucucucagagaucuugcauuucugcucucuuaugucacagcuggccugcagcaggucccugugagcacauaagcagaggcugcaggaacuuguguggggaucucaaugcuuuccacauuucuuucuccauucuguuccacugcucuucucugguucauguccaccacugacugggacccugaagaggcauuucagaguguuggagaagaaucuguagcuuguugaaaaagcugggggugaaagggaacaaggaaggugaugugugagucuggcaggcaggagaagggguguucauagaagcagugugcaggugaggcaaagugcugggacuuuuugguaauagauuuaauuaugaaugauuaguaggaaaggacugagaguauuauauuuuuccugggaugccuaauaguccuuugauagaaaggaauuuuaaauaguuugacacuugaaaaaagauacuauuuauaaguugaagaaaguuugcuguaccacaaugcgcauguaguuaacaauuuugcacuguagauuuaacauuuuguuaagaggauagauuucauguuaugcauuuuuuaccacaauuuuuaaaaaguuugaauagaaauuuuuaaugucuuugaguggauuuuguuuuuugaacaguuggauagacuucugcguaagaaagcuggauugacuguuguuccuucauauaaugccuugagaaauucugaauaucaaaggcaguuuguuuggaagacuucuaaagaaacugcuccagcuuuugcagccaaucagguagcuuaauggauguaauacauuucugaguaccauuaucuuaucuaguaauguagauuuacauagaauuaagaguugaaagaaauuaaguacuuaaguagccuggagguagguucuagaaaaccaaaaugagaguuuugcuaaaaucauccuauuacuuaugauuuaugguaguaauauuauacuguccuaggcuucugaugaucauuguugccagaugcagcacauauacuaaauaugagacaggguaaugaaaacuuggggaacugguaaguuuuugcaugcuacaagauuuuuuuacuuauuaaaaaauuauuaaauugauuuuauucuaaaauguuguguuuuguugacuaauauauugcguguuuccuguauucuaagaaaggcguaacugcuuugaauauuuaauaaauacaaaauauguugacaguaacacaagauacguaauuuuguccuuguaucagacaaauaguaauaggcauugucaguauaacuauauuuguaaaauucaaaagcuguaaugaugugguauuagauuucauuauacuccugcacaauuuuaguauugagauaccauuacuaauagauagucuguuguuuuacuaccuucauccuuuagggaguucuuaggcuuuaaacucucauuuauguucuuaacaguacuucuaggcauagacaggaaauaccuccacuuggaauauccccagagaccuguaauggcuuagucuguuuuuucuucuggucuucguguuuuucuuuauaaauacacacacuuucacacacccucacauucauuuucuccuguacgucaacauucacuuguauauuuuguauagccguaagaacugacaggauaauuagauucagcaagacaauaacaucuagucaucuuacauuaagauagaaaaacaccagugauccuauaaauuguggcagcuuugggcuuaauuauuauucaauuuuuaaaauaccuuugaaauuuauauaacauuuuaagaaucugugaaguaacaaagugauaaauacccuuuauuaaccuaguaaauaggaucaguacuucuuuugcuugccuacagguuuuuuuggagauuaaguguaccuaaaacauuacuuacaaccugaaaauuguaauuauucaguuuuuuauagaguauuugaccuuuaaaauagagcugauucaaaucaaagcccuaucaucaucaaauagggcuuuuacaugucagugaaagcguuguguagaaacguuacuuuuauaagagaaaucacuagcgauauauucaguaguuuuacugcuuucuuuaauaaguguuucacauacuuuuuuuagaaggaaaugcucaugguuaguucaaagcauauugaauucagagucuauggauugaagagcuuugagacagcuuucaaugcuuguugauaggaaaccucuaaaaggguuguucauuucauuuuaucagacaccugcuuucugaaaggaugucuuauauuaauauguaaaggagucagaacaguuuuuggcaguaaaguccuugagguuauacuguacuaaaaaagauaaacuguuuagaucugaucuguaugaagauguacuauccagcauuacaaagcaguaauauaacuugacugaguuccccaucuuuuccauuugcuuuccuuguaaucagugguaauaugccgugaaauagaaaccauauugugaaguaguaaguauaaaaggaaauauuuaacaauagaaguguaguaauugcucagaacauuuucuuugccuuaauaaaauacgcugaaaauaagccaagggaagaaaagcuaaacaaauugaacauauuggguauucagaaaugugaagaauuuucuauuaaggcaggaagaaaaaaaaucaugucagggaggaagaaaaaaaccuguagaacugacaacagaguugccuuaaagcuaaugucuaugucauaugaaaauaugccaacguuuauuuugauuauaagcuauauuuugauuacaaaacuguuauucaaaacauaguaaugaguacauaaaguugaccuuuggauguuaauaauauaugugaaaugaaauuaaaaucauauauaacuuugcuauuuuuuuguccuguaauucaacuuuauguuuuguuaaguaauugaagaccaaaguuccgcauauuuaaucaacaaaacuaaacuaaaauaauuuuuguuuuaagguuuuccacaauaaaagccaguuuguuccaccauucaaagguaacucagucauccaugaaacugaauacaaaagaaauuucaaggguuuaucuccagugaaagaaccaaaauuaagaaaugauuugagagaaaacagaaaucuugaaacagugucuccugaaaggaagguauucaucaacuuuuaaccuuacaaaacaaaauccccguuauuuuagauucuccacguuuucguuuacuuacuaccaccugggaguuuuugguuuucacuaguucauuaauucauuuguucaucaaauguucauugagccagcuacuaggagcagacauggguugguacugagaauacaaggcuggcaaauagccccaagcagcucuugggcuaguggggagacagacauaaauaaaaaugauacagcaugaugaguacuuaacaauacaggaaguaagucuaauaaguuuaguaucaaagucaaguaaguuuaauaucaaaugacuggauuuacaguaaccuccagggguaacaguagugauagaaauacuuauuuuaaguuauggaaauuaaacacauacauacuuauauguauuuuauuuuuauuuauuuuuuucgagacagagucuuggucugucgcccaggcuggagugcaguggcacgaucucggcucacugcaaccucugccucccggauucaagcaauucuccugccucagccuccugaguagcugggacuacagaugcacgccaccaugcccggcuaauuuuuguauuuuuaguagagaugcggguuucacuguguuggccaggcuggucucgaacuacuagccucaggugauccgccuaccuuggccuccugaagugcugggauuacaggugugagccaccacacccggccaucacauguauuuuaaaccaaagcuuuagcaugccaaauuauagccaguauaauucacaugauuuaccucagaauauacaaacaacugcuucugugugauauuacagccauuuaauuugcagaaucaggcuaacaugauuauaaauuacagguaauugggguauaaauacuauuuuugaaucuccuggaauguugauacccgauacuuuaugguccuaaaaauagaaaguauguaauuacaaguaaauaugacuaaaaguaaaaugauguauacacacacacauauauuaggccuaugauauuauuggagaaaaaaagaauuguuauucaguaaagcgauuugguaacuaauucaucaggaucuuauguuuaauuacuguaacgcaauuguaaauuuagaauaucaaauucaguaugugguaacauuauuuagauauguauuuguuaacuuaaaaauuuucuuccuuagccaaagaucuaaaaucuuuauuguuagaaaaugaaacuauauccucagcuaaacuucaaaaauaacuaaccaaauauacuaaaaauuucaaaacuucuuuguugauuucuuaugguuuuuauuuucuuuaguaucuaaagcuucuaaaaauagaaaugucauuaaauauucaagucuaacuuuauaacaugcauguuuucacuuuaauguguaacaucuuaagcauaaaaagcuuaaaugauuuccauuucagaguaauaaaauagacgaucguuuaaaauuggaagcagagauggaauuaaaagacuuacaccagccuaaaaggaagcuuacuccuuggaaacaucaaaggcuuggguauguauuuuaauaggaaaauaugguauuucaaugauuaacauggugaaauauuuacuuucauuucauuucuauuaggaaggugaauuccgaauauagagcaaaauuucugagcccagcucaguauuuauauaaagcuggggcuuggacacauguaaagggaaacaugccaaaucaggugaguguacaugaccucaauaagccuacauguucuuucagccucuguuaacacuuuaauuucacaacgaguuccuuuugguaauagagaccacaauuuaaagaaguaugauauaauaauagcacuaauaguaucaggaacuuauguauuagaauguaaauuaucauuuuuuuuaaugccacuggcucuucagaaauuaauauuuauugaggucuuuuaaguuuaaugcuuuuuaccaucaaacauuugauuguguuaauagucaauuuauagaauuguaucauuauagauucgauuauuucauaaccuccagaccuccacugucucaacugaagauuaauuuucaagaugaaauaauuuaucugauagugaugcccauugucaauguguacuauuacaguuuguaggcaaaagaaaggugaaguuuguguuguuagaggugugagcuacaguuuugggguacucugacuugggagaaacucuggggaucugaagauagguuugaagggaaggguaauucuagaguugagaauugcuacuuuaguacuagcuucuuauacucaaaggauagagaauggaaccuuuuuguuauuguauuaauuagcaucuuucaaaucauaucuugacuuuuuuuugccuuuucugugagaacaagcuaaauuaaaauguuucuguuuagacauaaguaaacaucccacuucccccugucauuguaaacagaaggauaauuuggauggggaaugagucuuuuauuuagcucauuacuuaaaaccauggcccacaauuauauauaaucagccucugggggaaggggcuggugcucgggugcgcugagcugcugguucuuugagcugcagcucccagacauauguccuggcgacugccaugcugucugcauauuguuucaggaggucacuugauuccuuccaccguggccacucuuuugcuuucuuucuacuucucuauuugagcacggccugaagacagcacaggcaaaguaaaagacaaagcucaaagcugucccggauauuaucuggggcaauguucauauauucaccuuagugaaaucaaguuaaaacuaggagcaucgaaagcacccgugauggaagaaaggcagugagucagcuaaacucuugagcaguuuaugaccaucccaagucuuggcaaagaucucccugacugaggagucugauagugggagugaggaaaagcaggacagaggcagaacaguauguguggcugguaaauugaugucagccgcuggccuguuguguuuaggcgugacacuagguugagguuaugagaaacucuuuguuuugaagacuguguuuucucugagauuucuacgcuugaucucagccaaaaggccgagcagcgauuucuuuaaacuaagaugaguuuaggcaucagaacuaaacaucuaauugagaagauuguuaaaacugaagucauaguaagaugagauuccuuauccugccuugauggaagagaacauuguuguugucaauuuaagauagacuuuucaagguuuccuauuaugauaucuugguaaugcagcuuuuuuugcuuauuaaauacuauaauggugguuguaaauauuuaaauuagugguauaguuugccuuaauuucuuugagaaaaauaauucaaaaaguaaauugaaguuggaaaagaauaagaauuuuuagcuaagaagucagugaucauugaugauaacaguuuuaguugaccagguuauagacauuuaauaugagccauguuuuacuuauaucucuuggaagucauuuacuauaggcaucugauuaugagguuccuaaauauaagguacaguacuccuucauuuucccacuccuaacauuucaggaaggaguguauucacacuccucacaugcacucagacauaagugacuuuguuguuggaauauuaacucacuuuuugagucacauuaguuuucgaguccauauaucaucuuuauuucuuucuauguuugagauauacuuuuugaaucuguuuauagucuagucacuggaaauucuaugccaagucccaguuaccucucauagagcauuagggugguugguuuuauuugcccagugguuguguauuugucaucuccauuauaauaaccacuugacuauugcuuuuuaaaaugcucacuuaagggauuguuucuuaauagucagcaauuagaacuuuuuagguucuauccucagaauaacuacuuaaucuauguuaaacuucuuuuuuucuuaauuguuagguaaucuuuucaucaucgauugguugaggugauuuuauuccaaugugucuuccacaaauaggacuguguuucaagauaaaguccugcauuugagagauguccuguaauuugacagacauuguaaagacuagguauaaagugaccccucauuuuggggggaugguuuuuggguaaaaggaguuuuuauccccaguuucuugaguuugaauuuucugcauauguuuuaaauaauuuaguugaacucuuaauuuggacaaagaaauucagaaaaggaaacauucuacuuauaauuguaucauaauauauaauaugauaacauuacuuggcccagaaagguguguguauguuguugaguugggaaugguuuauuucuauccuuuuugguggcucuggcaguuggcuauagggauuguucuauuuaacauugaguucaugcuauugauuuuuuuccuccucuuuuuaguagaacauacuacuuuggaaaaugucagccuuuuaauuuuucaucuuaguuuagggcuaaagauauuuaaaaucauauuuguaaaauauaauauuagcacugagauuaauaaagauuguugauauaguaaauuuaaagcacuuaguuuuaaaugucaguaacaaauagaacugaauaaaucaaagucuucagaauuuuuaugaaguauacucucccccuccuuucuaaauaaaauugacgucaaauaaaacuggaugacuguguacauggaggguauucauccauccuuucauucaucaugcauggauagaugcagcugccucugcugucccuuccacccccacugccccgucaaucuacccaacacagugcaggacugauuggucccccuuuugaacuacuccuucaacuuacauuucauuucauuuguuuauuauggcauagacccccaucaauauuaugacaauuuauguacagguuggcucacugagugcagggaguuucuugcuuaucuuuggcugccauguuuagcucaggcauaccacuuagucugcacucaggacagguugugggcucagugcuuaagugcugcguuuucccucaccucaagaaguucauagguugauggaggaggagggcaugugcaauuaauuccaguaaaauugaauauguauuaauggggaugugcccaaagaacucugagaacacagaggaggaagugaugcugaggcauguaggugauggaguggcccugaaacauuugaagcaugggggcacuuacuggcaauaaaaucuggaguauaucgaggcacuuuauaacaagguuccugugcauucagaauacccugguuagaaguucaguagaguuaauucauguaccucacuucuaccuguuaaaugcaaaaaccacugcuagaaauuuucuuuaaagguauaggaguugauagaaaugauaaaugaacauagcuuuuuuuuuggcagugaagaaaauauuucaaauuauccuuuaggaacuuuuuucagguaugguucauuagaguaggacucuguugggauuauaugguuucuuaugccauauaggugcugucuuuugcuuuggccaauucccuagagauguaacacuuucaucuuugcauucaaaaucguaccuuguuaaggagcuauguuucuacaauugcuuuuacauugcuguuucauuauuugcuuuuuuuuuugcccugaaagaaaagcaauucuagaauaaagauuuucugucuugaugauuuaaaaaauuaguguuuuuugagauuaaauaaagauacugaacagaauuuuaaggguaaaacuugaacuuaauuuuuuuuacauuguggaauuguacuuggagaagccagcagguggcaguaugauguauaaagugaaagguuucaaauggguaugaaggcugcuuuuuucaucagaaaauguuacuugcauauuaaauaauucauaucacuuuauuauucagcagaacuuuuuuauccugucccuuuguugaacacauugcaauuaugauuuuaugggcuauuauuuuaaauuauauauuuaguacuuuuuuaaaaaaaaaaaaguugagauuuugcugauuccaagggaauauugaggaauuuggagagggaagccucauaaccucauucaucucccagugagggcuucuguagcaguaguagcuguauacaaagccaugaaauaaagcuggguuagggauuuuuggcguguaaguacucuuccagagguagggaaauaggaauaauaguuagauugccuaauuuaucugucaucagcagcauccuagccaugcaagaauguggcugguuuucaagauaauaauaagguaucuugguuacugaacuaauuacuaaaaaucccaagaaauauugauugacaaguuugguagauauuuagaagggagaauaauguguuucauugauucccauuaauauucaauuauggcauuaaccuaucauuaaguguguuucuguauuccuucucuaggguucucuaaaugccaugugguaugcugagguugguugcuuuugaguuuuuaaaaacuauaaucauagauuacuuguguaauuucaguuggaauaaaaaguaggugucaauauuuuucuuagcugcuaugaauuucucccugccugcuggucugaaauaaaauaacugcaucaugcuuuagcuugauuguuuuaguuuuugcuuaaaugcacagucugaugacuguauguggcuaauuuugccuuccuuugucuuuggucccuggcuguauuugugcaaugucuuugauaugcuacuuggugcuguuuguaaagaagcauuuacaauaguauaugaugucugaacucuccugaauagguuaaagaacuccgagaaaaggcugaguuuuauaggaagcgaguucaggggacgcauuuuucucgggaccaucugaaucagauuuuaucugauagcaacugcuguugggaugucuccucaaccacaagcucagaaggaaccguuaguagcaacaucagagcauuagaucuugcugggugagauauucuuuguggauggcaaaaaaaguuuguugaagcuuauguagaucauagaaugauauaggaaaaugaccugacuacucaaaaugugucuccuagucgaauggaauuguggcagccauuuauuucauuuuuauucucagugaaaaauaaagcaauguagauugcuuuauuuauguauaaauaacacauaauguaaaucuggaaggcuagauuuuuauaauauuuuuuguuggcaguuaauagcggaguagggaugauuacaugguagauguaaaaagaccuuuagaagguaaaaagaaagucaacaacaauaaaaaaguagagacugcaagcuauuaauacauagcuauuauucauuaauagauuuuguggcuaauucagaacuuggcugcugauuuuauggaagagcgcucugcuguucuggguuaaaaugaacaugauuuaauuaucuguaagugaaaguaauugaagaacuuagaccaugggguccuaguuuauguguguaaaugccaguuuagggcuagguaugacuugugucagcagauguacacaagcauaugugaagguaggaguaaaagaagauaaauacauuuuggaauauuuuaauagaaacuccagauuaugacuuucauuuauuuugcuauaaaacgaauuagauuuccuucuucaauaccugagcaaggcaauaucuauggaaaacauguaguugugaacaguagaaggaaaugauggacucacuaaaauugguguugauuagaaaagugcaaacuauucacauuuaaaauaaaauugauuuuguuacgcagagauccuacaagccauaagacuuugcagaaauguccuucuacagaaccagaagaaaaaggaaauaucguggaagaacagccccagaaaaauaccacggagaaauugggugugucagcucccaccauacccguuagaaggcggcuggcuugggauacagagaacacaagugaagacguacagaaacagcccggggagaaagaggaggaggacgacaaugaagaggaaggggacaggaaaacgggcaagcaggcuuuuaugggagagcaagagaaguuggauguacgugagaaaucuaaggcagauaagaugaaagaagggugagaguuuuaaauuacucaguauagagaagcguuauuuacaugguugauauguauuuugucacuaaauauagugguuuacucuuuugauuuuaugacuaauaaauugcagauuuuauuucaaugucacaaaggaggcacugcuguauggugaauaauuugauucacucagguauuuaagucacuagugauugguaauugaauacuugaauucuggccuacuuugggaggaaguaguuaggauuauuuucauuuacguccuauaauuuauggugugccagauuugcaaaugugucuggaagaaugacuuuaaagaaaaaaacugguguucuuuaauaucagaugauucuaccaaaaaagauaauguuuuauaauauuuuuuaaaaagugauuucugaaaauagcuaauuccuguuguuuuauguguaaauugcuuuggggaguggcucuucuccaccuaugauaauagugccuuuugucuauaaucuaaauccuuuauucauucauggauguuauggaacuugagccuugaugugaggaaggauucucugcugugccggugcugacuuggcagugauuuuccccauuauccaguauucagucacuuuuuucuuuguggguuguuuuucuucuauugauauaguugauauagcuuauauuauuuuuucaguguucuguuuuauuuuugaucuugugcuuaguucuauucauuauuggaaauuucagucgcuuuuaacugcauguggauuuggugguuauuuuuuucagaaacaaaauggccuucucuuacaaguuuuuuuuuuuuuuuuuugagacggaguuucgcucugucacccaggcuggagugcaguggcacgauaucggcucacugcaagcuccgccuucuggguucacgccauucucccgccucagccucccaaguagcugggacuacaggugcccgccaccacacccagcuaauuuuguuuuuguguuuuuaguagagaugggguuucaccauguuggccaggauggucucgaucuccugauccgcccgccucggccucccaaagugcugggauuacgggcgugagccaccgcgccuggccucuuacaaguuuuauacuuuauuauugcacaaugauggcaaaguauuuuuuaucauauuuucucgaggaaaugcuguauagauucauagauuguuucaauuuauaggucagauucuucuguauccucagaaaaaggaggccggcuuccuacucccaagcugagagaacuugguggaauccagaggacucaucaugaucucacuacuccagcuguugguaaucggcaaacaccgugcaguucuuauuuaaccugcuuuuucuacauguuaauuuaguguaauugaaacugucaucuuuauuuuuccagguggugcuguuuuagugucuccaucuaagaugaagccuccagccccagaacagaggaaaagaaugaccucucaggauuguuuagaaacuucaaagaaugauuuuacuaagguaaacauguuuuggggaaaaaagcaucucaucuaggacuaauuauuguagacacauguaauaaaugaaugauggguuaagauuuuagagaauuguggcuaucauaugaggagaugauacuguuaaccugcuuuuaguaaggcaaaaggcuugacuuuuuuucuguuagaagcauuacguuuuuguugauacacuuucaaccuugucaguagugacucaauaggaagauaaagaaagcaauacuuucauugagcaucugcugugugacaguuguauuccagcuauguuccaggcauuguuuuaagugcuggggauauagcagagaacaaacagacaaaaaucauagccaucauugaacuuacauucuaguggaggagggagacaauaaacaaaauaaccagguaaaauacauaguauuuuagauacugauuagugcuaaggagaaaaauaaagcugcugaagugaacaggaaguggccagggaaguccucggugcgagaguggcauuuaagcaggaucugaaaaagguaagggauugaccuguaugcggaucugggaaggucuaggugacaagaacaguaagugcagaucccucaggugaaggggguaccugcccccuugaggaacagcuagaaggucacuguugcuggaagagagagagagagaaugagagggagaguaguguugauaauggguucagagacauaauggggugcuaaauuguguagggcuuuguaaaucauagcaaagauuuugaauuuuuuucuguaugcaguggcaagcuauuggaaaggcagaggagugacaugauuuuauuuaguuuuuuuccaaggucuuucuggcugcuguguugagaauagguaguaguagagcaagagcuggggcauaaaaacaguugggagucacuuacucuauccaggcaggaggugaugguuguuuggaccuuggugguggcagugaaggucauauaaaguucaauucuggauacacauggaagguacagccaacaagauuugcugauggauaagaucuggggugggagaaagagaaaaaucaagggugacucaagauuuuuggccuuagcaauaaggauggagucgccauuuaacugaguuggagaagaucaagaauuccguucuggacacucuaaauuugagaagcuuauuagacauacaaguagacauguugaauagggaacugacuauauagguuuggaguguagaggagaaguugggcuauagguacagauuugaggcucuuuauagcuuaggugggucagguuuuuaaaguauugagacuggaggaaaucaucaaggggguggguguagacagagaagaauaguuguagacaggucuaaaccccaguuuuuugauauugggaaguugaggacuagucagcaaaggagacugaaggagagcagccagugagguggugacaaacgagacugguauccuggaggugucaaggaggagggagagucaaugcuacagauaggugaguaagauaggacaauugcuuaucagauuuagcaacguggaggucuuuggugaccuugauaaagggcaguuuugguggaaggaagggacaaaagccuaagugcaagugaauucaagagaaaaaagaggagaagaauuggagaaagcugccacagauaauucucugaaguuucuuuuccaagaagggaagcagaguaaugcaggaguaguugagagaagugagaacaagauggaagacacaacagcauguuuguauguugacaagaauaauuuuggagagagaaaaguugaugaugcaggagugaggggaaaguuguuggaaagaugcucuugaguaggagaaagggcuuaggaucugguggagauauggaaggguuggcuuuagacacugauuguuucuuuauuguuaaaagagggaaagcagaauucaugggcaggcacugcugaugaauguaggaagaugugauggcagcuuuuggaagaccucuucuuauugcuucuuggugacaugugaagaaagauccuuacugagaauaaggcuggggaagauguuggagauuugaggaaagugaaggcauagaguagucuucucagagagugggagagugagugggccaggggaaugugggauauuuuaggccaauguuaaggggccauuuuaaguugguggucacaaaguuggcagaagaccagucaggaaggguugugugcccuucuccaguaauguuuggcugcagaagugcaggauacuuuuaucagauagaguuggauuuaccuaggguuuugaauuugucaugagaauaagacaaagugagaaaaaggggaauggaguugagguauauaugaagaagggauuauaaugaguuggugagggaaggacacugggacuugagaagagugcagaggugauaggaucgguggauggauggucuagguaaaauaaaagacuuguuggaauuggggcaccuguggggauuaguuuuaaaguuaggaaaugguggucagaaauuuagguuauggagagguugcaguuaccaguaaugacaaggcuuaacuuaacaucauggguguaagugguuggaguagaauagagaacauucagagaaaagguugaaaaucuauagggaauuuugcugauggcuguuugugaauuugaguacaaaguaggaguuuucagggauugggaacaggugggagaugggaucagagcacccucuaccucuuaauccccagugcuuagaacagaguccagcucauagcacguaacagauugaaugaauguuauuggagugacagaauaucaaaacuauuuccuguugcuuauguauacacugguuuauuaaaggaaaugugacauuaggaauauggucagaggacucaugagaaucagaucuuaauggacuguuuuacuccuccuuagaaauccaggcugccaucuggaaggugugagcuuuuaggcaacuguauacacacagcugauucagccaaaacgagugacucauccauauuuguggcuggauuuauauguauuauuuucacuuacuguggaauuaauuuauugaauaaucuaaauagaguaauaucaucccuuagaauguuaaugccauucucugucucacugugaguacuauacacuuuuaacauuuuaauuaccaacuccucuaaaauaaguuucuggccuggugcgguagcucauguuuauaaucccagcacuuugggaggccaaggugggaggaucacaugaagccaggaguucaagaccagccuggccaacauggggaaaucuugucccuacuaaaaauacaaaaauuagcugggcgugguggcagaugccuguaaucccagccauuugggagauugaggcacaagaaucacuucaacccaggagguggagguuggagugagcugagaucacgccacugcacuccagccuggaagacagaggaagacucucuccaaaccaauaaauacauacauauguacauacguacacaaguuuauuauugacaacuugauuggauauccuuccaugugaauuuucugcgaccagcacuaccagggacuauaccaggagcuagcuagauuugguuauuucccagugucuaccccuugguuacugguaggcagaggagucacuaaacuuugauauacaccaucaguuuuuccccuuauauucucuuauaaaagcauugauaagaaauuacguuauuauuauguauaaaauuaaacccauaggucauucaauuuccaauaaauuaucaguaugucccaaaacuuuaggguagaauucucauauugguuugaucaucaggaaacauuuucaaaucuuuauauuaaaaacccaaguguggauuugcucacuucauucauuuagcagauuuacccacaugcuauggcaaugauaauggauagaaacagacaugguacauaaucuuaugaaaccugcagucugguaagggagauacauguuaaucacaccaaaaaagaaaugaaauuaaaacuaauaagaguuucaaaauaaaaguacuuagcacuauucuggaaggaauuguucuaaucauggagaucagaaaccuucuuggaagucaaugaugcuucuuugaaaaacucauaauugagcuaagauaaaggagaagaggaagcauuaaccaggaaaaaaggauggggagaaggagccuagcauaugccaagaucuuguggagagaaacaauguagaguuugaggaaacaaagaccaauacaguguguggcagggagccugguacaacaugaggcuggaaaacauggcaacauugggauuucuuucguuaucucaagagcaaugggaagccauugaaauauuuucaguaugggaauugugauggauauauguuuugcaagaucuguccggcugccauaggaggcaagaguaggcugugaaugcccuuaaaaggccauugcaguaguccacguaggagguguugguagcuuggaugaaggaggguaggaauagacagaaguggaugaaacugcacaauuauguaaggggaacaauguuaagguugaugcuggguuggauaauggaugagagacagggaugccugcuaaguuucuggcuugcccaacaagauugauggagguaccaugcacugagcaagagaacucuggacaaggagccucuuuggaggguaguuuuauuuucauucauucaauucaauauuuaauaggcucuuaccaagugccaggcacuguucuaggaucugaggauuuauugauaaucaggucaaaaucccugccuucaugaagcuuacauuuucauugggaggaauagacaauuuuuuaagaaaauaauuucacauaguaguaagcgcugugaauuaaauaagacuacaggucucuaagggauggguaagacagcuuuaguuugggccaucaggacaggcaccucuaaggagaugacguuuuagcugagaccugacugaugaggaaggugcccaugcagagaucuggggcagagauuguuuuccaauuagaaagaacaggggccgggcgcaguggcucaugccuguaauuccagcaguuugggaggccaaggcagguggaucacuugaggucaggaguucaacaucagccuggccaacacagugaaacccugucucuacuaaaauuacaaaaguuagcuggacaugguggcacacgccuauagucccagcuacuugggaggcugaggcaugagaauugccugaauccgggaggcggagguugcagugagcugagaucgcgccacugcacuccagccugggcgacagagugagacuccaucucaaaaaaaaaaaaaaaagaaggaacagcaagugcaaguguuuuucccuagggcaagaacccagagagauuaaaaguguggcuggagccuggagagggaaggggagagggcaggaaaugagauuagaaagggaggccgaguaaggaucuuagauguuauucuuuuuuuuuuuuuuaauuuaauuuuauauucacuuuuuuuuuuuuuugagacagggucuugcucuguugcccaggcuggaguauaguggugcgaucuuggcucacugcaaccucugccuuccaggcucaagcaguucucaugccucagccucccaaauagcugagacuauagccaccuguggccacaucugacuaauuuuuguauuuuuaguagagaugugguuuugccauguuggccaggcuggucuugaacuccuggccucaagugauccaccugcaucggccucccaaagugcugggauuacagguuacaaccaccacaucuggcccauuuuuugcuuuuugagacaaggucuugcuguguugcccaggccagagugcauuggugcaaucacggcucauuguagccccaaccuucugggcuuaggcaauccucccaccucagccuccugaguagcugggaccacagauaugugccaccaugccuggcuaauuuuuaaaaaaaauuuuuuguagaguuggggaucucgcuguguugccaggcuguucucaaacuccuggguucaagcaguccucccuucuuggccucccaaagugguaggaugauuacaggcuugagccacugugcccagccugaauuuuauuuuagauucagagcguuuauguccaaguuuguuacauugguauauuguguaaugcugggguuugggcuucuauugaacccaucacccaaauagugaacauuguacccaauagguagguuuucaacucuugcaccccucccucuucucccccuuuuguaguugcuggugucuguuuccaucuuuauguuguguguaccucuuguuuagcucccacuuauaaaugagaauaugcaguauuugacuuuauguuucuguguuaauucaauuagaauaauggccuccagcugcauccauguuguugcaguggacaugauuucauucuuucuuauggcugcgcaguauucuaugguguguauauguacuacauuuucuuuaucuaauccacuauugaugggcaccuaggcugauuccaugaguuugcuaaugugaauagugcuggaauaaaccuaugagugcaggucuuuuucauagaaugauuuccuuuggguagauacucaguagugagauugcuggguugaaugguaguucuaauuuuaguuguuugagaaauuuucauauugcuuuccaaagggguugcguuuccuuuucucugcauccuugccaacaucuguuauuuuuugacuuuuugguaauagucauucugacuggugugagaugauaucucauuaugguuuugauuugcaucucucuggugauuagcaauguugagcauucuuucauguuuguuggcugcuuugucuucuuuuaagaagugucuguucauguccuuugcccccuuuuuaauggaguuguuuuuuucuuguuaaguuccuuauagauucuggauauuaguccguugucagauauguaguuugcaaauauuuucucccauucuguaagauguccguuuacucuguugauaguuucuuuugcugugcaaaagucccaauugucaauuuguuuuuguuacauuuguuuuugaguacuuagucauaaauuccuugccuuagccaauguccagaagaguuuuuucuaggguuucuucuaggauuuuuguacuuugaggucuuacauugaagucuuuaauccaucuugaguuaauuuuuguauauagugagagauagggguccaauuucauucuucuacauauggccagccaguuuucccagcaccauuuauugaauaggguguccuuuuuccauuguucauuuuuuuuggucaucuuuguuaaagaucagauagcuguagguguauggcuuuauuucugaguucucuuuucuguuccauuagucugucuguuuguuuaccaguaccaugauguugugguugcuguaacuuuauaguaauagguugaagucaaguaauguaaugccuccagcuuuguucuuuuuuuuuuccuuuuuuuuuuugcuuaggauugcuuugggcccuuuuuuuuuuuuugcuuccuuaugaauuuuagaacugcuuuuucuaauucugugaaaaaugacauugguaauuggauaggaauugcauugaaucuguaaguuacuuuagacaguauggcaauuuuaacaauaucgauucuuccgauccaugggcguggaaugcuuuuccauuuguuuaugucaucuauaauuucuuucagcaguguuuuguaguucauggggagaucuuucaccuccuugguuagcuguguuccuagguacuuuauuuuuggggggccauuguaacaggacuguauccuugauuugguuguuagcuugaauuauugguuuguagaaaugcuacugauuuuuguacguuaauuuuuguauccugaaacuuuacuaacgucauuuaucaggucuuuuggagggauuguuaggguuuuuuuagguuuagaaucauauugugagugaacagagauaauuugacuuccucuuuuucuauuuagaugccuuuuguuucuuuuucuugcccgauugcucuggguaggacuucaguacuauguugaauagagguggugagagugggcauccuugucuuguucuuaggggggaugcuuucaccuuugcccauucaguaugauauuggcuguggguuugucauagauggcucuuauuauuuugagagguauguuccuucauugccuaguuuguugaggauuuuuaucaugaagggauauuggacuuuaucaaaugcuuuuucuacauguauugagaugaucauaugguuuuuguuuuuaauucuguuuaugugcuaaaacuauuccccaaaaucaaagagaaaggauuucuccuuaacacauucuacgaaaccaguaucauccugauaccaaaaucuggcaaggacacaacaacaaaaaaagaaaacuguagaccaauauuccugaugaagguagacacaaaaauccucaacaaaauacuaucagacugaauccagcagcacaucaaaaagauaauucauuauaaucaagugggguuuauucucuuggauguuauucugaugucacugggaaaccucuggaauaucagaagcaacaaagcaaauaggauaugauucacagggcaaaucaagucacuguggcuccucaguggagaacugcuguacacagggcugaguagagcagugaggccuauuggccuuuugaggauuuaggcucaaaaacagaucgcagaaucaguuacguuaaaccugggaaccccaugucuuuuauuuuacagguuucuuuccgguguuuucagcaauuguaaaaccaguuuuacagagaucacaaauuuuguucauauauauagaaaaaggaaaaaaaaagaacaauuucucuuuggaauuauuuguauuguacuaagugauacuuguuuaaaaaggaaaacaaguggaagauuugugguuuuauccuucauauugauuugaaguauguuuauugguugagacuaacagcccuaggccaguuugaagcaauaagcucugcaaucacagaaaaugauaucuaaguuuagaaagcaauguuuugaauguuacauugauagaaucaaagauaauaagugaaggcaacaauuacaagaaauaaucaggaaaguuuggaacuguauuugauuuuacugguuugccuuguuuuguuuuuaauuuaauuuaauuuuuuuuuuaaauaaauagauauggggucucgccguguugaccaggcuggucaaacuccuggccuaaagugauccucccgucucggccucccaaagugcuaggauuacaggcaugagccacugcaccuggaccauuuuuauuuuuauuuuuugagacagucucucuccguuuccuggcuggagugcagugaugcaaucauggcuuacugcaaucucugccuccccagcucgagcaauucuugugccuuggccacccaaguaucccaaauugcuaggauuacaggcaugagccaguguguccagcuagcugccuucuuuuaaaaaguaaaauuguucuugacuucuaggacagugauacauagucauuguggaaaacagcaaauacugaccaaacuaaaaaagaagguaaauaucucacauguacuguucagggacauccacuguuaaauuuuugagguauuuagguauauauguguuaguauauuugguuauuuauuuaucauaguguagaaagguuuuauaaucuauuuuuagcacuguuaacauauuuucacaucaugaaauauucauaaucuuauuuuuauggcgacgugcaaucuauaguuacaccacaguuuuuuaaaaccagaugcuuauuguuaaaaucuaauuuuuacucaaauuucuauuguuauuucuuagucuguuuugaagaaauacuguaaagaaauccaucuguaacuacauuuuuguuuauauuauuuuguguuugugaguacuccccaaguauuauuguguagucaaagaagucaaagaaugcuaaauuuuaaggcuucugcuauguuuugccggccccccagaaagauuguacucccaauagcagucuaugagguugccaguuucucuacauccuugccagcucugguaucauugugcuuuuaaaaauuaauuuuugaaauuugguacgugaaaaauuaauaucucagugcuuucauuuuauaauuauuugaucauuaguaaggaagaauacguuugcuguuugugauuuguguguacauuauaugaauugcuuauucauauccuuuuucuacuuuuuaauuagguuuauauuuuucuuacuguuuuuaaagaaauacuuaugcagcaaugauaauucauugucagucauaaaaguuguauuuuuuccaaguucugcauuuuucuuuuaauuuuuaaaaugucuacguauuuuguuuauauagccaggucuguuugucuauaucauaucuuccccacauagauguugcauaaauucucucauauuucuccuucugcuuuuugguuauguuuuuugcauuuaaauguuuggcuuauuuauuuacauaucuacacauaggcaucuuuuuuuuuuuuuuuuuuuugucauuuagaaagaaagucgugcuguaucccuacugacuucuccagcugcugguauaaaaacaguugauccucugccuuugcgggaagauucugaagacaauauccacaaauuugcugaggcaacucuuccaguuucaaaaauuccaaaauacccaacaaaucccccuggacaguugccuucuccaccacauguuccauccuacuggcaucccucucgacgaauucagggcucucuuagagauccagaguuucagcacaaugguaauuauuuugguuuuaauuuuuugucuuuuaaaauaaaguguuaugcugauagguacaaagucuaagaaugcauuuuauguuaauaaaucaguuauuuaguauuuuugguuaauguauuaauaaaauuucuuuaaauaggaaaacucccuccuugggaccaauugugcugcaccuaaguucacuuuuugcuguuauauaugugugagauaucucucaaguucuuauucauacacauacagggaauccacuagauagaugacaguagcaccucuucucuggaugugacaaccaaaaaugucuccagacauugccaaauguugccuggguguagaauucacagucagaaaugacuuuccuuuaguguuaguaggcauugcucagcucuuuucuggcuuccaucguuaauguuaagaagucagaugcuccuuuuauucuggaucuucuaugugugguguuuucuuucuggcagcuuuugggaucuucucuucauaucuaauguucugaaauuuuaugaugugccucugagagaguauuauuuuuuuuauucauuuugcugguacuccauagaccuuucaaucuggaaaauucucacuucuggaacauuuucuugaauuauucagucaaaaauuuccucuccuggccaggcacaguggcucauguuuguaaucccagccacuuugggaggccaaggcaggcagaucauuugaggccaggaauuugagaccagccugggucacaugaugaaacccugucucuguuacaaaaaaauuagcuggguguguuagugcacaccuguaauuccagcuacuugggaggcugaggcaugagaauugcuuaagucugggaggccaaaaaaaaaaaauuucucuccuuucucuauuuccucuuucuagggcuccuauucagauguuggacaugauuuuauuuuuuaucuuaccucuccuguuuuccaucucugucuuuaaauuugaaaggguuacuaauuuuuaucuucuaucuuuuguguuuuuuaaaauuuuuauuucaauagcuuuugggguacagguaguuuugguuacauggauguauucuauaguggugaauucuggauuuuaaugcaccuguuacccaagcaguguacacuguacccaacauguagacuuuuaucccuucccccaccccaaguccccacagucuaucguaucacucuguaugucuuuguguccucauagcuuagcucccacugguaagugagaacaugcaguauuugauuuuucauaccugaguuacucaauuuagaauaaugaccuccaccuccaucuuaguugcugcaaaagacauuauuucauuccuuuuaauggaggauuaguauuccgugguguuccuguuucucuaguuccuugaggugugauaguagguugucaguuugugcucuuucagacuuuuuaagguaggcauuuaaugcuauaaacuuuuagcauugcuuuugcuguaucccagagguuuugauaacuugugucacuguuacucauuucaaagaauuuuugaauuuccaucuugauuucauuguuaacccuaaaaucauucaagagcagauuauuuaauuucuauguauuuguauaguuuugaggauuccuuuuggaguugauuucuaguuuuauuccccuguggucugagaagauaauugguaugauuuucuuaaauuuauugagacuugucuguggcuugucauguggucuauuuuggaaaauguuccaugugaaaugaugagaagaauguauauucuacaauuguuggguagaauguuuuguaaauaucuguuaaguccauuuguucuagaguauuguuuaaguccauuguuucuucguugacuuucugucuuaacgaucugucuagugcugucaguggaguauugaagucacucgcuauuauuaugucgcugucuacuucauuucucaggucuaguaguaauuguuuuauaaaugugggaacuccaguguuaggugcauauaaauguaggacugacuguaauaccuucuuguuggacugaccuuuuuaucguuauaugaugaccuuugucuuuuuuuaaauaguuguugcuuuaaagucuguuuugccugauauaagacuccugcuugcuuuugguuuccauuugcauggaauaucuuuuccuaccccuuuaccuugagcuuauaugaaucuuugugcauuagauauuugguuugugguuuuuaauccauucugccauuccauaucuuuuaaauggagcauuuaggccauuuacguucaauguuaauauugagacgugagguacuguucuauucacuguguuaguuguuacuuagauacuuuguuuuuuccguuguguuguuuuauaggcccugugaguuuuaagcuuucagagguucuguuuuguugcauaucaagcuuuuguuucaaaauuuagaacuccuacuuagcauuucuuguagugcuggucugguagugacaaauuccucagcauuuguuugucugaaaaagacuuuauuucuccuucauuuaugaaacuuaguuuugcuaaacuaacaaaauucuuggcugauagguguucuguuuaaggaggcuaaagauaggaccccaaugccuucugccuuguaagguuucugcugggaagucuguuguuagucuaguuguuuuucuuuuguaaguuaccugaugcuuuuugccucacaacuguuagaauucuuuccuucauguugacuuuagauaaccugaugacuaugugccuuggugaugaucuuuuugcaaugaaguuccuaagaguucauugagcuucuuguauuuggauauuuaaaucucuagcaaggccagggaaguuuuccucaauuauucccucaaaggaauuuuccaaacuuuuagccuuuucuucucccucaguaucaccauuuauucuuacauuugguuguuuacauaauccuauauuucuuggagacuuuguucauuucauuugauucuuuuuucuuuauuuuuguuugauuggguuaauucgaaagccuugucuuugagcucugaaauucuuuuuucugcuuuuuccucccucuuggaccuggcaugcagcuaucuucuacuuguucuagucuauuuuugaaacuuuccacuacguuuuguauuucucuaaguguguuuuuuauuuccagauguucugauugcauuuucuuuaugauaucuaucucucugggaaauuuuucauucauauccugaauuuuuuuuuaauuucuuuauguugguuuucaccuuucucugguagcuccuugaguagcuuaaucaucaaccuucugaauuuguuaucugguauuucaaagauuucaucuugguuuggaucaguuacuggagagugagugugaucuuuugaggguguuauagaaccuuguuuugucauauuacuagaauuacuuucugguuccuucuuuuuuggguagacuauucuaauuguucucaaauuuauuuuugauuugacuauguguguuuuuuuuaaaauuuuuuuccccucuuaagaaugugaccuuaaugauuauaauuuguuauaguuuaauuugguucuuggugcuuuuaggggugaagagucuuuauaaguucuuugguuauagagagucuuuguaugauggcuuccucaguugcugguuguaguagcuguguacucagugugucggcaaguucgcugucuccugugggguuggaauggcagaggucucuugaagcuuaucucauuccccugugguguguacuuuuucauuuauuuaauuuuucuccaguauuuuguuuacugaguugauaguucaggcuucaggccauuaggggagguaucccuggguaggaacuuacuguggcuaagguaggugggugaaugcaauacccacuggugggcacaggucccagccuugaugaagguggcugggggagcucucaguuaaaugcagugaggucuuaucagggugaagggugagaaugcuauccaaguagauaggaauugugacucugccucucaugcaagccugcaucuggggagugcuccuccuguggggaagcagucacccuaaaguguuccaggaaggcugucuauaggcacacucauaccgaguccugugggagaagucccagcugugucugcagugguggacaaggggaaauaagaccccuucuccaagacccuucaugagcacuaagcuugccugacuguuggggugaugggguagacucccugcugagccuagcacugcaauugugucucugcugaaagaaacuucccaccaguggaaagaucugggacuccugagauuccuugguuguagauaggcuuagggugcuggcuuucuugcguguugguuaugauaguugugaacuugucacguagacagauucaggaccacuggucagcuaggguguugcaggcaguggugauagcugaggucaggcacugguuuucugggcacagcguuauucuaccuagagaugauauaauggacugugucaguuggccucuaaucaggaggugcugcuugcaaaagagcaccagcugcaguaguagcagugguaauugagcuuucccuguguugcccaggggagguauucuggcuucucacaccugggcaggguuauaaaacucccaaaaguuuaugucguuuuuguuaagcuguggaggggcacagccaggcaggggcuggguuaggugggucugcucuuugacucuccacaugccgucuguuaguuuuuuaaaaagauuuuugcucuuuuuaauuucuaagaauuuuugaacauugcauauugcuuuuauacagcaucccauucuuauuucaugaauggaauguuuuaucucuuugaagaggaaaaugauacauauaaugccucuguuuugaauacauuaccccugcccacaguugaaccugguauccuucagucaaaguaucucugguaaacuuuuagagacgaaacuuccaugccucuuugggaaagagggaacuacccagcugugcaaauuuaaaggaggaccuggcauauuaacuauuuuuguaaaaacauauuuaggcagcuuccugguucagucuucccuucacuccaacuuucagugguacucaguaugcccaaacccagagccaucaggggaacaaguugguuguuucuugguuucacucuucugcuggcuuaaacuuccacuuacuuggguauaguuauacacucacugcucuuccauuugcuuuccauguuccaaaaaguuucuugcugucuuauuugcucccauucucuuuguccuaugaguuuguucuucuuguaaaugcguguauuuaauuuaccaucucuaaucagaagccuacuacauuucuuuaaaguuagaauagaucaauauuaucauuggaaagaauauuaggaaguuauccauaguuuguuuacaugcuugcuaagugcauuauaaauuaugaauggcccuuuuaugguaauuucuauuaagauauaaaauuaauuaauaaaaucuuuuucauuucuuaaaccuuuacucacauguagguuugauaauuaauaaaauuucugacagccuacuuuuacuaacaguuuaguauauaauugagauaagcuguucaguggcuuuugaaggauaauuuauucugccuuuuuuuuuuuaagugggaaaagcaaggaugaacaauuugcaguuaccucaacaugaagccuuuaaugaugaagguauuucaguagucacauaacauaaaaguuugaguucuagucuaugagaguauaauggcuuuacauuugauuagcacuuuauagcuuaugaaguacuuccacagauuuuucauuagauccuugaaacccugugagggggagugaaauuacccccauuuacaaaugaguaagcugggaguaaagugguaaaaaacuguucuagggcaaacauacaauaagagauugugccugacaucacagcugaggucaguguucuuuuucuuuuuccaccuugucuagcugggggcucaggaauuuggccuaguguuacauccaucuuuuaaaaaaaugccuauauauuuuugucaauuuuccauggucaaacaaauacaugauuagagaaaauugacauuauucuuuuuugcuguuucguuuuguuuuguuuuugagacggagucucgcucugucgccaggcuggagugcaguggcaugaucucggcucacugcagccucugccucccggguucaagcgauucuccugccucagccucccaaauagcugggauuacaggcauccgcuaccacacccggcuaauuuuuguauuuuuaguagagaugggguuucaccauguuggccaggauggucucaaacuccugaccuugugauccgcccaccuuggccucccaaagugcugggauuacaggcgugagccaccaugcccagccuuuuguaguuuuuauucugacauuuauuugcuuauaauaguggcaggagacuugaauucaauaugaauaauugaaucacuauuuuaauucauccuaagaaguauggaauuacugaacuuacaaaguuugaauuggaaguaaauuuaaauuucauacucuguaucauacauuaaagacuuucuuuccguuuagcagguuuaggacuuuuuguuauaauucauugagcuagaaaucaaguuguauguuuugaaaugcaaaugucugacaacuuugaauccaguccuuuuuucuuucuaauggaagaauagugucuauaaauaaccuuauaaaagauuugcuuacucagaaugaggaauuucaguauuaaggaaggguagcauauuaaaaucaaaaauuauuucuacauuuagugagauuauuuuagaaaugugauguaaaugccauguuaagguauggcauuuuguuuuuaaaaaguuuagaaaagcuuuuugcucagaauagcugugcuuuuuaaaguaggauaaaacaguauuaugaugaauuauuuucaaguaauacugaaaucauaggccgugugcucuguuaaugacgggauuucaagaaggaaaaaaauuuaacgauaaauguuaagauuaaaagguuugauuucuauauaugauaaaccuggaaaacuacugugagguaucaugagaguguuaguaucuuacauuucaguagauuacuuuuuuuccugacuaacuugacauugauaacacaguuugaugcuuuuaauuuucuguuauauaaaacacaauguuuauuuaauagauauuuuuggcaaugaauauaaucucgggauuuuuucauugcagaugaggacagauugucugagauuucugcucgcucugcagcuucuagucuccgggcuuuucaaacucuggcacgagcuaagaaaaggaaggagaauuucugggguaaaacauaaaccuagcugaguugccuuuaucuaaggaaacauuggcauaauuuuucuuuauugcuuacuguguuaaaauuuuuugagugaaguuuuuccuaacguuuucuacuuugaaauauuuaauuuccaauagaacaguuuacuuggaaauuguuaacauaggcuuauacaaauuuaacuuuuaaagaauucuuuuuacaucuaucccagaguacaaagaccuagauuauugaauucuucacauguaacuuucguaauaggugucauggauagauuuucaccuauccagagaguauucuaaaaaaauaaacaaagugaaguaaaaguuaagaucccagugugaaguauauauuccccuaagauuugauauauguaucuuuauaauugaugauguuguaaaaugaauuuguuguuccuuuaaccuuugcuguaguguuucuuuuuauuuuaguuccuucuauacauguuugcaguguuaagauaauuguacuuugaaaacaccagcuguauauauuuuucuuauuuauguaacaaaguuugcugaaagauauguauauuuuugaucuuugaguguauucuauuuguguaaggacuuuggcuuacauuugaauaaugucuagauuuugaaaaauuaccuguauaauggagaauuaaaacuuuguagacauuuugaaauaaaaauggaucaagugcguuuggcuucuccagaaaguuauuacauggaacaaauaauuaucuuguagaagaauucuacuccuaacagguuaaugaacaguuauacuuguuuugcagcugucagaauggaauggagccaagucugugauauuuucgcacaaaugugggacaaagaauuuccaaggcagacucauuuacagaaauuuaacacaaaac

SEQ ID NO: 16401 - RNA, 42203 nt, Homo sapiens
aaagcagaaggucgcgcuuggaggaaguggcggcuuugaguccgguggcccaaucgcuguuacuacuucucugaagcuccucucggcugcuugccgagacacccugccgccaagaugccucgaauuaugaucaaggggggcguauggaggaauaccgagguaagucuccuuuucccgccguccgcugcccgccgcucccucuagcagcuugugcgcacgcgcgcggaggucgggggggcgacgaggagacccuguggggucugcguggagggcagcccgggggcugacccuuggggcccuuuccgugugucuggccccguguugugcgagcgccaguaggacagggaccgugaugucaccaccuggcuacucggcuccaagcucacuuguuaggcccugagugaacauuuguugacuugaauacgcccccucccaccccgcccccccgccccccccggccccgggaagaacucagaguuccaacucagccagaguuggucccccggggcaccauccacucuuaguccaggcaccacgacucugucucauacucagaaauaaagaaguugccguggccacaacuuugugucuccauugacuuccuugcagaggggaagcaguuugagugccagguucagagagcccguuuaugcccgcaucucucugguuaucuguuaucagggcauaaccugucugccaucucgacagaucccaaggucugucucuuucugucacugccuuugccuagauagaagccagaaaggaaaaacuggccuaggauagucucuguuuccagaaacguaguggauagugccauuggugagccaaagggcaguagagugggagugaaauagaaauuagauuuuagugcguuuuguguucagaguguaccgaauuuaucaguuucuggagcacaucaugucuuuucaugcucugugucuuuuuuucguuacauuuuauggcuucuuuuuuuuuuuuuuuuuacaucuuuugccuuccuagcgcuugacaucuuucugaucauccuucaaaccuaguucggaaacacuucuuggaaucucuguaagaauuaauugcacccccgauauucucaugauaccuuuuucuuccguuuguuaaaacuugcuuugucuuuuuguaagcaucacauccucugugugguacucgguaaguuucuuaacuucugaaagccucaguuuucuacuuuuucuaaauugggauaauaauacuuaaccucucuugaggauuacacgaguuaauacguuuggaauauuuagaucagaguagggcacauaguagccucugaguaagagcuaguugcucuuucaccucaccagacagcauggcgagaggaccaggucuugguaucccuaggaccuaggacaguaaccaacaugaaguagguugcucgacagguauuugcagaaugaaucaaguagaguagguaucugcuguaucuauuuaauugaaaauguguuuaaguguaguuguacugcaaccaaguuacaaaaaagacaaugaaaacugccucagcuuccaccgagggaaccagacuguuuaaauuggagaagagaugacuucugagggagagacagauauaaaaucaaguaacaguaggauuccuaugcaguggucaaagcucugcagucuuuuuaaaaaguaucuuugaucaugggagauguagaggauggagugggguaucucaagaggcacguaccucaaauccaaugugggaaaaaaagccuagaaguaaaaucgccuaagugcaugcaucuauggcuccauuaacuuucuugucuuuggcuuggcuugccaggcuuccuugagguuggugcauuccacauggcaaugggugcccuggugaaaugguaucuagagauggggggaaauuggaaggagagcugacuagugggguugggguagaaauauguaauucuuagguuagaccugagauguggauucuugggucauaguugggguuaaggggcuggaggggaaaugccauguauaaacuugagacaggaggcuuggauuggagaauauauucaccagagucccaacuugcuucuugaggccuggauauguccuguuugauaagaccuuuccccaagggaaagguagauguuucaagguagauguucaggaaguguuuuuugagugaguguauaaaugaaugaguuauacauuuuuguuguuguuguguuuuuuaguuauccuuuuugaagagaaggacagccacacguugaagaauacuuuuucuuaauuuuugucauaaaguaggguuucucagauugggcuguucccacucccaauuuauuggagagugugguguaaggguggguagcugucuuucuaagggauuucuucuuaauuucucaauucuugguugcuguuauuauaguuaaugagguuuucauccuuagucuuuuaaccuaggugguguguaugugcauguuauaugucucuuucuccaauagcccuaucagaguuaauuuaaauuuugucuuuucccacuuggaguuuugugacugaauguacucuuuggcaauuuuuuuuaggaugaaauucugaaagcagcgguaaugaaauaugggaaaaaucaguggucuaggauugccucauugcugcauagaaaaucagcaaagcagugcaaagccagaugguauguaucaguuuaauaaguggaaaacagaaaaggagcuuaauuaugaugauggaaaaugucaacucugugaaccuuaucaaagaaagcagacauuguaauauaacaaggcauggagugggagauggaaguuggguguuugacuuagcugucacuugcuuccuguguggucuuaggcaagccauuuuucuaucccucuccccugcccuuguuuucucccaauuagggauaauaauacuugguccugacugauagagaugugaguugucaucuaaauggguuaauguauuugagagugcuuugugaagcauacaaagucuacuuucagggacagaugagccccagcuuguaaauuaauuguguucuaaaagugcauaaguuagcuguuuuagaaauuacuugcucaaagaaauaaaugauaaauaauggcuaauuuucuaaguaagccuacaguaguugaguuuccucauaauacaguugaaauauuauauauuuuauaguuaauauguuauauauuauauauuaaacauacuuaauguuauauauuauauauuaaacauauuuaauauguuauauauuauauauuaaacauauuuaauauguuauauauuauauauuaaacauauuuaauauguuauauauuauauauuaaacauauuuaauauguuauauauuauauauuaaacauauuuaauauguuauauauuauauauuaaacauuuaauauguuauauauuauauauuaaacauauuuaauauguuauauauuauauauuaaacauauuuaauauguuauauauuguauauauuaaacauauuuaauauguuauauauauuaaaagauauaagccaacucugaaccuguggugucaccucuuuuuuauuuuuauuuuuugggacggagucuugcucugucgcccaggcuggagugcaguggcgugaucucagcucacugcaagcuuugccucccggguucacgccauucuucugccauagccuccugaguagcugggacuacaggcuccugccaccauucccggcuaauuuuuuguauuuuuaguagagacggaguuucgccguguuagccaggauggucuugaucuccugaccucgugauccauccaccucggccucccagagugcugggauuacaggcgugagccaccgcgcccggcuggugucaccucuuaaaucauaggguaguggacacgugaagcuauuuaggguguucuuggcaugaguuauuuagcaccauccccaagucauguggcauuaggaaaauacuuuggauuguauaagaaugaccuaauuuccuaggcaccugguuaggggaaaguaucagaauguagaaauuggccaggcgugguggcucacaucuguaagccuagcacuucgggaggccaaggcugggaucaccugaggucaggaguuugagaccagccuggccaacauggugaaaaccccgucucuucuaaaaguacaaaaauuagccaggcgugguggcuacuugggaggcugaggugggaggaucgguugaacccaggagguggagguuguagugagcugagaugcugccacugcacuccagccugggcgacagagugaggcuuuuugaauguagaaauuggcuguuaagaggaagaugauuuuuaggcugaagaagucguucugauuucuguuugucuuagugguaccaguuccugcugucauauuugguaggacuuaaguccuguuugccugccugucauccagcuaaguagacuggauggaaaaggugggcuggguggggaauuaggaaagacagagggaaugucauaguaguuuuacuuaaauuuuaaaacauaucaaaugaaagguuacggugaauuuagugaguguaagucaaaugcuuaaagaaauaagccauggugugagaaucaaagcaugagaaaauaguaugaaaacuggaaacacuguaagaaacgugauuuuguauugucuuccaaauauuucaaaauuucuagaaaagcguaaauaaauaaaaacaugauagaugagaaagaaggcuuaugaucaugauucagugaaguaaccuuuuuuaaccauuacuaaucuugcauaauuaaaauaaaauagaaugugaugagauggggaauauugacugggguaaguguaaccacacagcaaauauucuguugucaaaaagaacaguuuuuguaauugaaggaugagagcacaagucaguguauccauugugcaaauuggauauuuaugccagguaacugauuaauauauaaaaugaucuauguuuaauagguaugaauggcuggauccaagcauuaagaagacagaaugguccagagaagaagaggaaaaacucuugcacuuggccaaguugaugccaacucaguggaggaccauugcuccaaucauuggaagaacagcggcccagugcuuagaacacuaugaauuucuucuguaagugagucuucagaaagagcauagaauauauguauauguucugaaagaggcugaauaaacuuugaguauuuucugucuuuaaacuuuuaauuauggaugugaguaaacccaaagcuaaagccauuggauaauauuuuccauaucucagaugguugaucaaaauuaugccuucugucauauacuuccuaaaauaauaauuuaaaagaauuauacaagucaugcauguucaucauagaaaaucuggggaaaaaauaguaaaagagcaaauaaaagucacccauaaucacacugcuaagaauuaacuacuggaacauuuugguucuuuacuaauaguuuuuuuuuuuuuuuuuuuuuuuuuaaauuuguauggcuguaccgcauuugugauuaggaucuguuuggguucuauuuuagagugauugaaaccagucacugaaaucagcaaauuuuaauaucauuucuuucagaugaagugauaguaaaaaggcuuuauguuguuaaagcccauccauugguuuuuuuggggggaaaaauaucgucagaacuuggaaaucugguaauuuuaacucuaaaugguacuguagugugacuaacuccuaugggcuuuuuucuagggauaaagcugcccaaagagacaaugaagaggaaacaacagaugauccacgaaaacuuaaaccuggagaaauagauccaaauccagaaacaaaaccagcgcggccugauccaauugauauggaugaggguaaguguaugcuuugaggaauuuauuucuuugguaacuguaaacuccuugggccucacucuuuuaguuccuuucugaacuccucuacuuuagaaucccuuuuuuuuuugagacaaggucuugcucuguuacccaggcuggaaugaaguggcacaaucaugguucacugcgguuuugaccuccugggcuuaagcaauccucccaucucagccuccugaguaguugggacuacagguuuaugccgccauaccuggcuaauuuuuaaauuuuuuuguagagauggggucucccuguguuacccaggcuggucucaaacuccugggcuuaagcuauccucccuuuucugccuccaaaaguguugagauuauaggugugagccaccauaccugauccccaauucugucagcaguguucuuauucuaaguaucuuuccaaauauguccaguguuuucuguuauagaguaguugcuuuuucugaacagcgccccuucaucuucuguuucuucaauucaguuaauuaaguuaauuaaguguuacgggguguggugguaugugccuguagugcuagcugcuaaggaaguugaggugggucgaucucuuuagcccaggaguuggaggccagucugggcaacauaaccccuugagcccagaaguuggaggccagccugggcagcauaacgagacccugucuuuaaaacugaguaguguaauucuacugaguagauuuuucagaggcuagaggugagcccuugaagauccuguuucucauuccuauuccauggagagagacaucaagucagaauauuggaccucaguccuccuauuaauuacuuauuugacuauaggcaaguuauuuauucugugugagaaggcaaccugugagacggugauggagacuuaacagugauucugggaggcauugaaucaggaauuccacaauagaaaguauauggaaucaaccuaaguguccauuaaugggugaauggauaaagaaaauguggacugggcaugguggcucacgccuguaaucccagcacguugggaggcugaggugggcagaucacuugagcccaggaguucaagaucagccuggccaacauggugaaacccugccucuauaaaaaaauacaaaaauuagccaggugugguggcgcaugccuguagauccagcuacuggggaggcugaggugggagaaucacuugagcccgggaggcuggguuugccaugagcugagaucaagcacugcacuccagccugggcaacagagcaggacccugucucaaaaaaaaaaaaaaaaaaaaaaaaaaaaaaugguauacacacacacacacacacacacacacacgaauacuauuuggucauaaaaagcaaugaaaucaugucauuugcagcaacauggauggcaguagaagucauuauguucagugaaauaagccaggcacagagagacaaauacugcauauucuuccucauaugugggagcuaaaagcguugaucucauggaguuagaauagagugauagaugccagaggcuggguauggugugugggugggagagcgggauuaagagagguugguuaauggguacaaacguagauggaaagaaauaaguuauaauguuugauagcagaauagggugacuauaguuagcaacaguguauuacauauuucaaaguagcuggaagagaggucugaaauaaauacucaaggugauggguaccccagauauacugacuugaucauuacacauucuaugcauguaacaaacucucacauguacccuauaaauauguaaaguaugauguaucaguuaacagaaucaggaauuggauuuucaacccgugugugccaccuauuagcuguuugaccuuagacaagucauaaaaucucucugagcuuugauucccuuucuugcgagauggggaauacuaauaccugcuuuaccuuagcaggguuguugugaagcacucagugaauauuuguuaaguuucuaaaauguaaaguuugaacauagugguucccaaaggcaggcuguggcuaggcuggcugcaucauuaucacagggggagcauuuaaaaauagaaauaucagggcuucuccuguauauacugagucaguacaucugggguggugugggaggcacgggaagagcagugaucuuggaaucugaguauuuuacaaguucccaugugauuuaguuggacagccuugcauaggaauuguucuaaggcaucaauaguggcauguauuauuccauucuauagagccacgaaaaauguauuggaugagagaaauuguucugaggggaaaaaaaaguaucuaaugauaguuguucucucauaauuaaauaguuuuuacccuauuucacaauuugugcugugccaguuaguugauaauaaugaaggauacaauaauuguagccacuguuuaaugaaugcuugcgagaugcuuuacauauuucguuuuacuuagcccuucucaaaauccuugugaaauaggaauuguuauucgaauuuuauagggaaaccaugcuuagggaggguaaguaagugacuaaggucacauagcuagcaaguggugggccugguuuuuaaccuagguucuuugacuucaaaacucaagcuguuuccauuaugcuacaccauaaaaucaguauuuuuauguuuuuuucucauuuugagcaauagagugucucuuacauaccuugcuucuagaguauguaagaacuaagaaaauacuuaguuuuucuucuuuuaauuuuugcagaugaacuugagaugcuuucugaagccagagcccgcuuggcuaauacucagggaaagaaggccaagaggaaagcaagagagaaacaauuggaagaagcaagguauguguggauauaggaauaaaaagcaaaguguuuuucucacauaacaaucaacacagaauacuucugugaccagauaugugguuuuuuuuuuuuuuuccccucuccaccagcaaucaggcaaucaauucugcaguggauagcuggguguccucuaauucaguuaacucuaauacugucuaccuggagauagcuccagaucuuacagguugaggacuuagucccacaagacugaaccccaguuuugaugcugacccuaaaccccagguuauuuugcuuguguuucugaccagcgagcuggguuccacugccccuuccuuggguuccauucaucugcuagaggacucacagaacucagggaaacacccacauuuacaaaggauauuuuaaaggauacaaaucaacggccccaugaagagauacacagggugaagccuggaaggguccugagugcaggugcuuaugucccauugaaguugggauaugccacccucccagccaguggguguguucuuguucaccuuuucggaagcccccauguauuuggcugcccacaaguucuccagacucuguccuuuuggguuuuuauggaggcuucauuaaauaggcaagauugauuacaucauuggccauugcuuaucaacucgaccuucagcccuucuccccuccccugagguuggggguuguggcugaaagucccaagcccucuaauccugccguggucuuucuggugacugccagcuaucagucaacucauuaacaugcagaaagacacuuuucacuuggaagagucccaggauuuuaggaguugcauuguuggaaacggaugaagaccaaauacauuauuucacaaugugugcuugucuccauucauaguucaauaauuagucuaggcauccuuaggaccaauaaaacugcaugauuuauuaacccguugggugaauaauaauuggaauuguccaguuccuauuucgcuaguauucuuuaccuucuuuauuucucugaaacuaucuuguauuuuuuucccccaaccauuucagaauauuuauagaaaaccauauuuaaaaaaaauugaagcuauggcagagguaaugcccaguuuauccaguauguugaguguguucuguuggcauaugagagcuucauuuguuguagcuauuuuggagucagaugacuguaggacacacaagauuaugugucuuuuguaugacugccaauuaguuacuuuccuugauugguauugggaaggcacuggcugugaaacaggaaacuuggcugaacaaagagggaauuaaugagcuuagaaccaaauuuuaggcccucauagaaaucuuuauuuaaaaaguaaacgaauauauauuacacauugucuuucacucaggauuuucuucacuuuccccuuuuuuccuuuugguuaaguccaugauugauaucaguucuaauagcccagaaaccaagaugaugucacuaaagggcaaaucuggacugugucacagcuuauuagcuucugggauucaggcccuagaauaaccucccuauccuguacagugccccuuguggcccccagguuggccugcugauucuucuugaccugaugaccagcauuauguuguaauuaauggcuuugaagugccagauccugggauggaggguuuuuuaaugucugaggaugcauguuggcagagcuggccaauugcuagccuagaaugguuagcuuauuuggggguauuagcugccggggacaguaaacagaaaccaagaggagguacuaacuuuuccaccauucuuggccaccucucuauucuguauacucuucagaguuaaguacugugaguaagguugaaaaaaaaucacuuuuccauuuuuauccaugguuguaggggaccaaauuuuuagagcccuuuaaccguguggauugggccagggacacagcaaaugcauaugugaaaaaucuccaaguguggcuagcauugauugcuuuaaauaaaauuugcagauuuuaauuuacccuguaauuucuuguaggcauucuuguagaaucuacacaucuuuguaaguuauauucuaacaggcuggaauggccucuaugcaaagugcagggcagggcuauuugcuuuuaaauguuaaauuacaaaucuaccuuguaacuuaaagcaguuuuuuauugauuauaaaaguaacacauuuuuccuucuaguauuguuaauguucucauuuugggacauagguaauauaaugcuauauggcuugguuauauucauuuagcauuauuguguaaagguuuucuaauguggauugaaguccuuauuuccauuauuuaaagaaugaaauuacuuuaaaauuugaaauacauuuuucuaaacuuuucucucucucaacauagaugugcauuuauguguauauauguacacuaacguuuauacaaaguuggaucauacuguacgguuuuaaugagaagucagcuguaaaucuuacugagauuuccuuguaaguguugaaucauuuuugucauacugcuuuuaauguuaauuuuaauuuuuuuuaagagagggucuuucucuguugccuaggcuuuagugcagaguucacugcagcccugcacaccugggcucaagcaguccucugccuuagcccccugaguagcuggaucuacagaugcacaccaccauucccaccuaauuaaaauuuuuuuuguugagacggagucucgcuauguugcccaggcuggucuugaacuccugaccucaagcuauccuccuuucuuggccucccaaagugcugggauugcaggugugagccacugugacuggccugucuuacugguuuuaaaucuucucgucuuuggcuuucaacauuuuuaauaugaugugucuguagauuucuuuuuguuuaucuuacuuggaguucauugagcuuacuggauguguagauuaauguuuuucaauaaauuuuucaaaauuucagccauuauauaucuucaaauauuuaauucugcuccuuucacuucucuccuuuugguaccccuguucugcuuauguugguguauuuaauagugccacauauuucucugaggcucuauucauguucuucauucuuuuucucuguuuagauugcauaauuguuacugcucuguuuuaaaguuuguuaauucuucugccaguuaacaucuacuguugagccucucuagugaaguuuacauuucagcuuuguacuuuguuuuguuuuguuuuuugagacggggucuugcucuguugccaggcuggagugcaguggugcgaucuaggcucacugcaagcuccaccucccggguucacgccauuuuccugccucagccuccugaguagcugggacuacaggugcccgccaccacacccggcuaauuuuuuguauuuuuaguagagacgguuucaccauguuggccaggauggucuugaucucuugaccucgugaucugccugccucggccuuccaaagugcugggauuacagugugagccaccacaccuggcuacuuuauuuuuuuuuaauuaaauaaauauuuuuuuucauuuuuguuauuccauuccuuuucuaaguuagcugauaagcuuugugcuuuugaauuugagaauuuccauuugguucuuuuuaagcauuucugucucuuuacugauauucucuguuugaugcaacguuguuaucauaccuuccuuuacuucuugguuuccuuuuguucuuggaacauaauggcuacuuucaaguuuguuaaucugacaucugguugcacucucaggcaguuuccguugcuugcauuuuuucuagcauaugggucauucuuuccuguuucuuugcaugucuuauaauuuuuuguuggaaacuagacauuuuagaugauauacuguagcaauuuuggguacucccccagccuucauuuauuauuugcuuguuuacuuguuugaugacugguuuauuuuauuuuauguuuuugagacggagucucgcucugucacccaggcuggagugcaguggcaugaucucggcucacugcaacuucuaccuccuggguucaaguaguucucuugcuucagccuccagaguagcugggauuacaggcacugucuaccgugccuggcuaauuuuuguauuuuuaauaaagacaggguuuccccauguuggccaggcuggucuugugaccucagaugauccaccugccuuggccucccaaaguccugggauuacagacaugagccagcgugucuggccaauuuuagucagucuauucuucccuuaccuccugugagaaaugugaagcaucugauguugcuccucacaggguaugcucacagucacccugggauagcaugguuugggcagcgcucucuuugacauuccuuucccuguuaaguuucacugauugccagcuguuuacuguguuguuuucaacaauguccuggggcauaaguugcacuacaaagugauccagucaaauuugggcuccuuugaagggaugcuuccugauaucaguguuugagauuuauucucaccccagaagggcuccucccagcucuuauucccuguuucucucuggcaaacuaguaggccuacagauuugguaucuccauuaagucugucaagcuuuuucccaacuugccuuuuaccagaacuuccacuguuuuugauaguacccuuaggcuagaacuucucuauacucuguugcaaugaaguccuuuuguuugaggagagauguggaucucucaguucuguguccugcuucuuccccagggcucugacaggacaugucuccaagugacagcccuacuuuauuagcugaguguuuggugggaaguaggggauggacagcagcccaagguuuccuuggcuugcccuccccguccguccgcccgcagcguggagcccucaucucauaagccagggcaaaggcuaucagggcuccaguauucucagcagcacuguguccaaagcuaggacuucuguuuggauggaggaaggaagcccacuuuucagccacucuugauggaacuuugccaccagaaauacugauguccuaauccuccuggaaugaaagcccuacuacugggagcuggaggggagaaggaguccuggguucuuggcugcacuuguguggaguggaaucuccauuccucugagcuggggggaaggagggagugggucuugguuuaaauauauauauuuuucucuuuuuuaaauuuaauuuaauuuuauuauuauuauacuuuaaguuuuaggguacaugugcacaaugugcagguuaguuacauauguauacaugugccaugcuggugugcugcacccauuaacucaucauuuagcauuagguauaucuccuaaagcuaucccuccccucuccccccaccccacaacaguccccagagcgugauguuccccuuccuguguccauguguucucauuguucaguucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaguaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauuuaaauauuauauucuuguguuucuuaccgaguuaaaguagauuuucuugauuuaauguuuauauauuugcuguaucugcuucagauccucuucagagacuuuaauugguuguuuuuaaaauauauguaauuuucaccauucucccuggguagugaguuuauggaguuccucaugcugucaugcuggaaguuacucauagauacuguuuuguaacuuguuuuccaucuuucauauugugaauagcuuuucuuaucacgaaaucauuacaguuauagcaacauaggaagaugcaaagaaaaaaaguaaaaauuaaauggaauuccacccuccaaugacuaucguuauuaauauuuugauggacauccuucauaucuccucaggcacauauucauugauagauaugcauacaguucuuauguguugcccuguaacauguaaacuuucuaacauuuuuuacacagugguaugucuugggccucuuuccauaucagaguagauuuauagccuuuuaaaaguuuauguaaaugucuguauaauaucuuauaaauucauuuaauuucuuacugauaguuguuuagauuguauccagcuaucuacuaucauaaacagugcuuagugaacagcuuuguaauuaaguccuuguucaugguguaacuuauuuccucaggcuaaaggcuaaggagugaaauugcugcucaaaaaauaugaaaaucuuuagacuaugaauguguauuucuaacuucucuuugggaagagaugcaccaauauacuuuuucauuaccagugcagcagacuguccauuuuuugcagccuugccguuaaaacaaaacaaaaaacugaaugguguuaauuagauaugcacaaaugguacuuguuaauuuaauuugugauucuuuaauuguuaaauaaaacuuuugucauuuuaguuaccugcauuuuuugcuuugugaauuguuuccuuuugcucuuuuuacacccuuugagugcauuaaaaaaaaaaaaaaacuuugcuuagacuguuuauauuuaaccaucauacuaguugcaaauauuuuuuccuacuauuugccuuuuaauuucauuuauaaauuuucauaguguuacaguuagaaguuuuauaucucaaagcuauucaauguauagaugaguggauuaaaaggaaaaaaaagcuguugauuuuuuucauuugccauuuauuuaauuuauauuuaguaaguacauuuccauccagagauaagauauguauuuacuuguaguuccuuuugguuuuucuuuuugccuuauuauguguaugugugugugcaccuuuaaauuaaaacuaggauuuguuuuggugaauggugugagguaaggauuuaaauaacuauuucuuccccaaauaaauagauacuuuuuuuuuaacuguaugggauaauuuaucccugucacauggcauaugauuuucaaagugauuuugcauucuuuucagacgucuugcugcccuccaaaaaagaagagaacuucgagcagcuggcauagaaauucagaagaaaagaaaaaggaagagaggaguugauuauaaugccgaaaucccauuugaaaaaaagccugcccuugguuuuuaugauacuucugaggaaaacuaccaagcucuugacgcagauuucaggaaauuaagacaacaggaucuugauggggagcuaagaucguaaguugccuuucugauuuuggaaauggaaaggaauaguaggaggagucuuacgaagggccaaguauuauccuugucagagccagauuuuuauuauuuauuuauuuuacauuuuuuaaaaucaauuuuuuuuuugagacagggucuugcuguguugcccaggcuggaguacaguggcacaaacacggcuuacugaagccuugaccuccugggcucaagcaauccucccaccucagccuccugaguagcuaggccuucaggugcacaccaccacaccuagcuaauuuuuuuuuauuguuuuguagggugggaucuccuuuuguugugcagacuggucucaaacuccugggcucaagcgauccuucuuaaaguguugggauuauaggcaucaguuacugugccuggccuagauuuuuauuaguacaauguggccuacauaugguuuuauuuauuuaauggauucaucuuucugagaaaaucagggacuguggcuaucacguuuuuagcacagaaugcuguuuauggcucuugaguugaaaugcauggcucucaauugacuguuuacucuuugaaucacaucuuaacuuuuauguacauuuaugaguagauuaguuuuacuaguggcugaggaaucugucaaaauugagucugguauuuuuagccuuaaaaaacaauuuuuuuuuuuaagacaaggucucacucuuaucacccaggcuggagugcaguggcaugaucacagcucacuguauccaccucccaggcucaagcaguccuuccaccucaaccucucaaguagcugggaguacagaugugugccaccaugacuggcuaauuuuuuauuuuuuguagagaggugggucuugccauguuauccaugcuggccuugaacuccuaggcucaagcuacccucccuuugcgucccucacaaaguguugggauuacaggcaugagucaccacuccuggcccuuuuagucuuuucuagugaaaaauuuuaccuuguuuuuauuaagaugaaauuaaaagaaaaaacuuacugauccuuucacuugaugggauaaauauacauuuauaaaaucuuuauguuuuagggcauagcagauuuucccuauuucuugagauuuuuaguuucuuuaaaucucauaucugaauauuguagggagaguauuuuaugguugucaaggguuuuuuaaaguuuucuacuccguugaccuuucauuucuguugacaugaauuguuacaaaacaacagcuaucagccauuguaaaauaggauuuucuuagauguacuccauuguauuuauuccucagauuaggacuuugcuuuagguaggcucuacaaauaaagagauugaacaggaaaacuauucauuuggaaggaguacuaagugggggaggcaagaaagacacacagaaggggaggagguauuccuggagcuuugaaagacugcuuugagccugucuuuaggcuuccuaaccauguuuagaugucacuugucaguauuaagacagccuuuuuaaaaaaguugugaauuuuaagaaucaugagaauuuaauaacaaguuuuaaagggaaauuuaauuauguuuuaauuuuauuucuuucauacacauuuuccuuuuuacauacuugucauacuuuuuccuaugugcacacguuuuuauugaauguauucauaauauaggaauaguuuuugacauuauguggaauguuuuguuuaucacaaucuucauacuuacauguuuuaauauuuaguacuucaauuaggguaccuuauugauaauuuuguugcuauucugaguuugcuuuuaucuugaauaugguaaguaaugguguaggggacuacuuaauguauauuguuuuuaccuuuuuuuagcuauuuucuuuuuuuuuuugagauggagucuuucucuauugcccaggcuggaguauaguggugcgaucucagcucacugcaaccucugucucccgggcucuaaugauucuccugccucagccucccgaguagcugggauuacaggcacgcaccacuaugccuggcuaauuuuuguauuuuuaguagagaugggguuucgccacguuggccaggcuggucuugaacuccugaccucagguaauccacccaccuuggccucccaaagugcugggauuacaggcgugagccauugcaccuggccuuuucaguuauuuucuuagaaaugagguuguuuguucaaaggguuugaguauuuguauggauuuuaauguuuuuggcuauauguaacuuaaaaaucucuuuucuacuuugauccaugacagugaaaaagaaggaagagauagaaaaaaagacaaacagcauuugaaaaggaaaaaagaaucugauuuaccaucagcuauucuucaaacuagugguguuucugaauuuacuaaaaagagaagcaaacuaguacuuccugccccucagguaaucugauaaaagcaaauuuuucacuaugugaauuuauaugcuuauaucauuuauucagcaaauguuugaaggccuguguaccagguuugugcuggaugcucuuaagaaauucacaguuuaaugggugagacacacauaaaaacaaguaauugugggcuggcugugguggcccacaccuguuauuucagcacuuugggagaccaggacgggcggaucaccugaggucaggaguucaagacagaaggaguuccugcccagcauggugaaacccugucucuacugaaaauacaaaaauuaggcgggaugguggcacacaccuguaaucgcagcuacuugggaggcugaggcaggagaaucacuggaacccgggagguggagguugcagugagccaagauggugccauugcacuccagcuugggugacagagugagacucugucucaaaaaacaacaacaauaacaaaaaaaaacaaaaaaaaccccacaaguaauugugauauaguaugauaagauagcuucagcuucucuguauaaauuauuguaucagaucuuaaacugcucauaugaugguuugguaaguaauuaucagcucuuaacauuuugucaacaggguagggcuuuaggcuucuuuuuguagcugaugaggguaaaggugugguuuggcuuuguggacuuuaagcugccuucucccagggaauguuuuguuguguuaugcuuuucuuuuuugagacaacaguugugaaagucaaugugggaguuguggagaaaagcgauacaaacauucuuucauucagcuuauuacaggcuguauucuuuugacuuacuauaguuggucagaaacaugggaccuuaggguaaccuuuuuuuuuuuuuuugagacggagucuugcucugucgccaggcuggaguaccguggugccaucuaggcucacugcaaccuccgccuuccgcguucaagcgauucuccugccucagccuuccaaauagcuggaacuguaggcgugcgccaccaugccccgcuaauuuuuguauauuuacuagagacaggguuucaccauguuggccaggauggucuugauuucuugacuucgugagcuaccaucuacccaccucggccucccaaagugcugggauuauaggcaugagccaccgugcccagcuaacccuuuuuuuugucuguuuugaguaguacagcuuuguagaauuggacagauuuaauggugcagaagaaaggacuuaggagaccagaagaacucuuuucccacaugagcacauuggcugcaucaacacaagauucuugggcauaaacgaguuuugucauauccugacauuccuaguggggauauuuauuaaacugaaauuuugucuuuaauuuuuuucuuaguacaccuuaggauauuuauuuugguaaaauuacuaacacaacaccuuuagauuuucuuagggaucuuguggcucgcuggacccuuucugugugauauuuuaauugguuuucagucuuccuccuccaauuuuguauaaauacugcuauuuuacauucuugguacguuaauauguugauuugaaagaauuucaguauagagauacagccuuuguagcuugauucuauaucauaugugaauuuuccccucacauucuguagggaaggcuuucuaaagcuauauuauggaaacuuucaaagccacaaaaaagaugaguacuacugugaacuugugauauuaaucacacagcuucagcaauucauuuuucuggaauauggaaauuuaaagcugugucagcucucaguuaaaauguugguuuuuuuuuuuuuuucaauagagacaguuuugcuguguugcccagguaggucccgaacuccugggcucaaacaguuugcccuccucggccucccagaguguugggauuacaagugugagccacugugcccggccucaguuaaaauguugcuuacuaugauaauuguguccuuuuagauuucagaugcagaacuccaggaaguuguaaaaguaggccaagcgagugaaauugcacgucaaacugccgaggaaucuggcauaacaaauucugcuuccaguacacuuuugucugaguacaaugucaccaacaacagcguugcucuuagaacaccacgaacaccagcuucccaggacagaauucugcagguaacgugucacguaguagaaugaggcuuuuacuuuguuuauuguccuuagaaguaucaugcaggagaacuaagcgguuugguuguguuucuuuuaguguaaaugguuugaaacugaguccugaaugcauagaucuugcaauauuucuguaguagagaagcuaaauagauucagcaaucagguaguuuuauuuucacauuuauuaaaauucguaauuuuuugaagccagcccuucuaccuucauuagucuuuuguaccugucaguaaagcauaguuuuguaaaauuucacauugccugccaauccuagaaagaaagaaauacuuccuugcauuucuguacuuagcuucacauagugugcccgcaguucuacuuucuucccucucucuaacacgugggguagacacagcuuuguguguucccagggugucuguauaccagagaauauccaaaccuacaaaacauaguugggucuuuugguacacuuacaucucauuuccucaucucuaauagucaggaauauaauuuuaaggcuuugauucgcggcaaacaguuguguaaggcuuagcaagaaaaacacuugugccccucauccguagaggugccuguuacaacucuuuguuuuacuuaccgcuaaaagaucuuuguuacucauugaccauuuucaguuuuaggcauuaucuguuguuuuucuacguagaauuugacauuuggcuuucacacccucuguguccgucaugcauacauuuucuauuccccuauugucuguuauaauuugguuagcuuuauauucuugguuuaucuuaugacucuguaaauccuauucauugcuaaaccaugaauuaccuuauaauuuguguaaguuauacaaauauguaauauucguacauauaguuuguaauccauagcauaccauuguacuuugugguauaguauuuuguuuuucuuggagcuaauacuuguuuuauucaguugcuaaguuuuuugacuaagcaguaauucaacucuagacuacgcuggcugugucuguuuucucuaaccugugcugacuuuagauagucucaucuuuuugaagaaaucuuucuuagaacuuccgaauguucuugccuggacucauuauucuucagggcuuguuuauagcuuguucuuuugauuucccuucacugucacccuagagagucccuuggauccccucuuuccaggcucccaugucuuuggcuuucuugguuuacucccuuguucaaugaagaauaucauucaguagcuuucagagaaaggguucauaggagguagaauuuuuuuuuuuuuaguuuuuuuucauugauaaggaaaaauuguaucuauuuaugguguacaguaugauguuuugauauauguauaccuuauggaauggcuaagucaagcugguuaacaugggcauuacuucacauauuuaucauuuuuuugugguaagaacacuuaaaaucuacccuuagcaauguucaaauguacaguguacuguuauucacuauaaucacuguaauguauaauaucuugaacuuauuucuccugucuuacugaaauuuuguguccuuugacagauaucucccugguucccucaccccucagccucuaguaaccaccauuuuacucuuuuucugugaguuugacuuuuuuagaucccacaaauaaguaaaaucauggggaauuugucuuucuguaucuggcuuacuugauguaauguccuucaguuucauccauguugucacaaaugacaggauuucuuuuuuaaggcugaauaguauuuuauuguguuuauguaucacauauuuuuaaauucauuucuccacugguggacccuuagguuguuuccagagguagaauuuuucaagaucuugcauaucuguuaauuacuaaucuacccucuugguugauaguauaacuggguauagaaucccagauugcagugguuuuuguucacaguguugaagguagcacugcaaggucuucuggcuuccacuguugcucuugagaccuccuauacuguugaguuuguuaaaaguaaaccucguuuuuucuuuucuugaagcuuacauuaucuuacaugauuuaugaugcauguuucuuggugaaggucuuuuucaaccacuguggaucuuuucauuccagagacucauggccuucaauuuuguaaaauuauuuugaauuaaaauuguuuuucucccuuucauugaucucuuuaugaaccuccagguuuucuauuaauuccucugcaguuuucuaucuuacugauuuugauuuauuuguaggagguuuucucaauuuuaucuuuauucaguuuuuaauuuacuaucauauauguaauguuuaagagcuuuuuaaaauuuuguucaguauuuuuuuuuuuuaccaucucuuauuucaugaguaucuuauuucucugaggcuguuaaugaugguuuuguuuuuauaaguuuucuuuuccuugcauaguuucuaaguuuuuuguuuuguuuccuuucugucuuuccuuauggguauuuccucaaauguccggugcucuuugccugugucuagaaguggguggggggcaaucacaagcugauuggaagcuccuuagguguggguagggcuccuugacuccuggcuucccuggaggcugaucuggcugggauguuucacugggagaguucuugaugucaguguuaguucuuuugggucaguguuaguuguuuuugcuuagguuagucauauuccucagagaaguaauuuccagucuccuaucuacaggguauaaaguuggccagucucugggaaccuaguuggggaaaaaggcuggaugucuccaaucuaaaauuaaaaacuucugcuucauuucucuauuuucauagugauaauuuugcucuuaacucuuccugguauucucugguuuagaaaucuuuuuuguacucucuucagagaguaaagccccucuguuuuuuguaaauccugugagagacagagagagagagagagagagagagagagagugugugugugugugugacuaaaaauccuauagacuuuguuuuuuauuaucacucuuuuucuucucauuuuauauuguuucgugaaaguuuacaaaauuauggcacacuaguuauuagccagcucaaggcuuugaggaggucugaacauaggguuucucaaguaaauaaguaaaauaucuagcauaucagaagcuuuaaaaacaauaaugugaucuugcauuuauuuccuuggauucugaacacaaguaaggaauguguuucaggguguucaaggccagauaaagugucagauaagccuguucggacagacugggaaagagaaaaccuaaccacucacagaggaaauauggagggaccuaaacaguccagaauacagacaggaauccacuuaaacuguauagaccuguuaauaacagggggcaauaauggcuauagguauuguaagaaucccacuagccaucuucuccugguggcccugaagugauggagaugcuucugauagaggcucugucaguguuacauggcuuaguauugcucgugcaugugcagcacuuauccagcccuuucauuaaaauacagagcaugcuuuccugguucugucacuuuauccaugccucagccuuucagaugucuccacuucugugacagauaggaauaaccugucccccacuuuuuuuuuuuuucagacagggucucacucccauuacccaggcuggagugcaguggcaugaucacggccacugugcccagacaguuuuuuuacuuuuaguagagacaggguuucgccauauugccccaggcuggucucgaauuccuggguucaagugaucugcccgccuuggccucucagagugcuggggauuacaggcaugaaccacugcaccugaccccccacuuuuuucaguggugcuguuugaagaaguuugcaagugugaauauucacacuugaaauuaaaaaaaauaguuuuuuuuuuaauuuugggaaaaaauuacauuauaggacaauauaagggacauuuaauggaacuccuuucaugguuuuuaaacaguuuuauugagauaccauucuuacagaauucacccauuuuuacuguauuuaccgaguuguauaaccaucaccacagucaauuuuagaauaauuucuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagcugggauggucucgaucuccugaccucgugauccgcccgccucggccucccaaagugcugggauuacaggcgugagccaccgcgcccggcccaauuuuagaauaauuucaucauccagaaagaaaacccauacccauuagcaguuauuccccauuccccucaaaccugccaaguuuuuaggcacccauuaaucuacuuugugucucuauagaguucccuauucugcacauauauguaaaugaaaucauauaauauaugauguuuugugacuggcuuuuuucacuuugcauuauaucgucaagguucauccauguuguagcuuuuaucaguacuuuauuccuuuuugucauugcauaauauuccauuguaugaauauaccauguuuuguuuauccacuuaucagcugauagacacuugaguuguuucuaccuuuugacuguuaggaauaaugcugcuuugaacagauguuuguguggacauguuuuuuuccuuacucuugcauagauaccuaggaauggaauuacuggguccuauggugacuauguuuaacuuuaugaggaacugccagacuguuuuccaaagucgcugcaccauuuuauuuguuuauuuuugagacauggucuugcucuguugcccaggcuggagugcaguggugcagucauggcucaccgaagccuugaccucuugggcucaagugauccucccaacuuggccucccgaguagcugguacuacaggcaugcacuaccaggcccaauuaauuuucuaauuuuuuguagagaugggggucucacugugucgcccaggcuggucuugaacuccugaccucaagugauccuucugccucagccucccaaaacgcugggauuacaggcaucagccaccgugccuagcacauuguacguuuuuauuaggaauguggaaggguucuaauucuuuacauccucaccaacacuuguuuucugucuuuuugauuauagccaucuuguaaucaaacagauccuaguugugaagugauaucuuguguuuuugauuugcauuucccuaauagcuaaugacauuucaugugcuuauugguuauuuuuauaucuuuguuguuguuguuauugagacagggucuugcucugucacacaggcuggagugcaguggcaccauuauggcucacugcagacucaacuucucugguucaagcagcccucccaccacagccucucaaguugcugggacuacaggugugcaccacugugccuggcuaauuuuuuauuuuuguagagaugggaucucacuauguuguccaggcuagucuugaagaccuggguucaagcgauccucccaccuuggccucccaaaguguugggauuacaggcgugagccacugugccuggccuggccuguguguguguguguguguguguguguguguguguguguguguguguguauuuuuuuuuagaaauagcuauucaucuucuuuacucauuuuuaaauuggguuaucuuuuuuuuuuuuaauuuaaaaauuuuuuuuguagagacagggucuugcugguguuacguaggcugguuuugaacuccuggcuucaagauucucccacccgagucucccaaagugcuagaauuauauacgugaaccauugcaccugacuggguuuuuuauaauuguaagaguucuuuguauauucuggauauaaguuccuuaucugauauauaacuugcagauguuuccucucauuuuguagguuguguuuucacuuucuugauguucucauuugcaguacagaaggcuuauauuuucaugaaguauaguuuagcuaucuuuuucuuuuuugcuuaugcauuuaaucuuauccaagaaauucuuuccaacccugggucaugaagaguuauucccauguuuuuuccucagauuuuauaguuuuagugcuuacauuuaggucugugauccacuuugaguuaguuuuuuauguacuguuagguauggaucuaccuucauucuugggcauguggauauccaguuuuccuaacacaauuuguuguaaagacuguucuuuucccguuguauguucuuagcagcccuuaaaaaaaucaauugaccauuaauguaaggguuuauuucuggacuuucaauucugucucauugaucuauuaucuauccugugccaguaccacacugucuuaauuccuauagccuuguaguauccuuuuguguuuuuaauaggcuuuuuaacugauuguuaaagaauauugaaguaaugagugaauguuaacugggagcguaguaguuauuuugaaaaagcacaaaacagguuuagaaccugagccauaugcaguaaguuuggggcuuguaacuuuggauuucucuucuaaaagaugugggggaaguuauauauuuguuggaauuggguuuagcuguaacagaaaaccucuaacaguggccuaaauagaauagagguuuauuucuguuucauguucuaaguguugagagauaaaucaaacuggggcuuguguggcacucccuggugucagggaccugggcaccugcuuuuuuguccucccccaugucagguuucucuucuuaguuucuccuuguggcagguacagucgcugcagggccagccgucauguuugcauauagccugcaagaaggaggaaaaagggcacacccuuucccuucuuaagaacacaucucuugcacacaucauucugucuguccugcuggccagaacuuaggcacacauguccuagcuacuggggcaugugauauuuguucuggguagccagguggugguuaagaauugaggcuucuguuacuauggaggaagagaaugggugcuuggugacaagaagucucugccacaguaaaauaaaugucuacuaaugaaaaugauuaugauugguugaagcccuuuggaaccucuaagaugaacugacagaaguugagauuuagucuagucugugacauauuuuuuuguaaaauuuugauaaauuuuguuuucacuuugugagcuuuuauugguucagugucuguucuaugugugauaaaggcgguaccucuggcugcuguuguguguagcuagggguaagaggaguuuugcuucugucucuuggccuccucugauguagucuaggguauaucagucaagauuuaauuaaggaaacagaaccacuaggaaaaucauggaauaaggaauuuguuagaggaauuagucccauauacaguuaugggaaaagcagggcauuaaaggucugaaaaggaguguuaaagauuggagaaaggucaccagcccugguguggagugagucauagcuuacagggaaaucuggaggccaggcauggaagucuggaggguuguugacucuuugucacuacuguuucugugaguuugaagcagaagucuggucaccagggcugccuguaaaggaggagaauuggauauauggagcaguggggugcaaggacacacugaaacuugccagcuccucugcaagucugucacuaccucugaccaaugauggccuucagaguguagugguugcuacuucaccucugucaccucugcuucuccuucugccucuaccucuguuuuacuuuugaugaacucuacucaguaccaagauggaagaggauucugggaaacaucccaguguaaccacgucaacaaaggauaauucaccacauaggagacagcucucagaugcaccggcauuuuacugggccaaucucauacugggccaaacucccccacuccuuuagccacaccauuuuugggaguguugccuauuuguaauuuuggcacauaugauauuucacgucacccacucuuccaggaauauauacuuuugccauuugauucuuauuucuccucuuuccuaugcagaagaucuaagccuacauacguuucuuucuaguaaaugcuuuauauuuggaauagcaaaaaggacacacacagggccuuugauaaugugaaauucaagauuuuuuuucaugaauaaagauauacagaauaauggaauaagucuugcucugguuauuuucauuuugccucaaaauuuagugauuuagugcauuuuacuaugcuuaugacuucugugagucaggaauucagacagggcacagaaggagugguuagucugugcuccaugaugucuagggccuuaguaaggaggacucagcgguucugugugauuugauggauaggggauagagucauuuggagguguugucuuuccaugucuggugguugaugcuggcuguuggugggguggguccucagcugggaauguggagugaaucugcauguggucuuuccaugaggcuugggcuuucucauaguguaguggucucagaacaguugaacuucucacgugguaucucagggcuccacugugagugcggugggaagcugcguuauuuuuucuaaacuaaccugggaggucaagcauugucacuuuuguuguguucuguugguuucaggugaaucacaagcccaccuagauuuauggggagggaacauagacccuaccucuugauggaaggaguaucacaguuggauuuuaagaacaugaaacaugagagagaagguugugaccaucuuuggaaaauaaacuuugccacaggcccuaaguuggacauaaagagauuuauggguacaaagauagcacugaggacaggguuacagugaagggacuaaagagaacauggucaguucugccuaaagagaucagcaagacuucugaaagggaccugacccccacaaguuguuuucuugugcaguggaaagguugcuugggaguaucuuaaguucccaguagaagaaacagaccucagagauacuaaugaagacuggauagagaauucaguggugaagccagacuaaaacccaggcauucagacauuuggccuaagcugggaaauuugaauucuuguaauaguaauuucauaugugaggccacaaaagcacaccucuacacauaaaacuuuauuugauguauaaaacuucuuuuuaaauuuuauuauuauuauacuuuaaguuuuaggguacaugugcacaaugugcaggucuguuacauauguauacaugugccauguugcugugcugcacccauuaacuccucauuuaacauuagguauaucuccuaaugcuaucccuccccucuccccccacccuccaacaguccccggagugugauguuccccuuccuguguccauguguucucauuguucaguucccaccuaugagugagaacaugcgguguuugguuuuuuuguccuugugauaguuugcugagaaugaugguuuccaauuucauccaugucccuacaaaggacaugaacucaucauuuuuuauggcugcauaguauuccaugguguauaugugcuacauuuucuuaauccagucuaucauuguuggacauuuggguugguuccaagucuuugcuauugugaauagugccacaguaaacauacgugugcaugugucuuuauagcagcaugauuuauaauccuuuggguauauagccaguaaugggauggcugggucaaaugguauuucuaguucuagaucccugaggaaucgccacacugacuuccacaaugguugaacuaguuuacagucccaccagcaguguaaaaguguuccuauuucuccacauccucuccagcaccuguuuccugacuuuuuaaugauugccauucuaacuggugugagaugguaucuccuugugguuuugauuugcauuucucugauggccagugaugaugagcauuuuuucauguguuuuuuggcugcauaaaugucuucuuuugagaagugucuguucauauccuucgcccacuuuuugaugugguuguuuguuuuuuuuuuuuuuguaaauuuguuugaguucauuguagauucuggguauuagcucuuugucagaugaguagguugcgaaaauuuucucccauuuuguagguugccuguucacucugaugguaguuucuuuugcugugcagaagcucuuuaguuuaauuagaucccauuugucaguuuugucuuuuguugccauugcuuuugguguuuuagacaugaaguccuugcccaugccuauguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccaugauguauaacacuucuaaugugauguguuagauugauagaaggaauggaaacauugaaaucugccaugacugguauucauuuucucuguuagcuuucauugagaaaaugaguaaggauucugccugcuucaagauugguauaguaggaccagaagagauucugcaagucugucuaaacuuuuaaacuugcuucuuugucuucuuguuaaucaggaagcccagaaccucauggcccucaccaauguggacaccccauugaaagguggacuuaauaccccauugcaugagagugacuucucagguguaacuccacagcgacaaguuguacagacuccaaacacaguucucucuacuccauucagguauuguaaaugaacacguuuuuauuuuagaaaaacuugaauucaaggacuuagcauauuugcuuuaguaauguuuacggagaaugacuacuuauuguguuggauuuuccucuuugauuucuucuucauaguaauaaauaauaguguccaggaaaugguuaaauacuguggagugccucccccccuuucuuuaagauggagucucgcucuguuacccaggcuggagugcaguagcgcgaucucagcuuacggaaccccucugccucccggguucaagcgauucucgugccucagccuucugaguagcugggauuacagacauccgccaccaugccugucuaauuggaguguucuuuugcaaagcuucggauccuaucacguuauuuuugaauacuuuguauuugauuuuagaguagauugauucauuuuuaaugauuacuuugugaauuuuauuauguaauccuuuuauguauguauuacuauugcuuucccuccagcauuuuauuaugaaaauuucaggcauuuagaaagguugaaagaauguguggaaguuaucaguauugaaauggagucauuuauguuacauuuuaaugaaaaaggaacccucaugcgcguaugccuaugacagaaauuauugcagggaccuucugaaaaccacacaaauuccagauaaguugcuucugugaagacauugcccuaccaacagccaguacagguugagcaucccaaaucugaaaauccagaaugcuccaaaauccaaacuuuuuuuuuuuuuuuugagacggacuuuugcuuuucuugcccaggcuggagugcaguggcgcgaacucggcucaucacaaccuccgccuccuagguucaagcaauucuucugccuuggccucccgaguagcugggauuacaggcaugcgccgccaugccuggcuaauuuuguauuuuuaguagagacaggguuucucagugauggucaggcuggucucgaacuccugaccucagguaauccacccgccuuggccucccauagugcugguauuacaggugugagccacugcgccuggccaaaauccaaacuuuuugagcaccaacaugacacucaaaggaaacgcucauugaaacguuucagauuuugaauuuccugauuuggcaugcucaaccaguaaguauaaugcaguuauccccaaaucugaaaaaaucccauaucuaaaacucuucuggucccacauuucagauaagggauacucuuaucuauaccggcaaugaaaacaaaugccaccuccugugauaagucccuguaaccaauggucuuuguuucagaacaguuugcguagacuccucccuuguaucuuuaaaaacuucuccuugccccagcacccucaguuguaccuauggucugucauagcacacauaucccacacuguaaucccuugccguucccgaauaaacucuuuguuuuggagacccggucucucacccauuuaaguugacaaaugguaaagugaacauccauauacccaccacuuagauucuaagaucguuaauauuuuacuauauuugcuuuaucacauauccauccaccaauccaucauaauuuuuaaugcauuucgaaguaacuugcagguagcaguuuguuugaucccaaaacacuuccacaugcguuaacuagaauucaguauuucuuuauaacucuugcuuaguuuuaagcugcuguuuuuuaagaagaaucuuuaaaauacaaauguuauggaagcauguaguaggaaaauggaauuggaacuuacaaugguuggaaauauuugggguuuacuuugaauuuuaaguguuaagauaugucuuccuacugguuauuuaguagagaaagcacuucaggcuauuacacauaucaugacagcagaaccaagaagcauuggcagccagucuuaaacauuuaacacuucuugagagucuuguaagagagcauaaucccucauuuccuauguuuagucggcucucuguaucugaggauuccacaucugugaauucaaccaacuguggauaaaaaauauuccaaaaaacucaaacaguacaacaauaacaaauaacacaaauaaaaauacaauguaccaacuauuuauauagcauuuacauuguauuagguauuauaaguaaccuagagaugauuuaaaguacaugggaggaugugcauacguuauaugcaaauacgaugccguuuuauaucagggaguugaguaucugcagggaguugaguauugguccuggaaccaauccccgguggauacuuagggacaacuguaugucuugucucucaccuagauuguaaaauccuugggggugggaaccaugucuuaugugauaacaccuuaccuaucaggaauagcugucuggcagcaucaccguucugcaacacaccaauauacaggaaauaggcaaccaggaaaaaaaaagacuuugaauaauuaaaauauagguugcugcaaaaucuguggaucuuauuccuaggagaaucucuuaggccucacucaggaacuuacucauguuuagaugugauuucaaaagugugguguuugguuuccaaacaaaauguaaaaggaggaacuauuuaauaaaguguguacauuuguaauaaugacagugauagugaugugagaaccaacagcuugauagggagggaggagacaaauauacacaaaacucaaagagucaucuggggucauugagugugguggcccaccucccugcccacugcauguucuuagucgcccuaaugugccaagaaaagguugaaauaauguuuaguggacguaguuuaggaaggcaagaaaauaucaaauguagugauuauuguaagucaguaaaauaaaaauaccaugcuagcuagaccaaacauugauuuuaaccuagagauccuaacaaaaccagcuggacagaauuuugaaaucuuuauucuuuuuuuuuucuauauuuccugugaaauaauuuaugugaaaaacauuugaaagcacaauccaaauguaaguggcacuucuguuaauugggauuccugucuuucuaggacuccuucuaauggagcugaagggcugacuccccggaguggaacaacucccaaaccaguuauuaacucuacuccggguagaacuccucuucgagacaaguuaaacauuaaucccgaggauggaauggcagacuauagugaucccucuuacgugaagcagaugguaaaugucaauucccuuuuaauacucuuaaauuuuuuuuuaauaucucauggaugccaaauuaaaauuucuccuguuagugcauaucacauauaccuuaagaaucuauacaccuguggaugccagaaaaagaauuauuuguaagacuugaugaaagggaauauuuugggcucaaaacccaccuuucuuuaugcuuacuagguuugugaauauugauguucguuguugauuucacugaaguuuucuuuagcaagcugagguagaaagcuaacuguaaaaaguuaaguuuugcuucugcccguguuacugcguuuauuacuuugcuauugggccuuauuaucuaaugccacagaaaucauugugaaauuaaaaaaaaaacuucuaaugauacuggcuugucuucaguuuaaaauuaauucuaaccucauguauauauuugguugauuuauauauguuuuuuaaaguucaaauugauaucaacuaaagccaacucugaauggauacauaagaauuaaauagauuaagaaccucaugcaugcagagcaugcauuuggacauuugaggggaucuaaaguugaauaaagauguccuuuguccuaaggaaauuuauauucuggggagauugacaguacuaaacuaaguccaaaaauaauugcaauaucagaacagaauaagcccuuugaguaaaaccagugugcuuaggguaguuaaagaagggaauagucacauuuguuggguaacaggaaagccuuauuagaggagcuauguucugaaggagggugggggcugucucagauggagacuacaauaugaguaagcauggaggauguuuuagauauagcaacucaucuguuccucacaccugguacauguaagcacugaggauggaugggaaaacucuggguaccaggaggcuuuuuugggaaccaggacucuacuuucuuucuucugcaugggauuuaguauuuccauuaaaaauaaacacauacauacaaauucaaguaucuuuuagaguggauuuuauuaguccaaggacaaacuaacuuuugaaccuguucuuuucauuugcuguuaacuuucggugucagaaauguguucccucaaaguggucuuuuuuucugcccuggccucagaccuccuguuggaauaucccagaguaucuucagugaucacaagugaaaguuuuugguuggucuuaauguugggaagaaggggggauagaaaauaaacauaagacuugucuuagcucugaagucaggauuauuuuucuagaauuaauauuaggcugauuuuuuuugagacuuuuuuucucuuucuguaauuuuuaauuuuuguggauacauaguagguguguauauuuaugggguacaugagauaucuugauacaggcaugcauguguaauaaucauaucguggaaaaugggguauucauccccucaagcauuuaaccuuuguguuugaaaccauccaauuauucuuaguuauuuuaaaauguacaguuauuuugacuagagucacccuguugugcuaucaauuuuuaagagacucauaaaauacugguggaauguuuaauaugcaugaauugagaaggaccacuucuuuucuacaggaaagagaaucccgagaacaucuccguuuaggguuguugggccuuccugccccuaagaaugauuuugaaauuguucuaccagaaaaugccgagaaggagcuggaagaacgugaaauagaugauacuuacauugaagaugcugcugauguggaugcucgaaagcagguggguaacuguacugaaagaagcgugaguuuggcugaaugugucaguaggcuggaagaaugaagaauagccauuaaaugucccaagaucucuaccuaguccuuuuuaauauugaaaaaacuucuaaaguaaauaacuuaugucauuaauaauguauccucacauaauuaacauacucacaauauuuugaugagcauucuuaaaaauauauauauggaaauuuaaauacauucugucaaauucauuaugcuucucuaaaauacacauagguagucuuuuagacauugcuucaaucuagcaaagaaaagauguuauugguuagucuuaaaaacaaauacaucuugguuccuggguggugcgauguacgagccuguagucucagcugcucgagaggcugaggugggaggauucuuugggcccaggaguuugaauccaguccggggaacauaguaagaccucuaucuaaacuggaguuggaaauuuagauagagugugucaaaauaauauuaguaacacuuuguacuaauauaucuuauacguaauuacuuucucauuugcacguaacagcacagugauauaaauaggaucgguauuacagguugaacauugcuaauccaaaaauccaacaccugaaaugcuccaaaauucaaaacuuuuugagugccgacaugaagcucaaaagaaaugcucauugaagcuuuuuggauuagaguuaguauaaugcagauguuccagaaucugaaaaaaucagaaauccaagauacucugggcccagauauuucuaguaaggaauacucaacaagcucagaugaauugaggucucauggucucaacuuucucaggucucaugguggguaaguggugaauccuaaacuagaacugauauuuuaugaccccuuucaguagcugcaguccauugcuggaugauuuuagggaccuugaaucucaggggauuggagugagaaugacaucaguggaaacaauauuuuagaggggacccauguaaaugugcuuuucaguggggaacagaggaugauacuuuuuguguuuaguucucagcuacuuugaguuacauuuacuccuucagaaauggcaugaaauuuuaauguguuaucccacauuauucauaagaaucaggaaacaauacauuuuuuggcuggcuuuuugaguuaaaagucaguaauuuuggagugaaagggaagaaagaguuuugucgugggagucucuuuggaguuuagguuuuccauuuagaugagaaaaguuuguuacgugauauggauccaugcaaguuuggagaaugcucuaguagacauuggaagcucuuaguuucuauuauaaugagagugaauagacugauucauuucuguugccuuagcauugccuuucuacaaacuuaaaccgauuucuaaacuuuagcuauugaacacacaugaucuuacauaccaaaguguuuuuagcuuuacugagagauaucaaauacgcuauagcugcaauaaaggauauaaaaaucauuuuuuaggccauacgagaugcagagcguguaaaggaaaugaaacgaaugcauaaagcuguccagaaagaucugccaagaccaucagaaguaaguguuagaauuucugguuuaggaaguuuuaaguuucuuuuuauaugauugcugcguuuuacaucauucauaaagacuauaaaacaaaauuucaucuacuuucuggaauauagcaaaguaguucucaaauccaaucuuuaaaauguuucaguaguaccagaaagaauuuagaaggaaaaaaauggaaauugcuuuugaaaauguaaaaccgcuguuuaauucaugcuguaacagguaauaacauuaauauauuauagugauauguuugguaauuguauuuguuuuaaaauuuuagguaaaugaaacuauucuaagacccuuaaauguagaaccgccuuuaacagauuuacagaaaagugaagaacuaaucaaaaaagaaaugaucacaaugcuucauuaugaccuucuacaucacccuuaugaaccaucuggaaauaaaaaaggcaaaacuguaggguuugguaccaauaauucagagcacauuaccuaucuggaacauaauccuuaugaaaaguucuccaaagaagagcugaaaaagguaugauugagcuggaauauuucuucuugagauuuagguaguuguuaggugcuguguaucauggacaaauaaugaacuuauuuuucccuguugguauucauaaacaacugaaauguaugauuaggagaugcauguuuagauuaaguguuaugaaaaggacaugcuuuaaauaccuccaucccccguguucagugugauagaccuuuagcaaauaaacaccgccaggguguuuuugguucauggguauuaauggcuucguugacaguuguuacaguugccguuuucuguauucagcucugcuaucucugaauaaaaauuagaugccuuuaguacuuaaacaucacuuauuuagaauaauaugaagaggugagagagacuaauauaaaaauguuuauagauuaaaccuuuuagcuauugaaaggaaggaaguauuuuuuuuacugaauauauuccccucacaugauuucccccuacucuuuuggauaaggacaugaagaaaugauuucuuauaugaagucuguaucuggucuuuucuucuacaugcauuuuauuccuucuguuuugacagagcaaacaacugugauuguaaauagaaaucuccauaauuguauaagaagauacagugggucucaucguuggaagcagaguggucauuagcuuaaaagucuuuuuuucuuuagccuucagcccugaggagcagugauagaccuauggauuuggaaugagcugcuguauacuuaggauaaaacaaacaagauucuuacaaacucuccugucuucucuccugcauucuuccucuuucuucgcuuuucacaauuucuuacuuuguguuuucuuuauugcauaaguaauacauuauuuauuauaggauuuuuagaaaauagagaaaggaaggaggguuucgauuuauauuucaauaacuugucccugauuucagaauaacugagucacucauuuuuuaguaagugcaguagggaaacuaacaucuguugaguugccuacucugucgagcacauuuaaucauugaacugggauugagaaucaggcuacgaaauugauacuugcacaguuuccucuuuugaaagugaaaauaugaggggaagaggaauuuaggaaauaaauuuuccuaaauuguauguauggaaaccuaaaacaaggaucacauuguugcuuuuggagauucuguagaggguaaacccuaacacaauuuuugaaaaauaauaauucuaaguauugguuuguaauuguuugaaacaaaguagcuuaaauauucucucauauuuuaucuguguauaucucucuuuguuccaaaaagaauuugaagcagcuauuuaguuagcagauuauuuauggauaguuuaaagauaacuuagccauauucucucguaaugauuauaagaucugaacuuguaaauuuuuacucugugcaguuucagagugaaauagcauuucucuuuuaauaaacugucagauuuucuuuuucuuuaauauacuuuaagauauguuaacauugauuuguuuccauuauuucccuuaagguauuaaguguccauuuuuucuucuauagagaugauuuuccguuucuuuuguuaaaauuuuuuguuuaucaaucauuucucuugauuuuguagauuuugauguguuuauuuucauuauuacuggaaagauugaaagccuucuguaaggcacagaaggugguucccaguuuuucauaagccaugaagcaaagggcugggaaaaaauucauaugcuuauggaauucugugugucuggcauugggcuaggcucuauaguauauuguucacuuaauccuaauaacaaacacaucugaucuaaggucagcaucaucauugcuuggaaagcuguuuuucagcuuuccaggcugaaaaagcccugagaaaugggcucagauaaauuaagcaagcucaaagagcugcuucaaugguaaagcugugaucugaacccaggccuguccagcuuucccucucauucugucauuuuacacuauuuucuuuaguagugaacuaaacugguuuaugaucuaucaucuaauucgugccccagucucauuaucuggcaaugucagggcauuccuucaggaugagaaaaaugccaugugacaaaaagaugccuagcuccccuuuaccaucacgugagguccugcacacaugguggagugggagaguggaaggggcacacccaguggugccauuuguauucugccucaucugccuacuaacgauguggucuuaacaagugguugaaucucuaugagccuuaguuucauuagcuuuuuuuuuuuuuuuuuuuuuuuugagacugagucucacucuguugcacaggcuggggugcaguggcacgaucccagcucacugcagccuccaccuccuggguucaagggauucuugugccucagccuccugaguagcuaggauuacaggcaugugccacuacguccuacuaauuuuuacauuuuuaguagacacgagguuuugcuguguuaaccaggcuagucuugaacuccuggccucguuauccgcccaccucagccucccgaagugcugggaucauaggagggagccaccgugccuggccaaauuucauuagcuuuuaaaugagguuaauauuggcuaauuuguaaggugauuaugaucuuuggauauaauguagguaaaacuuuuaaaccuaguuucucacacacacaauagguaccugagaaaugauagcugcuguuauagugagugaaagcaaaggauguuuauacuuuugaggaaacauggaugcuugauuuuuaaaaagcagucugcauugacucaaaggcuucuuaagcuauuuuuccuagguauuguuauccacccuuccaaaaaacaaccaaccacaucuuggauuugacucaaggcaugagggaaaaaauuagucuucuaaagcucucuggauauggcaaguguuuguaguacuuaaacuuauugaaauuauuauuguaaacaggcccaggauguuuuggugcaggagauggaagugguuaaacaaggaaugagccauggagagcucucaagugaagcuuauaaccaggugugggaagaaugcuacagucaaguuuuauaucuuccugggcagagccgcuacacacgggccaaucuggcuaguaaaaaggacagaauugaaucacuugaaaagaggcucgaggu

SEQ ID NO: 16402 - RNA, 42205 nt, Homo sapiens
ucaaagcagaaggucgcgcuuggaggaaguggcggcuuugaguccgguggcccaaucgcuguuacuacuucucugaagcuccucucggcugcuugccgagacacccugccgccaagaugccucgaauuaugaucaaggggggcguauggaggaauaccgagguaagucuccuuuucccgccguccgcugcccgccgcucccucuagcagcuugugcgcacgcgcgcggaggucgggggggcgacgaggagacccuguggggucugcguggagggcagcccgggggcugacccuuggggcccuuuccgugugucuggccccguguugugcgagcgccaguaggacagggaccgugaugucaccaccuggcuacucggcuccaagcucacuuguuaggcccugagugaacauuuguugacuugaauacgcccccucccaccccgcccccccgccccccccggccccgggaagaacucagaguuccaacucagccagaguuggucccccggggcaccauccacucuuaguccaggcaccacgacucugucucauacucagaaauaaagaaguugccguggccacaacuuugugucuccauugacuuccuugcagaggggaagcaguuugagugccagguucagagagcccguuuaugcccgcaucucucugguuaucuguuaucagggcauaaccugucugccaucucgacagaucccaaggucugucucuuucugucacugccuuugccuagauagaagccagaaaggaaaaacuggccuaggauagucucuguuuccagaaacguaguggauagugccauuggugagccaaagggcaguagagugggagugaaauagaaauuagauuuuagugcguuuuguguucagaguguaccgaauuuaucaguuucuggagcacaucaugucuuuucaugcucugugucuuuuuuucguuacauuuuauggcuucuuuuuuuuuuuuuuuuuacaucuuuugccuuccuagcgcuugacaucuuucugaucauccuucaaaccuaguucggaaacacuucuuggaaucucuguaagaauuaauugcacccccgauauucucaugauaccuuuuucuuccguuuguuaaaacuugcuuugucuuuuuguaagcaucacauccucugugugguacucgguaaguuucuuaacuucugaaagccucaguuuucuacuuuuucuaaauugggauaauaauacuuaaccucucuugaggauuacacgaguuaauacguuuggaauauuuagaucagaguagggcacauaguagccucugaguaagagcuaguugcucuuucaccucaccagacagcauggcgagaggaccaggucuugguaucccuaggaccuaggacaguaaccaacaugaaguagguugcucgacagguauuugcagaaugaaucaaguagaguagguaucugcuguaucuauuuaauugaaaauguguuuaaguguaguuguacugcaaccaaguuacaaaaaagacaaugaaaacugccucagcuuccaccgagggaaccagacuguuuaaauuggagaagagaugacuucugagggagagacagauauaaaaucaaguaacaguaggauuccuaugcaguggucaaagcucugcagucuuuuuaaaaaguaucuuugaucaugggagauguagaggauggagugggguaucucaagaggcacguaccucaaauccaaugugggaaaaaaagccuagaaguaaaaucgccuaagugcaugcaucuauggcuccauuaacuuucuugucuuuggcuuggcuugccaggcuuccuugagguuggugcauuccacauggcaaugggugcccuggugaaaugguaucuagagauggggggaaauuggaaggagagcugacuagugggguugggguagaaauauguaauucuuagguuagaccugagauguggauucuugggucauaguugggguuaaggggcuggaggggaaaugccauguauaaacuugagacaggaggcuuggauuggagaauauauucaccagagucccaacuugcuucuugaggccuggauauguccuguuugauaagaccuuuccccaagggaaagguagauguuucaagguagauguucaggaaguguuuuuugagugaguguauaaaugaaugaguuauacauuuuuguuguuguuguguuuuuuaguuauccuuuuugaagagaaggacagccacacguugaagaauacuuuuucuuaauuuuugucauaaaguaggguuucucagauugggcuguucccacucccaauuuauuggagagugugguguaaggguggguagcugucuuucuaagggauuucuucuuaauuucucaauucuugguugcuguuauuauaguuaaugagguuuucauccuuagucuuuuaaccuaggugguguguaugugcauguuauaugucucuuucuccaauagcccuaucagaguuaauuuaaauuuugucuuuucccacuuggaguuuugugacugaauguacucuuuggcaauuuuuuuuaggaugaaauucugaaagcagcgguaaugaaauaugggaaaaaucaguggucuaggauugccucauugcugcauagaaaaucagcaaagcagugcaaagccagaugguauguaucaguuuaauaaguggaaaacagaaaaggagcuuaauuaugaugauggaaaaugucaacucugugaaccuuaucaaagaaagcagacauuguaauauaacaaggcauggagugggagauggaaguuggguguuugacuuagcugucacuugcuuccuguguggucuuaggcaagccauuuuucuaucccucuccccugcccuuguuuucucccaauuagggauaauaauacuugguccugacugauagagaugugaguugucaucuaaauggguuaauguauuugagagugcuuugugaagcauacaaagucuacuuucagggacagaugagccccagcuuguaaauuaauuguguucuaaaagugcauaaguuagcuguuuuagaaauuacuugcucaaagaaauaaaugauaaauaauggcuaauuuucuaaguaagccuacaguaguugaguuuccucauaauacaguugaaauauuauauauuuuauaguuaauauguuauauauuauauauuaaacauacuuaauguuauauauuauauauuaaacauauuuaauauguuauauauuauauauuaaacauauuuaauauguuauauauuauauauuaaacauauuuaauauguuauauauuauauauuaaacauauuuaauauguuauauauuauauauuaaacauauuuaauauguuauauauuauauauuaaacauuuaauauguuauauauuauauauuaaacauauuuaauauguuauauauuauauauuaaacauauuuaauauguuauauauuguauauauuaaacauauuuaauauguuauauauauuaaaagauauaagccaacucugaaccuguggugucaccucuuuuuuauuuuuauuuuuugggacggagucuugcucugucgcccaggcuggagugcaguggcgugaucucagcucacugcaagcuuugccucccggguucacgccauucuucugccauagccuccugaguagcugggacuacaggcuccugccaccauucccggcuaauuuuuuguauuuuuaguagagacggaguuucgccguguuagccaggauggucuugaucuccugaccucgugauccauccaccucggccucccagagugcugggauuacaggcgugagccaccgcgcccggcuggugucaccucuuaaaucauaggguaguggacacgugaagcuauuuaggguguucuuggcaugaguuauuuagcaccauccccaagucauguggcauuaggaaaauacuuuggauuguauaagaaugaccuaauuuccuaggcaccugguuaggggaaaguaucagaauguagaaauuggccaggcgugguggcucacaucuguaagccuagcacuucgggaggccaaggcugggaucaccugaggucaggaguuugagaccagccuggccaacauggugaaaaccccgucucuucuaaaaguacaaaaauuagccaggcgugguggcuacuugggaggcugaggugggaggaucgguugaacccaggagguggagguuguagugagcugagaugcugccacugcacuccagccugggcgacagagugaggcuuuuugaauguagaaauuggcuguuaagaggaagaugauuuuuaggcugaagaagucguucugauuucuguuugucuuagugguaccaguuccugcugucauauuugguaggacuuaaguccuguuugccugccugucauccagcuaaguagacuggauggaaaaggugggcuggguggggaauuaggaaagacagagggaaugucauaguaguuuuacuuaaauuuuaaaacauaucaaaugaaagguuacggugaauuuagugaguguaagucaaaugcuuaaagaaauaagccauggugugagaaucaaagcaugagaaaauaguaugaaaacuggaaacacuguaagaaacgugauuuuguauugucuuccaaauauuucaaaauuucuagaaaagcguaaauaaauaaaaacaugauagaugagaaagaaggcuuaugaucaugauucagugaaguaaccuuuuuuaaccauuacuaaucuugcauaauuaaaauaaaauagaaugugaugagauggggaauauugacugggguaaguguaaccacacagcaaauauucuguugucaaaaagaacaguuuuuguaauugaaggaugagagcacaagucaguguauccauugugcaaauuggauauuuaugccagguaacugauuaauauauaaaaugaucuauguuuaauagguaugaauggcuggauccaagcauuaagaagacagaaugguccagagaagaagaggaaaaacucuugcacuuggccaaguugaugccaacucaguggaggaccauugcuccaaucauuggaagaacagcggcccagugcuuagaacacuaugaauuucuucuguaagugagucuucagaaagagcauagaauauauguauauguucugaaagaggcugaauaaacuuugaguauuuucugucuuuaaacuuuuaauuauggaugugaguaaacccaaagcuaaagccauuggauaauauuuuccauaucucagaugguugaucaaaauuaugccuucugucauauacuuccuaaaauaauaauuuaaaagaauuauacaagucaugcauguucaucauagaaaaucuggggaaaaaauaguaaaagagcaaauaaaagucacccauaaucacacugcuaagaauuaacuacuggaacauuuugguucuuuacuaauaguuuuuuuuuuuuuuuuuuuuuuuuuaaauuuguauggcuguaccgcauuugugauuaggaucuguuuggguucuauuuuagagugauugaaaccagucacugaaaucagcaaauuuuaauaucauuucuuucagaugaagugauaguaaaaaggcuuuauguuguuaaagcccauccauugguuuuuuuggggggaaaaauaucgucagaacuuggaaaucugguaauuuuaacucuaaaugguacuguagugugacuaacuccuaugggcuuuuuucuagggauaaagcugcccaaagagacaaugaagaggaaacaacagaugauccacgaaaacuuaaaccuggagaaauagauccaaauccagaaacaaaaccagcgcggccugauccaauugauauggaugaggguaaguguaugcuuugaggaauuuauuucuuugguaacuguaaacuccuugggccucacucuuuuaguuccuuucugaacuccucuacuuuagaaucccuuuuuuuuuugagacaaggucuugcucuguuacccaggcuggaaugaaguggcacaaucaugguucacugcgguuuugaccuccugggcuuaagcaauccucccaucucagccuccugaguaguugggacuacagguuuaugccgccauaccuggcuaauuuuuaaauuuuuuuguagagauggggucucccuguguuacccaggcuggucucaaacuccugggcuuaagcuauccucccuuuucugccuccaaaaguguugagauuauaggugugagccaccauaccugauccccaauucugucagcaguguucuuauucuaaguaucuuuccaaauauguccaguguuuucuguuauagaguaguugcuuuuucugaacagcgccccuucaucuucuguuucuucaauucaguuaauuaaguuaauuaaguguuacgggguguggugguaugugccuguagugcuagcugcuaaggaaguugaggugggucgaucucuuuagcccaggaguuggaggccagucugggcaacauaaccccuugagcccagaaguuggaggccagccugggcagcauaacgagacccugucuuuaaaacugaguaguguaauucuacugaguagauuuuucagaggcuagaggugagcccuugaagauccuguuucucauuccuauuccauggagagagacaucaagucagaauauuggaccucaguccuccuauuaauuacuuauuugacuauaggcaaguuauuuauucugugugagaaggcaaccugugagacggugauggagacuuaacagugauucugggaggcauugaaucaggaauuccacaauagaaaguauauggaaucaaccuaaguguccauuaaugggugaauggauaaagaaaauguggacugggcaugguggcucacgccuguaaucccagcacguugggaggcugaggugggcagaucacuugagcccaggaguucaagaucagccuggccaacauggugaaacccugccucuauaaaaaaauacaaaaauuagccaggugugguggcgcaugccuguagauccagcuacuggggaggcugaggugggagaaucacuugagcccgggaggcuggguuugccaugagcugagaucaagcacugcacuccagccugggcaacagagcaggacccugucucaaaaaaaaaaaaaaaaaaaaaaaaaaaaaaugguauacacacacacacacacacacacacacacgaauacuauuuggucauaaaaagcaaugaaaucaugucauuugcagcaacauggauggcaguagaagucauuauguucagugaaauaagccaggcacagagagacaaauacugcauauucuuccucauaugugggagcuaaaagcguugaucucauggaguuagaauagagugauagaugccagaggcuggguauggugugugggugggagagcgggauuaagagagguugguuaauggguacaaacguagauggaaagaaauaaguuauaauguuugauagcagaauagggugacuauaguuagcaacaguguauuacauauuucaaaguagcuggaagagaggucugaaauaaauacucaaggugauggguaccccagauauacugacuugaucauuacacauucuaugcauguaacaaacucucacauguacccuauaaauauguaaaguaugauguaucaguuaacagaaucaggaauuggauuuucaacccgugugugccaccuauuagcuguuugaccuuagacaagucauaaaaucucucugagcuuugauucccuuucuugcgagauggggaauacuaauaccugcuuuaccuuagcaggguuguugugaagcacucagugaauauuuguuaaguuucuaaaauguaaaguuugaacauagugguucccaaaggcaggcuguggcuaggcuggcugcaucauuaucacagggggagcauuuaaaaauagaaauaucagggcuucuccuguauauacugagucaguacaucugggguggugugggaggcacgggaagagcagugaucuuggaaucugaguauuuuacaaguucccaugugauuuaguuggacagccuugcauaggaauuguucuaaggcaucaauaguggcauguauuauuccauucuauagagccacgaaaaauguauuggaugagagaaauuguucugaggggaaaaaaaaguaucuaaugauaguuguucucucauaauuaaauaguuuuuacccuauuucacaauuugugcugugccaguuaguugauaauaaugaaggauacaauaauuguagccacuguuuaaugaaugcuugcgagaugcuuuacauauuucguuuuacuuagcccuucucaaaauccuugugaaauaggaauuguuauucgaauuuuauagggaaaccaugcuuagggaggguaaguaagugacuaaggucacauagcuagcaaguggugggccugguuuuuaaccuagguucuuugacuucaaaacucaagcuguuuccauuaugcuacaccauaaaaucaguauuuuuauguuuuuuucucauuuugagcaauagagugucucuuacauaccuugcuucuagaguauguaagaacuaagaaaauacuuaguuuuucuucuuuuaauuuuugcagaugaacuugagaugcuuucugaagccagagcccgcuuggcuaauacucagggaaagaaggccaagaggaaagcaagagagaaacaauuggaagaagcaagguauguguggauauaggaauaaaaagcaaaguguuuuucucacauaacaaucaacacagaauacuucugugaccagauaugugguuuuuuuuuuuuuuuccccucuccaccagcaaucaggcaaucaauucugcaguggauagcuggguguccucuaauucaguuaacucuaauacugucuaccuggagauagcuccagaucuuacagguugaggacuuagucccacaagacugaaccccaguuuugaugcugacccuaaaccccagguuauuuugcuuguguuucugaccagcgagcuggguuccacugccccuuccuuggguuccauucaucugcuagaggacucacagaacucagggaaacacccacauuuacaaaggauauuuuaaaggauacaaaucaacggccccaugaagagauacacagggugaagccuggaaggguccugagugcaggugcuuaugucccauugaaguugggauaugccacccucccagccaguggguguguucuuguucaccuuuucggaagcccccauguauuuggcugcccacaaguucuccagacucuguccuuuuggguuuuuauggaggcuucauuaaauaggcaagauugauuacaucauuggccauugcuuaucaacucgaccuucagcccuucuccccuccccugagguuggggguuguggcugaaagucccaagcccucuaauccugccguggucuuucuggugacugccagcuaucagucaacucauuaacaugcagaaagacacuuuucacuuggaagagucccaggauuuuaggaguugcauuguuggaaacggaugaagaccaaauacauuauuucacaaugugugcuugucuccauucauaguucaauaauuagucuaggcauccuuaggaccaauaaaacugcaugauuuauuaacccguugggugaauaauaauuggaauuguccaguuccuauuucgcuaguauucuuuaccuucuuuauuucucugaaacuaucuuguauuuuuuucccccaaccauuucagaauauuuauagaaaaccauauuuaaaaaaaauugaagcuauggcagagguaaugcccaguuuauccaguauguugaguguguucuguuggcauaugagagcuucauuuguuguagcuauuuuggagucagaugacuguaggacacacaagauuaugugucuuuuguaugacugccaauuaguuacuuuccuugauugguauugggaaggcacuggcugugaaacaggaaacuuggcugaacaaagagggaauuaaugagcuuagaaccaaauuuuaggcccucauagaaaucuuuauuuaaaaaguaaacgaauauauauuacacauugucuuucacucaggauuuucuucacuuuccccuuuuuuccuuuugguuaaguccaugauugauaucaguucuaauagcccagaaaccaagaugaugucacuaaagggcaaaucuggacugugucacagcuuauuagcuucugggauucaggcccuagaauaaccucccuauccuguacagugccccuuguggcccccagguuggccugcugauucuucuugaccugaugaccagcauuauguuguaauuaauggcuuugaagugccagauccugggauggaggguuuuuuaaugucugaggaugcauguuggcagagcuggccaauugcuagccuagaaugguuagcuuauuuggggguauuagcugccggggacaguaaacagaaaccaagaggagguacuaacuuuuccaccauucuuggccaccucucuauucuguauacucuucagaguuaaguacugugaguaagguugaaaaaaaaucacuuuuccauuuuuauccaugguuguaggggaccaaauuuuuagagcccuuuaaccguguggauugggccagggacacagcaaaugcauaugugaaaaaucuccaaguguggcuagcauugauugcuuuaaauaaaauuugcagauuuuaauuuacccuguaauuucuuguaggcauucuuguagaaucuacacaucuuuguaaguuauauucuaacaggcuggaauggccucuaugcaaagugcagggcagggcuauuugcuuuuaaauguuaaauuacaaaucuaccuuguaacuuaaagcaguuuuuuauugauuauaaaaguaacacauuuuuccuucuaguauuguuaauguucucauuuugggacauagguaauauaaugcuauauggcuugguuauauucauuuagcauuauuguguaaagguuuucuaauguggauugaaguccuuauuuccauuauuuaaagaaugaaauuacuuuaaaauuugaaauacauuuuucuaaacuuuucucucucucaacauagaugugcauuuauguguauauauguacacuaacguuuauacaaaguuggaucauacuguacgguuuuaaugagaagucagcuguaaaucuuacugagauuuccuuguaaguguugaaucauuuuugucauacugcuuuuaauguuaauuuuaauuuuuuuuaagagagggucuuucucuguugccuaggcuuuagugcagaguucacugcagcccugcacaccugggcucaagcaguccucugccuuagcccccugaguagcuggaucuacagaugcacaccaccauucccaccuaauuaaaauuuuuuuuguugagacggagucucgcuauguugcccaggcuggucuugaacuccugaccucaagcuauccuccuuucuuggccucccaaagugcugggauugcaggugugagccacugugacuggccugucuuacugguuuuaaaucuucucgucuuuggcuuucaacauuuuuaauaugaugugucuguagauuucuuuuuguuuaucuuacuuggaguucauugagcuuacuggauguguagauuaauguuuuucaauaaauuuuucaaaauuucagccauuauauaucuucaaauauuuaauucugcuccuuucacuucucuccuuuugguaccccuguucugcuuauguugguguauuuaauagugccacauauuucucugaggcucuauucauguucuucauucuuuuucucuguuuagauugcauaauuguuacugcucuguuuuaaaguuuguuaauucuucugccaguuaacaucuacuguugagccucucuagugaaguuuacauuucagcuuuguacuuuguuuuguuuuguuuuuugagacggggucuugcucuguugccaggcuggagugcaguggugcgaucuaggcucacugcaagcuccaccucccggguucacgccauuuuccugccucagccuccugaguagcugggacuacaggugcccgccaccacacccggcuaauuuuuuguauuuuuaguagagacgguuucaccauguuggccaggauggucuugaucucuugaccucgugaucugccugccucggccuuccaaagugcugggauuacagugugagccaccacaccuggcuacuuuauuuuuuuuuaauuaaauaaauauuuuuuuucauuuuuguuauuccauuccuuuucuaaguuagcugauaagcuuugugcuuuugaauuugagaauuuccauuugguucuuuuuaagcauuucugucucuuuacugauauucucuguuugaugcaacguuguuaucauaccuuccuuuacuucuugguuuccuuuuguucuuggaacauaauggcuacuuucaaguuuguuaaucugacaucugguugcacucucaggcaguuuccguugcuugcauuuuuucuagcauaugggucauucuuuccuguuucuuugcaugucuuauaauuuuuuguuggaaacuagacauuuuagaugauauacuguagcaauuuuggguacucccccagccuucauuuauuauuugcuuguuuacuuguuugaugacugguuuauuuuauuuuauguuuuugagacggagucucgcucugucacccaggcuggagugcaguggcaugaucucggcucacugcaacuucuaccuccuggguucaaguaguucucuugcuucagccuccagaguagcugggauuacaggcacugucuaccgugccuggcuaauuuuuguauuuuuaauaaagacaggguuuccccauguuggccaggcuggucuugugaccucagaugauccaccugccuuggccucccaaaguccugggauuacagacaugagccagcgugucuggccaauuuuagucagucuauucuucccuuaccuccugugagaaaugugaagcaucugauguugcuccucacaggguaugcucacagucacccugggauagcaugguuugggcagcgcucucuuugacauuccuuucccuguuaaguuucacugauugccagcuguuuacuguguuguuuucaacaauguccuggggcauaaguugcacuacaaagugauccagucaaauuugggcuccuuugaagggaugcuuccugauaucaguguuugagauuuauucucaccccagaagggcuccucccagcucuuauucccuguuucucucuggcaaacuaguaggccuacagauuugguaucuccauuaagucugucaagcuuuuucccaacuugccuuuuaccagaacuuccacuguuuuugauaguacccuuaggcuagaacuucucuauacucuguugcaaugaaguccuuuuguuugaggagagauguggaucucucaguucuguguccugcuucuuccccagggcucugacaggacaugucuccaagugacagcccuacuuuauuagcugaguguuuggugggaaguaggggauggacagcagcccaagguuuccuuggcuugcccuccccguccguccgcccgcagcguggagcccucaucucauaagccagggcaaaggcuaucagggcuccaguauucucagcagcacuguguccaaagcuaggacuucuguuuggauggaggaaggaagcccacuuuucagccacucuugauggaacuuugccaccagaaauacugauguccuaauccuccuggaaugaaagcccuacuacugggagcuggaggggagaaggaguccuggguucuuggcugcacuuguguggaguggaaucuccauuccucugagcuggggggaaggagggagugggucuugguuuaaauauauauauuuuucucuuuuuuaaauuuaauuuaauuuuauuauuauuauacuuuaaguuuuaggguacaugugcacaaugugcagguuaguuacauauguauacaugugccaugcuggugugcugcacccauuaacucaucauuuagcauuagguauaucuccuaaagcuaucccuccccucuccccccaccccacaacaguccccagagcgugauguuccccuuccuguguccauguguucucauuguucaguucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaguaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauuuaaauauuauauucuuguguuucuuaccgaguuaaaguagauuuucuugauuuaauguuuauauauuugcuguaucugcuucagauccucuucagagacuuuaauugguuguuuuuaaaauauauguaauuuucaccauucucccuggguagugaguuuauggaguuccucaugcugucaugcuggaaguuacucauagauacuguuuuguaacuuguuuuccaucuuucauauugugaauagcuuuucuuaucacgaaaucauuacaguuauagcaacauaggaagaugcaaagaaaaaaaguaaaaauuaaauggaauuccacccuccaaugacuaucguuauuaauauuuugauggacauccuucauaucuccucaggcacauauucauugauagauaugcauacaguucuuauguguugcccuguaacauguaaacuuucuaacauuuuuuacacagugguaugucuugggccucuuuccauaucagaguagauuuauagccuuuuaaaaguuuauguaaaugucuguauaauaucuuauaaauucauuuaauuucuuacugauaguuguuuagauuguauccagcuaucuacuaucauaaacagugcuuagugaacagcuuuguaauuaaguccuuguucaugguguaacuuauuuccucaggcuaaaggcuaaggagugaaauugcugcucaaaaaauaugaaaaucuuuagacuaugaauguguauuucuaacuucucuuugggaagagaugcaccaauauacuuuuucauuaccagugcagcagacuguccauuuuuugcagccuugccguuaaaacaaaacaaaaaacugaaugguguuaauuagauaugcacaaaugguacuuguuaauuuaauuugugauucuuuaauuguuaaauaaaacuuuugucauuuuaguuaccugcauuuuuugcuuugugaauuguuuccuuuugcucuuuuuacacccuuugagugcauuaaaaaaaaaaaaaaacuuugcuuagacuguuuauauuuaaccaucauacuaguugcaaauauuuuuuccuacuauuugccuuuuaauuucauuuauaaauuuucauaguguuacaguuagaaguuuuauaucucaaagcuauucaauguauagaugaguggauuaaaaggaaaaaaaagcuguugauuuuuuucauuugccauuuauuuaauuuauauuuaguaaguacauuuccauccagagauaagauauguauuuacuuguaguuccuuuugguuuuucuuuuugccuuauuauguguaugugugugugcaccuuuaaauuaaaacuaggauuuguuuuggugaauggugugagguaaggauuuaaauaacuauuucuuccccaaauaaauagauacuuuuuuuuuaacuguaugggauaauuuaucccugucacauggcauaugauuuucaaagugauuuugcauucuuuucagacgucuugcugcccuccaaaaaagaagagaacuucgagcagcuggcauagaaauucagaagaaaagaaaaaggaagagaggaguugauuauaaugccgaaaucccauuugaaaaaaagccugcccuugguuuuuaugauacuucugaggaaaacuaccaagcucuugacgcagauuucaggaaauuaagacaacaggaucuugauggggagcuaagaucguaaguugccuuucugauuuuggaaauggaaaggaauaguaggaggagucuuacgaagggccaaguauuauccuugucagagccagauuuuuauuauuuauuuauuuuacauuuuuuaaaaucaauuuuuuuuuugagacagggucuugcuguguugcccaggcuggaguacaguggcacaaacacggcuuacugaagccuugaccuccugggcucaagcaauccucccaccucagccuccugaguagcuaggccuucaggugcacaccaccacaccuagcuaauuuuuuuuuauuguuuuguagggugggaucuccuuuuguugugcagacuggucucaaacuccugggcucaagcgauccuucuuaaaguguugggauuauaggcaucaguuacugugccuggccuagauuuuuauuaguacaauguggccuacauaugguuuuauuuauuuaauggauucaucuuucugagaaaaucagggacuguggcuaucacguuuuuagcacagaaugcuguuuauggcucuugaguugaaaugcauggcucucaauugacuguuuacucuuugaaucacaucuuaacuuuuauguacauuuaugaguagauuaguuuuacuaguggcugaggaaucugucaaaauugagucugguauuuuuagccuuaaaaaacaauuuuuuuuuuuaagacaaggucucacucuuaucacccaggcuggagugcaguggcaugaucacagcucacuguauccaccucccaggcucaagcaguccuuccaccucaaccucucaaguagcugggaguacagaugugugccaccaugacuggcuaauuuuuuauuuuuuguagagaggugggucuugccauguuauccaugcuggccuugaacuccuaggcucaagcuacccucccuuugcgucccucacaaaguguugggauuacaggcaugagucaccacuccuggcccuuuuagucuuuucuagugaaaaauuuuaccuuguuuuuauuaagaugaaauuaaaagaaaaaacuuacugauccuuucacuugaugggauaaauauacauuuauaaaaucuuuauguuuuagggcauagcagauuuucccuauuucuugagauuuuuaguuucuuuaaaucucauaucugaauauuguagggagaguauuuuaugguugucaaggguuuuuuaaaguuuucuacuccguugaccuuucauuucuguugacaugaauuguuacaaaacaacagcuaucagccauuguaaaauaggauuuucuuagauguacuccauuguauuuauuccucagauuaggacuuugcuuuagguaggcucuacaaauaaagagauugaacaggaaaacuauucauuuggaaggaguacuaagugggggaggcaagaaagacacacagaaggggaggagguauuccuggagcuuugaaagacugcuuugagccugucuuuaggcuuccuaaccauguuuagaugucacuugucaguauuaagacagccuuuuuaaaaaaguugugaauuuuaagaaucaugagaauuuaauaacaaguuuuaaagggaaauuuaauuauguuuuaauuuuauuucuuucauacacauuuuccuuuuuacauacuugucauacuuuuuccuaugugcacacguuuuuauugaauguauucauaauauaggaauaguuuuugacauuauguggaauguuuuguuuaucacaaucuucauacuuacauguuuuaauauuuaguacuucaauuaggguaccuuauugauaauuuuguugcuauucugaguuugcuuuuaucuugaauaugguaaguaaugguguaggggacuacuuaauguauauuguuuuuaccuuuuuuuagcuauuuucuuuuuuuuuuugagauggagucuuucucuauugcccaggcuggaguauaguggugcgaucucagcucacugcaaccucugucucccgggcucuaaugauucuccugccucagccucccgaguagcugggauuacaggcacgcaccacuaugccuggcuaauuuuuguauuuuuaguagagaugggguuucgccacguuggccaggcuggucuugaacuccugaccucagguaauccacccaccuuggccucccaaagugcugggauuacaggcgugagccauugcaccuggccuuuucaguuauuuucuuagaaaugagguuguuuguucaaaggguuugaguauuuguauggauuuuaauguuuuuggcuauauguaacuuaaaaaucucuuuucuacuuugauccaugacagugaaaaagaaggaagagauagaaaaaaagacaaacagcauuugaaaaggaaaaaagaaucugauuuaccaucagcuauucuucaaacuagugguguuucugaauuuacuaaaaagagaagcaaacuaguacuuccugccccucagguaaucugauaaaagcaaauuuuucacuaugugaauuuauaugcuuauaucauuuauucagcaaauguuugaaggccuguguaccagguuugugcuggaugcucuuaagaaauucacaguuuaaugggugagacacacauaaaaacaaguaauugugggcuggcugugguggcccacaccuguuauuucagcacuuugggagaccaggacgggcggaucaccugaggucaggaguucaagacagaaggaguuccugcccagcauggugaaacccugucucuacugaaaauacaaaaauuaggcgggaugguggcacacaccuguaaucgcagcuacuugggaggcugaggcaggagaaucacuggaacccgggagguggagguugcagugagccaagauggugccauugcacuccagcuugggugacagagugagacucugucucaaaaaacaacaacaauaacaaaaaaaaacaaaaaaaaccccacaaguaauugugauauaguaugauaagauagcuucagcuucucuguauaaauuauuguaucagaucuuaaacugcucauaugaugguuugguaaguaauuaucagcucuuaacauuuugucaacaggguagggcuuuaggcuucuuuuuguagcugaugaggguaaaggugugguuuggcuuuguggacuuuaagcugccuucucccagggaauguuuuguuguguuaugcuuuucuuuuuugagacaacaguugugaaagucaaugugggaguuguggagaaaagcgauacaaacauucuuucauucagcuuauuacaggcuguauucuuuugacuuacuauaguuggucagaaacaugggaccuuaggguaaccuuuuuuuuuuuuuuugagacggagucuugcucugucgccaggcuggaguaccguggugccaucuaggcucacugcaaccuccgccuuccgcguucaagcgauucuccugccucagccuuccaaauagcuggaacuguaggcgugcgccaccaugccccgcuaauuuuuguauauuuacuagagacaggguuucaccauguuggccaggauggucuugauuucuugacuucgugagcuaccaucuacccaccucggccucccaaagugcugggauuauaggcaugagccaccgugcccagcuaacccuuuuuuuugucuguuuugaguaguacagcuuuguagaauuggacagauuuaauggugcagaagaaaggacuuaggagaccagaagaacucuuuucccacaugagcacauuggcugcaucaacacaagauucuugggcauaaacgaguuuugucauauccugacauuccuaguggggauauuuauuaaacugaaauuuugucuuuaauuuuuuucuuaguacaccuuaggauauuuauuuugguaaaauuacuaacacaacaccuuuagauuuucuuagggaucuuguggcucgcuggacccuuucugugugauauuuuaauugguuuucagucuuccuccuccaauuuuguauaaauacugcuauuuuacauucuugguacguuaauauguugauuugaaagaauuucaguauagagauacagccuuuguagcuugauucuauaucauaugugaauuuuccccucacauucuguagggaaggcuuucuaaagcuauauuauggaaacuuucaaagccacaaaaaagaugaguacuacugugaacuugugauauuaaucacacagcuucagcaauucauuuuucuggaauauggaaauuuaaagcugugucagcucucaguuaaaauguugguuuuuuuuuuuuuuucaauagagacaguuuugcuguguugcccagguaggucccgaacuccugggcucaaacaguuugcccuccucggccucccagaguguugggauuacaagugugagccacugugcccggccucaguuaaaauguugcuuacuaugauaauuguguccuuuuagauuucagaugcagaacuccaggaaguuguaaaaguaggccaagcgagugaaauugcacgucaaacugccgaggaaucuggcauaacaaauucugcuuccaguacacuuuugucugaguacaaugucaccaacaacagcguugcucuuagaacaccacgaacaccagcuucccaggacagaauucugcagguaacgugucacguaguagaaugaggcuuuuacuuuguuuauuguccuuagaaguaucaugcaggagaacuaagcgguuugguuguguuucuuuuaguguaaaugguuugaaacugaguccugaaugcauagaucuugcaauauuucuguaguagagaagcuaaauagauucagcaaucagguaguuuuauuuucacauuuauuaaaauucguaauuuuuugaagccagcccuucuaccuucauuagucuuuuguaccugucaguaaagcauaguuuuguaaaauuucacauugccugccaauccuagaaagaaagaaauacuuccuugcauuucuguacuuagcuucacauagugugcccgcaguucuacuuucuucccucucucuaacacgugggguagacacagcuuuguguguucccagggugucuguauaccagagaauauccaaaccuacaaaacauaguugggucuuuugguacacuuacaucucauuuccucaucucuaauagucaggaauauaauuuuaaggcuuugauucgcggcaaacaguuguguaaggcuuagcaagaaaaacacuugugccccucauccguagaggugccuguuacaacucuuuguuuuacuuaccgcuaaaagaucuuuguuacucauugaccauuuucaguuuuaggcauuaucuguuguuuuucuacguagaauuugacauuuggcuuucacacccucuguguccgucaugcauacauuuucuauuccccuauugucuguuauaauuugguuagcuuuauauucuugguuuaucuuaugacucuguaaauccuauucauugcuaaaccaugaauuaccuuauaauuuguguaaguuauacaaauauguaauauucguacauauaguuuguaauccauagcauaccauuguacuuugugguauaguauuuuguuuuucuuggagcuaauacuuguuuuauucaguugcuaaguuuuuugacuaagcaguaauucaacucuagacuacgcuggcugugucuguuuucucuaaccugugcugacuuuagauagucucaucuuuuugaagaaaucuuucuuagaacuuccgaauguucuugccuggacucauuauucuucagggcuuguuuauagcuuguucuuuugauuucccuucacugucacccuagagagucccuuggauccccucuuuccaggcucccaugucuuuggcuuucuugguuuacucccuuguucaaugaagaauaucauucaguagcuuucagagaaaggguucauaggagguagaauuuuuuuuuuuuuaguuuuuuuucauugauaaggaaaaauuguaucuauuuaugguguacaguaugauguuuugauauauguauaccuuauggaauggcuaagucaagcugguuaacaugggcauuacuucacauauuuaucauuuuuuugugguaagaacacuuaaaaucuacccuuagcaauguucaaauguacaguguacuguuauucacuauaaucacuguaauguauaauaucuugaacuuauuucuccugucuuacugaaauuuuguguccuuugacagauaucucccugguucccucaccccucagccucuaguaaccaccauuuuacucuuuuucugugaguuugacuuuuuuagaucccacaaauaaguaaaaucauggggaauuugucuuucuguaucuggcuuacuugauguaauguccuucaguuucauccauguugucacaaaugacaggauuucuuuuuuaaggcugaauaguauuuuauuguguuuauguaucacauauuuuuaaauucauuucuccacugguggacccuuagguuguuuccagagguagaauuuuucaagaucuugcauaucuguuaauuacuaaucuacccucuugguugauaguauaacuggguauagaaucccagauugcagugguuuuuguucacaguguugaagguagcacugcaaggucuucuggcuuccacuguugcucuugagaccuccuauacuguugaguuuguuaaaaguaaaccucguuuuuucuuuucuugaagcuuacauuaucuuacaugauuuaugaugcauguuucuuggugaaggucuuuuucaaccacuguggaucuuuucauuccagagacucauggccuucaauuuuguaaaauuauuuugaauuaaaauuguuuuucucccuuucauugaucucuuuaugaaccuccagguuuucuauuaauuccucugcaguuuucuaucuuacugauuuugauuuauuuguaggagguuuucucaauuuuaucuuuauucaguuuuuaauuuacuaucauauauguaauguuuaagagcuuuuuaaaauuuuguucaguauuuuuuuuuuuuaccaucucuuauuucaugaguaucuuauuucucugaggcuguuaaugaugguuuuguuuuuauaaguuuucuuuuccuugcauaguuucuaaguuuuuuguuuuguuuccuuucugucuuuccuuauggguauuuccucaaauguccggugcucuuugccugugucuagaaguggguggggggcaaucacaagcugauuggaagcuccuuagguguggguagggcuccuugacuccuggcuucccuggaggcugaucuggcugggauguuucacugggagaguucuugaugucaguguuaguucuuuugggucaguguuaguuguuuuugcuuagguuagucauauuccucagagaaguaauuuccagucuccuaucuacaggguauaaaguuggccagucucugggaaccuaguuggggaaaaaggcuggaugucuccaaucuaaaauuaaaaacuucugcuucauuucucuauuuucauagugauaauuuugcucuuaacucuuccugguauucucugguuuagaaaucuuuuuuguacucucuucagagaguaaagccccucuguuuuuuguaaauccugugagagacagagagagagagagagagagagagagagagugugugugugugugugacuaaaaauccuauagacuuuguuuuuuauuaucacucuuuuucuucucauuuuauauuguuucgugaaaguuuacaaaauuauggcacacuaguuauuagccagcucaaggcuuugaggaggucugaacauaggguuucucaaguaaauaaguaaaauaucuagcauaucagaagcuuuaaaaacaauaaugugaucuugcauuuauuuccuuggauucugaacacaaguaaggaauguguuucaggguguucaaggccagauaaagugucagauaagccuguucggacagacugggaaagagaaaaccuaaccacucacagaggaaauauggagggaccuaaacaguccagaauacagacaggaauccacuuaaacuguauagaccuguuaauaacagggggcaauaauggcuauagguauuguaagaaucccacuagccaucuucuccugguggcccugaagugauggagaugcuucugauagaggcucugucaguguuacauggcuuaguauugcucgugcaugugcagcacuuauccagcccuuucauuaaaauacagagcaugcuuuccugguucugucacuuuauccaugccucagccuuucagaugucuccacuucugugacagauaggaauaaccugucccccacuuuuuuuuuuuuucagacagggucucacucccauuacccaggcuggagugcaguggcaugaucacggccacugugcccagacaguuuuuuuacuuuuaguagagacaggguuucgccauauugccccaggcuggucucgaauuccuggguucaagugaucugcccgccuuggccucucagagugcuggggauuacaggcaugaaccacugcaccugaccccccacuuuuuucaguggugcuguuugaagaaguuugcaagugugaauauucacacuugaaauuaaaaaaaauaguuuuuuuuuuaauuuugggaaaaaauuacauuauaggacaauauaagggacauuuaauggaacuccuuucaugguuuuuaaacaguuuuauugagauaccauucuuacagaauucacccauuuuuacuguauuuaccgaguuguauaaccaucaccacagucaauuuuagaauaauuucuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagcugggauggucucgaucuccugaccucgugauccgcccgccucggccucccaaagugcugggauuacaggcgugagccaccgcgcccggcccaauuuuagaauaauuucaucauccagaaagaaaacccauacccauuagcaguuauuccccauuccccucaaaccugccaaguuuuuaggcacccauuaaucuacuuugugucucuauagaguucccuauucugcacauauauguaaaugaaaucauauaauauaugauguuuugugacuggcuuuuuucacuuugcauuauaucgucaagguucauccauguuguagcuuuuaucaguacuuuauuccuuuuugucauugcauaauauuccauuguaugaauauaccauguuuuguuuauccacuuaucagcugauagacacuugaguuguuucuaccuuuugacuguuaggaauaaugcugcuuugaacagauguuuguguggacauguuuuuuuccuuacucuugcauagauaccuaggaauggaauuacuggguccuauggugacuauguuuaacuuuaugaggaacugccagacuguuuuccaaagucgcugcaccauuuuauuuguuuauuuuugagacauggucuugcucuguugcccaggcuggagugcaguggugcagucauggcucaccgaagccuugaccucuugggcucaagugauccucccaacuuggccucccgaguagcugguacuacaggcaugcacuaccaggcccaauuaauuuucuaauuuuuuguagagaugggggucucacugugucgcccaggcuggucuugaacuccugaccucaagugauccuucugccucagccucccaaaacgcugggauuacaggcaucagccaccgugccuagcacauuguacguuuuuauuaggaauguggaaggguucuaauucuuuacauccucaccaacacuuguuuucugucuuuuugauuauagccaucuuguaaucaaacagauccuaguugugaagugauaucuuguguuuuugauuugcauuucccuaauagcuaaugacauuucaugugcuuauugguuauuuuuauaucuuuguuguuguuguuauugagacagggucuugcucugucacacaggcuggagugcaguggcaccauuauggcucacugcagacucaacuucucugguucaagcagcccucccaccacagccucucaaguugcugggacuacaggugugcaccacugugccuggcuaauuuuuuauuuuuguagagaugggaucucacuauguuguccaggcuagucuugaagaccuggguucaagcgauccucccaccuuggccucccaaaguguugggauuacaggcgugagccacugugccuggccuggccuguguguguguguguguguguguguguguguguguguguguguguguguauuuuuuuuuagaaauagcuauucaucuucuuuacucauuuuuaaauuggguuaucuuuuuuuuuuuuaauuuaaaaauuuuuuuuguagagacagggucuugcugguguuacguaggcugguuuugaacuccuggcuucaagauucucccacccgagucucccaaagugcuagaauuauauacgugaaccauugcaccugacuggguuuuuuauaauuguaagaguucuuuguauauucuggauauaaguuccuuaucugauauauaacuugcagauguuuccucucauuuuguagguuguguuuucacuuucuugauguucucauuugcaguacagaaggcuuauauuuucaugaaguauaguuuagcuaucuuuuucuuuuuugcuuaugcauuuaaucuuauccaagaaauucuuuccaacccugggucaugaagaguuauucccauguuuuuuccucagauuuuauaguuuuagugcuuacauuuaggucugugauccacuuugaguuaguuuuuuauguacuguuagguauggaucuaccuucauucuugggcauguggauauccaguuuuccuaacacaauuuguuguaaagacuguucuuuucccguuguauguucuuagcagcccuuaaaaaaaucaauugaccauuaauguaaggguuuauuucuggacuuucaauucugucucauugaucuauuaucuauccugugccaguaccacacugucuuaauuccuauagccuuguaguauccuuuuguguuuuuaauaggcuuuuuaacugauuguuaaagaauauugaaguaaugagugaauguuaacugggagcguaguaguuauuuugaaaaagcacaaaacagguuuagaaccugagccauaugcaguaaguuuggggcuuguaacuuuggauuucucuucuaaaagaugugggggaaguuauauauuuguuggaauuggguuuagcuguaacagaaaaccucuaacaguggccuaaauagaauagagguuuauuucuguuucauguucuaaguguugagagauaaaucaaacuggggcuuguguggcacucccuggugucagggaccugggcaccugcuuuuuuguccucccccaugucagguuucucuucuuaguuucuccuuguggcagguacagucgcugcagggccagccgucauguuugcauauagccugcaagaaggaggaaaaagggcacacccuuucccuucuuaagaacacaucucuugcacacaucauucugucuguccugcuggccagaacuuaggcacacauguccuagcuacuggggcaugugauauuuguucuggguagccagguggugguuaagaauugaggcuucuguuacuauggaggaagagaaugggugcuuggugacaagaagucucugccacaguaaaauaaaugucuacuaaugaaaaugauuaugauugguugaagcccuuuggaaccucuaagaugaacugacagaaguugagauuuagucuagucugugacauauuuuuuuguaaaauuuugauaaauuuuguuuucacuuugugagcuuuuauugguucagugucuguucuaugugugauaaaggcgguaccucuggcugcuguuguguguagcuagggguaagaggaguuuugcuucugucucuuggccuccucugauguagucuaggguauaucagucaagauuuaauuaaggaaacagaaccacuaggaaaaucauggaauaaggaauuuguuagaggaauuagucccauauacaguuaugggaaaagcagggcauuaaaggucugaaaaggaguguuaaagauuggagaaaggucaccagcccugguguggagugagucauagcuuacagggaaaucuggaggccaggcauggaagucuggaggguuguugacucuuugucacuacuguuucugugaguuugaagcagaagucuggucaccagggcugccuguaaaggaggagaauuggauauauggagcaguggggugcaaggacacacugaaacuugccagcuccucugcaagucugucacuaccucugaccaaugauggccuucagaguguagugguugcuacuucaccucugucaccucugcuucuccuucugccucuaccucuguuuuacuuuugaugaacucuacucaguaccaagauggaagaggauucugggaaacaucccaguguaaccacgucaacaaaggauaauucaccacauaggagacagcucucagaugcaccggcauuuuacugggccaaucucauacugggccaaacucccccacuccuuuagccacaccauuuuugggaguguugccuauuuguaauuuuggcacauaugauauuucacgucacccacucuuccaggaauauauacuuuugccauuugauucuuauuucuccucuuuccuaugcagaagaucuaagccuacauacguuucuuucuaguaaaugcuuuauauuuggaauagcaaaaaggacacacacagggccuuugauaaugugaaauucaagauuuuuuuucaugaauaaagauauacagaauaauggaauaagucuugcucugguuauuuucauuuugccucaaaauuuagugauuuagugcauuuuacuaugcuuaugacuucugugagucaggaauucagacagggcacagaaggagugguuagucugugcuccaugaugucuagggccuuaguaaggaggacucagcgguucugugugauuugauggauaggggauagagucauuuggagguguugucuuuccaugucuggugguugaugcuggcuguuggugggguggguccucagcugggaauguggagugaaucugcauguggucuuuccaugaggcuugggcuuucucauaguguaguggucucagaacaguugaacuucucacgugguaucucagggcuccacugugagugcggugggaagcugcguuauuuuuucuaaacuaaccugggaggucaagcauugucacuuuuguuguguucuguugguuucaggugaaucacaagcccaccuagauuuauggggagggaacauagacccuaccucuugauggaaggaguaucacaguuggauuuuaagaacaugaaacaugagagagaagguugugaccaucuuuggaaaauaaacuuugccacaggcccuaaguuggacauaaagagauuuauggguacaaagauagcacugaggacaggguuacagugaagggacuaaagagaacauggucaguucugccuaaagagaucagcaagacuucugaaagggaccugacccccacaaguuguuuucuugugcaguggaaagguugcuugggaguaucuuaaguucccaguagaagaaacagaccucagagauacuaaugaagacuggauagagaauucaguggugaagccagacuaaaacccaggcauucagacauuuggccuaagcugggaaauuugaauucuuguaauaguaauuucauaugugaggccacaaaagcacaccucuacacauaaaacuuuauuugauguauaaaacuucuuuuuaaauuuuauuauuauuauacuuuaaguuuuaggguacaugugcacaaugugcaggucuguuacauauguauacaugugccauguugcugugcugcacccauuaacuccucauuuaacauuagguauaucuccuaaugcuaucccuccccucuccccccacccuccaacaguccccggagugugauguuccccuuccuguguccauguguucucauuguucaguucccaccuaugagugagaacaugcgguguuugguuuuuuuguccuugugauaguuugcugagaaugaugguuuccaauuucauccaugucccuacaaaggacaugaacucaucauuuuuuauggcugcauaguauuccaugguguauaugugcuacauuuucuuaauccagucuaucauuguuggacauuuggguugguuccaagucuuugcuauugugaauagugccacaguaaacauacgugugcaugugucuuuauagcagcaugauuuauaauccuuuggguauauagccaguaaugggauggcugggucaaaugguauuucuaguucuagaucccugaggaaucgccacacugacuuccacaaugguugaacuaguuuacagucccaccagcaguguaaaaguguuccuauuucuccacauccucuccagcaccuguuuccugacuuuuuaaugauugccauucuaacuggugugagaugguaucuccuugugguuuugauuugcauuucucugauggccagugaugaugagcauuuuuucauguguuuuuuggcugcauaaaugucuucuuuugagaagugucuguucauauccuucgcccacuuuuugaugugguuguuuguuuuuuuuuuuuuuguaaauuuguuugaguucauuguagauucuggguauuagcucuuugucagaugaguagguugcgaaaauuuucucccauuuuguagguugccuguucacucugaugguaguuucuuuugcugugcagaagcucuuuaguuuaauuagaucccauuugucaguuuugucuuuuguugccauugcuuuugguguuuuagacaugaaguccuugcccaugccuauguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccaugauguauaacacuucuaaugugauguguuagauugauagaaggaauggaaacauugaaaucugccaugacugguauucauuuucucuguuagcuuucauugagaaaaugaguaaggauucugccugcuucaagauugguauaguaggaccagaagagauucugcaagucugucuaaacuuuuaaacuugcuucuuugucuucuuguuaaucaggaagcccagaaccucauggcccucaccaauguggacaccccauugaaagguggacuuaauaccccauugcaugagagugacuucucagguguaacuccacagcgacaaguuguacagacuccaaacacaguucucucuacuccauucagguauuguaaaugaacacguuuuuauuuuagaaaaacuugaauucaaggacuuagcauauuugcuuuaguaauguuuacggagaaugacuacuuauuguguuggauuuuccucuuugauuucuucuucauaguaauaaauaauaguguccaggaaaugguuaaauacuguggagugccucccccccuuucuuuaagauggagucucgcucuguuacccaggcuggagugcaguagcgcgaucucagcuuacggaaccccucugccucccggguucaagcgauucucgugccucagccuucugaguagcugggauuacagacauccgccaccaugccugucuaauuggaguguucuuuugcaaagcuucggauccuaucacguuauuuuugaauacuuuguauuugauuuuagaguagauugauucauuuuuaaugauuacuuugugaauuuuauuauguaauccuuuuauguauguauuacuauugcuuucccuccagcauuuuauuaugaaaauuucaggcauuuagaaagguugaaagaauguguggaaguuaucaguauugaaauggagucauuuauguuacauuuuaaugaaaaaggaacccucaugcgcguaugccuaugacagaaauuauugcagggaccuucugaaaaccacacaaauuccagauaaguugcuucugugaagacauugcccuaccaacagccaguacagguugagcaucccaaaucugaaaauccagaaugcuccaaaauccaaacuuuuuuuuuuuuuuuugagacggacuuuugcuuuucuugcccaggcuggagugcaguggcgcgaacucggcucaucacaaccuccgccuccuagguucaagcaauucuucugccuuggccucccgaguagcugggauuacaggcaugcgccgccaugccuggcuaauuuuguauuuuuaguagagacaggguuucucagugauggucaggcuggucucgaacuccugaccucagguaauccacccgccuuggccucccauagugcugguauuacaggugugagccacugcgccuggccaaaauccaaacuuuuugagcaccaacaugacacucaaaggaaacgcucauugaaacguuucagauuuugaauuuccugauuuggcaugcucaaccaguaaguauaaugcaguuauccccaaaucugaaaaaaucccauaucuaaaacucuucuggucccacauuucagauaagggauacucuuaucuauaccggcaaugaaaacaaaugccaccuccugugauaagucccuguaaccaauggucuuuguuucagaacaguuugcguagacuccucccuuguaucuuuaaaaacuucuccuugccccagcacccucaguuguaccuauggucugucauagcacacauaucccacacuguaaucccuugccguucccgaauaaacucuuuguuuuggagacccggucucucacccauuuaaguugacaaaugguaaagugaacauccauauacccaccacuuagauucuaagaucguuaauauuuuacuauauuugcuuuaucacauauccauccaccaauccaucauaauuuuuaaugcauuucgaaguaacuugcagguagcaguuuguuugaucccaaaacacuuccacaugcguuaacuagaauucaguauuucuuuauaacucuugcuuaguuuuaagcugcuguuuuuuaagaagaaucuuuaaaauacaaauguuauggaagcauguaguaggaaaauggaauuggaacuuacaaugguuggaaauauuugggguuuacuuugaauuuuaaguguuaagauaugucuuccuacugguuauuuaguagagaaagcacuucaggcuauuacacauaucaugacagcagaaccaagaagcauuggcagccagucuuaaacauuuaacacuucuugagagucuuguaagagagcauaaucccucauuuccuauguuuagucggcucucuguaucugaggauuccacaucugugaauucaaccaacuguggauaaaaaauauuccaaaaaacucaaacaguacaacaauaacaaauaacacaaauaaaaauacaauguaccaacuauuuauauagcauuuacauuguauuagguauuauaaguaaccuagagaugauuuaaaguacaugggaggaugugcauacguuauaugcaaauacgaugccguuuuauaucagggaguugaguaucugcagggaguugaguauugguccuggaaccaauccccgguggauacuuagggacaacuguaugucuugucucucaccuagauuguaaaauccuugggggugggaaccaugucuuaugugauaacaccuuaccuaucaggaauagcugucuggcagcaucaccguucugcaacacaccaauauacaggaaauaggcaaccaggaaaaaaaaagacuuugaauaauuaaaauauagguugcugcaaaaucuguggaucuuauuccuaggagaaucucuuaggccucacucaggaacuuacucauguuuagaugugauuucaaaagugugguguuugguuuccaaacaaaauguaaaaggaggaacuauuuaauaaaguguguacauuuguaauaaugacagugauagugaugugagaaccaacagcuugauagggagggaggagacaaauauacacaaaacucaaagagucaucuggggucauugagugugguggcccaccucccugcccacugcauguucuuagucgcccuaaugugccaagaaaagguugaaauaauguuuaguggacguaguuuaggaaggcaagaaaauaucaaauguagugauuauuguaagucaguaaaauaaaaauaccaugcuagcuagaccaaacauugauuuuaaccuagagauccuaacaaaaccagcuggacagaauuuugaaaucuuuauucuuuuuuuuuucuauauuuccugugaaauaauuuaugugaaaaacauuugaaagcacaauccaaauguaaguggcacuucuguuaauugggauuccugucuuucuaggacuccuucuaauggagcugaagggcugacuccccggaguggaacaacucccaaaccaguuauuaacucuacuccggguagaacuccucuucgagacaaguuaaacauuaaucccgaggauggaauggcagacuauagugaucccucuuacgugaagcagaugguaaaugucaauucccuuuuaauacucuuaaauuuuuuuuuaauaucucauggaugccaaauuaaaauuucuccuguuagugcauaucacauauaccuuaagaaucuauacaccuguggaugccagaaaaagaauuauuuguaagacuugaugaaagggaauauuuugggcucaaaacccaccuuucuuuaugcuuacuagguuugugaauauugauguucguuguugauuucacugaaguuuucuuuagcaagcugagguagaaagcuaacuguaaaaaguuaaguuuugcuucugcccguguuacugcguuuauuacuuugcuauugggccuuauuaucuaaugccacagaaaucauugugaaauuaaaaaaaaaacuucuaaugauacuggcuugucuucaguuuaaaauuaauucuaaccucauguauauauuugguugauuuauauauguuuuuuaaaguucaaauugauaucaacuaaagccaacucugaauggauacauaagaauuaaauagauuaagaaccucaugcaugcagagcaugcauuuggacauuugaggggaucuaaaguugaauaaagauguccuuuguccuaaggaaauuuauauucuggggagauugacaguacuaaacuaaguccaaaaauaauugcaauaucagaacagaauaagcccuuugaguaaaaccagugugcuuaggguaguuaaagaagggaauagucacauuuguuggguaacaggaaagccuuauuagaggagcuauguucugaaggagggugggggcugucucagauggagacuacaauaugaguaagcauggaggauguuuuagauauagcaacucaucuguuccucacaccugguacauguaagcacugaggauggaugggaaaacucuggguaccaggaggcuuuuuugggaaccaggacucuacuuucuuucuucugcaugggauuuaguauuuccauuaaaaauaaacacauacauacaaauucaaguaucuuuuagaguggauuuuauuaguccaaggacaaacuaacuuuugaaccuguucuuuucauuugcuguuaacuuucggugucagaaauguguucccucaaaguggucuuuuuuucugcccuggccucagaccuccuguuggaauaucccagaguaucuucagugaucacaagugaaaguuuuugguuggucuuaauguugggaagaaggggggauagaaaauaaacauaagacuugucuuagcucugaagucaggauuauuuuucuagaauuaauauuaggcugauuuuuuuugagacuuuuuuucucuuucuguaauuuuuaauuuuuguggauacauaguagguguguauauuuaugggguacaugagauaucuugauacaggcaugcauguguaauaaucauaucguggaaaaugggguauucauccccucaagcauuuaaccuuuguguuugaaaccauccaauuauucuuaguuauuuuaaaauguacaguuauuuugacuagagucacccuguugugcuaucaauuuuuaagagacucauaaaauacugguggaauguuuaauaugcaugaauugagaaggaccacuucuuuucuacaggaaagagaaucccgagaacaucuccguuuaggguuguugggccuuccugccccuaagaaugauuuugaaauuguucuaccagaaaaugccgagaaggagcuggaagaacgugaaauagaugauacuuacauugaagaugcugcugauguggaugcucgaaagcagguggguaacuguacugaaagaagcgugaguuuggcugaaugugucaguaggcuggaagaaugaagaauagccauuaaaugucccaagaucucuaccuaguccuuuuuaauauugaaaaaacuucuaaaguaaauaacuuaugucauuaauaauguauccucacauaauuaacauacucacaauauuuugaugagcauucuuaaaaauauauauauggaaauuuaaauacauucugucaaauucauuaugcuucucuaaaauacacauagguagucuuuuagacauugcuucaaucuagcaaagaaaagauguuauugguuagucuuaaaaacaaauacaucuugguuccuggguggugcgauguacgagccuguagucucagcugcucgagaggcugaggugggaggauucuuugggcccaggaguuugaauccaguccggggaacauaguaagaccucuaucuaaacuggaguuggaaauuuagauagagugugucaaaauaauauuaguaacacuuuguacuaauauaucuuauacguaauuacuuucucauuugcacguaacagcacagugauauaaauaggaucgguauuacagguugaacauugcuaauccaaaaauccaacaccugaaaugcuccaaaauucaaaacuuuuugagugccgacaugaagcucaaaagaaaugcucauugaagcuuuuuggauuagaguuaguauaaugcagauguuccagaaucugaaaaaaucagaaauccaagauacucugggcccagauauuucuaguaaggaauacucaacaagcucagaugaauugaggucucauggucucaacuuucucaggucucaugguggguaaguggugaauccuaaacuagaacugauauuuuaugaccccuuucaguagcugcaguccauugcuggaugauuuuagggaccuugaaucucaggggauuggagugagaaugacaucaguggaaacaauauuuuagaggggacccauguaaaugugcuuuucaguggggaacagaggaugauacuuuuuguguuuaguucucagcuacuuugaguuacauuuacuccuucagaaauggcaugaaauuuuaauguguuaucccacauuauucauaagaaucaggaaacaauacauuuuuuggcuggcuuuuugaguuaaaagucaguaauuuuggagugaaagggaagaaagaguuuugucgugggagucucuuuggaguuuagguuuuccauuuagaugagaaaaguuuguuacgugauauggauccaugcaaguuuggagaaugcucuaguagacauuggaagcucuuaguuucuauuauaaugagagugaauagacugauucauuucuguugccuuagcauugccuuucuacaaacuuaaaccgauuucuaaacuuuagcuauugaacacacaugaucuuacauaccaaaguguuuuuagcuuuacugagagauaucaaauacgcuauagcugcaauaaaggauauaaaaaucauuuuuuaggccauacgagaugcagagcguguaaaggaaaugaaacgaaugcauaaagcuguccagaaagaucugccaagaccaucagaaguaaguguuagaauuucugguuuaggaaguuuuaaguuucuuuuuauaugauugcugcguuuuacaucauucauaaagacuauaaaacaaaauuucaucuacuuucuggaauauagcaaaguaguucucaaauccaaucuuuaaaauguuucaguaguaccagaaagaauuuagaaggaaaaaaauggaaauugcuuuugaaaauguaaaaccgcuguuuaauucaugcuguaacagguaauaacauuaauauauuauagugauauguuugguaauuguauuuguuuuaaaauuuuagguaaaugaaacuauucuaagacccuuaaauguagaaccgccuuuaacagauuuacagaaaagugaagaacuaaucaaaaaagaaaugaucacaaugcuucauuaugaccuucuacaucacccuuaugaaccaucuggaaauaaaaaaggcaaaacuguaggguuugguaccaauaauucagagcacauuaccuaucuggaacauaauccuuaugaaaaguucuccaaagaagagcugaaaaagguaugauugagcuggaauauuucuucuugagauuuagguaguuguuaggugcuguguaucauggacaaauaaugaacuuauuuuucccuguugguauucauaaacaacugaaauguaugauuaggagaugcauguuuagauuaaguguuaugaaaaggacaugcuuuaaauaccuccaucccccguguucagugugauagaccuuuagcaaauaaacaccgccaggguguuuuugguucauggguauuaauggcuucguugacaguuguuacaguugccguuuucuguauucagcucugcuaucucugaauaaaaauuagaugccuuuaguacuuaaacaucacuuauuuagaauaauaugaagaggugagagagacuaauauaaaaauguuuauagauuaaaccuuuuagcuauugaaaggaaggaaguauuuuuuuuacugaauauauuccccucacaugauuucccccuacucuuuuggauaaggacaugaagaaaugauuucuuauaugaagucuguaucuggucuuuucuucuacaugcauuuuauuccuucuguuuugacagagcaaacaacugugauuguaaauagaaaucuccauaauuguauaagaagauacagugggucucaucguuggaagcagaguggucauuagcuuaaaagucuuuuuuucuuuagccuucagcccugaggagcagugauagaccuauggauuuggaaugagcugcuguauacuuaggauaaaacaaacaagauucuuacaaacucuccugucuucucuccugcauucuuccucuuucuucgcuuuucacaauuucuuacuuuguguuuucuuuauugcauaaguaauacauuauuuauuauaggauuuuuagaaaauagagaaaggaaggaggguuucgauuuauauuucaauaacuugucccugauuucagaauaacugagucacucauuuuuuaguaagugcaguagggaaacuaacaucuguugaguugccuacucugucgagcacauuuaaucauugaacugggauugagaaucaggcuacgaaauugauacuugcacaguuuccucuuuugaaagugaaaauaugaggggaagaggaauuuaggaaauaaauuuuccuaaauuguauguauggaaaccuaaaacaaggaucacauuguugcuuuuggagauucuguagaggguaaacccuaacacaauuuuugaaaaauaauaauucuaaguauugguuuguaauuguuugaaacaaaguagcuuaaauauucucucauauuuuaucuguguauaucucucuuuguuccaaaaagaauuugaagcagcuauuuaguuagcagauuauuuauggauaguuuaaagauaacuuagccauauucucucguaaugauuauaagaucugaacuuguaaauuuuuacucugugcaguuucagagugaaauagcauuucucuuuuaauaaacugucagauuuucuuuuucuuuaauauacuuuaagauauguuaacauugauuuguuuccauuauuucccuuaagguauuaaguguccauuuuuucuucuauagagaugauuuuccguuucuuuuguuaaaauuuuuuguuuaucaaucauuucucuugauuuuguagauuuugauguguuuauuuucauuauuacuggaaagauugaaagccuucuguaaggcacagaaggugguucccaguuuuucauaagccaugaagcaaagggcugggaaaaaauucauaugcuuauggaauucugugugucuggcauugggcuaggcucuauaguauauuguucacuuaauccuaauaacaaacacaucugaucuaaggucagcaucaucauugcuuggaaagcuguuuuucagcuuuccaggcugaaaaagcccugagaaaugggcucagauaaauuaagcaagcucaaagagcugcuucaaugguaaagcugugaucugaacccaggccuguccagcuuucccucucauucugucauuuuacacuauuuucuuuaguagugaacuaaacugguuuaugaucuaucaucuaauucgugccccagucucauuaucuggcaaugucagggcauuccuucaggaugagaaaaaugccaugugacaaaaagaugccuagcuccccuuuaccaucacgugagguccugcacacaugguggagugggagaguggaaggggcacacccaguggugccauuuguauucugccucaucugccuacuaacgauguggucuuaacaagugguugaaucucuaugagccuuaguuucauuagcuuuuuuuuuuuuuuuuuuuuuuuugagacugagucucacucuguugcacaggcuggggugcaguggcacgaucccagcucacugcagccuccaccuccuggguucaagggauucuugugccucagccuccugaguagcuaggauuacaggcaugugccacuacguccuacuaauuuuuacauuuuuaguagacacgagguuuugcuguguuaaccaggcuagucuugaacuccuggccucguuauccgcccaccucagccucccgaagugcugggaucauaggagggagccaccgugccuggccaaauuucauuagcuuuuaaaugagguuaauauuggcuaauuuguaaggugauuaugaucuuuggauauaauguagguaaaacuuuuaaaccuaguuucucacacacacaauagguaccugagaaaugauagcugcuguuauagugagugaaagcaaaggauguuuauacuuuugaggaaacauggaugcuugauuuuuaaaaagcagucugcauugacucaaaggcuucuuaagcuauuuuuccuagguauuguuauccacccuuccaaaaaacaaccaaccacaucuuggauuugacucaaggcaugagggaaaaaauuagucuucuaaagcucucuggauauggcaaguguuuguaguacuuaaacuuauugaaauuauuauuguaaacaggcccaggauguuuuggugcaggagauggaagugguuaaacaaggaaugagccauggagagcucucaagugaagcuuauaaccaggugugggaagaaugcuacagucaaguuuuauaucuuccugggcagagccgcuacacacgggccaaucuggcuaguaaaaaggacagaauugaaucacuugaaaagaggcucgaggu

SEQ ID NO: 16403 - RNA, 2834 nt, Homo sapiens
acaugcauaaaauagcuuagcaacugagccaaagagaauaauaauuaauagagcucacucaagauugcccaucaagaaacaggagguuuguagcuuccagaaggaagaaaccacagauuuuuuuucauuuuuuuaaggcccaguuccugcagaguagaaaaaauuuucgacaagcuguguguuugcaagugacagauuuuacuuuccaauguucaaaucaucaccaagaaacuaagagacuuauccaggacugaacaguaagccaggggcaccacuggauuagaaacaagugcugagugucuaguuuauaaccaaaggagaccuguugccaugucucuccuuucuguuucugggggcuuacaugagaggagugagaggcaggcccagcaauagugaaagcugagcacauauccuaagaacacaaaugcuagcuugaagacccuggucccucucauuugagcccauuuauaucaaagucaaccccaaaggaaucuagaggccuuugucuucuagaaaacauuuugaaaaacaugauuugucuuuaugccucaacguuaucuuucuguuuauagaagccauaacuuaaagauacaaguucaugagguaagacuuaggagucuaaggaguucuccagcugagauauucugaaaguugauagagaguugauagaacaaucuuuucauaagguauaaauucuaucuauuuuucccuaaaaacaaacaaacagcaaccauucuugcuucuaauugggcaguacaaucugauagguuggcuagagacuugcaguggggugucccugguaccuauucaaagacuguagcuuucuucuaucucauucucauuuucuauucuuugcauuguagaguuuuggagcaaagaaggucaucaaacuuauacagugagccuaacaguuuccuuuuaagaugaggaaacugagccccagccagccaugugauucaucacaguuccuugguggcugaguugggaggagaacacacaucuucucagcuccucccacugcucuuuccauuaagacagacagccucucauucaaaguaagagaauuuccaucauaugagcaagggacaaugagagaacugcuucucaguacuccccgcuucuuccucaccuacuuccucuucacuggauuugucaacucaccugucuuuacgcaauaguuacaaugccagcauuucucuacauuacauacuucagcgauucucuuacuggcuuugcaaagucacccaaacacgaauggaaauaguaagguagaguuucagccaugaguugaguucauagcuuuagcaacuguuaaauagcuaaugucuacuuucuggagaauaaaugcuuugcaagacccucggcaaugaaaccaaagaaagaauuuaaauagccucaccgaauaauuagucagcuuuucgaagucaucucguuucuuuuuguugcuauugaaaaacuugacauucaugucuuccuugauggucuccacacucuuuuggaugcucuggucaucuuuaaaguuuuuaaaaaguuugaaguaaaaggagacaauuuggcucugcauuauuuuucugucacucuccuuggaaggaaagagcacaaacagaggaugaugugaauuuauccaucagaaagcaagcaacaggaaaauuagccaaaugggaauauucagcuuaccucuuuccaauucuucaaaaugccuaagaaaagaguuccauuauccgcuacaucugaaugaccugcauucuaaaaaaaaaaaaagaaaaaauugguuuacaauuagcccauaaauugccuuaaaaauauauuucaaguuucauugaacucagaugugacaauauucacugauuuccuuuucaacucuucugcuuaguucuaacaauaaguauucccaaaaggcuuaugugagauauagacaaagacuauuauguucuuuuagcuuuuuuauuucccaauauaaccauuaaauugcaaugucacaaaugagcucaacaaagcugauacuccaaaggucccaaaaacuauaguaagcuaaagaaaguauuuucaagcuaggcuaaaaaauacaaaaacaaaaaacagcaaagccaccccacuauaaaauacugccccccaaugguacagguuucuauuacaucuacugugccuuccuguaggguauuauuauacgagcuuuaaaagauaguuccaaacaugugcgagugugugugugugugugugugugugugugauuugauuuuguguuguaagaauaaaaucaauugugaaugucugaauauuauuaugacagcuauaauuauaacagcuaaguuuuaaacaaauaaugaaauauuuaaaauguaaaaacuuuucauuaaccaucaauaaaauuuuaaaagaaacucaaaaaauucacuuaaaauuuuuaaacauuccuuagccagaaucauaauucuuccaaaaucccagugagcaacgaaguuccggaauacuucacaaguaauauagauagagaagcagaauguugaaaucacuuuuuggagaaaaucaccuaucaguuauuuuuuuaagccaaagcuuuaaggaccuuuuugacuuuaauuuguaaacauuuccuauuaccuuuuuaaugcuaaucuugaccuuagagucugagaagucaaaaacuaauaaccaaucauuuuuuucaaucugcauacuccuugacuaucacaacugaaugaguucccaccacaaaauuauuaacaucauuaugcuucauacccauauuaugcccaucuuuuggaaaauucauaaaucccuuuuaagucucuauacaaacugagcagaagguuaaaacaauaucuagauuauuu

SEQ ID NO: 16404 - RNA, 737 nt, Homo sapiens
caagggggugccuugucacagccuucuccagagggaggaacacuguguccuuguaugguggaaggcagaaggcaagcaagccgacugcugugugaagccucuuuuauaaaggacuuaauucuauucaugagaggagggacccuuaugaccuaaucaucucuuaaagaccucaccucuuaguuucaacaccugauuuuagaggggacacauuaaaaccacaguagguuccuaaaaaugauugcccuucuuaugcuuaccuuaggcagaacccuagagaaugggccuugcuuaacgaagcaggaagcaaggauaauaaauuugcaugacaauauauuuuuaaaugcauggaaaaaauucaggcugguagcagauuaaucagcggaaugucaagacacuuuguuuaacaaucuccacccuccuccauguggccuuuccccuuacuugguccugcugauccaacaguagacuaacaaaguuggaagcagugaccugcucagucuucccuuuguugucuggaagucaggaccaguucuuauuuucagaugccuuugcaagauagcugguuuauauccugacuuuacauaccucuugaaaaucuuuuaaucggacacacuuuacagaaauucauucaucacacauuuuugagcacuugcuacguucuaugcaacuacaauagaugcuggaugacauaauagaugccagacagugugaagauacaaacuccuugacuucccauu

SEQ ID NO: 16405 - RNA, 15004 nt, Homo sapiens
ccucucacaguugaaguggcaaaaccugugaccuuugaacagaggcgcacugugugccacgcacgacgaggcgcggaugugagacgggaaagcaauuuuuuuuuggucuucaaggaaaagagagguuguauauggcgaauaaaaaaggcagggaaauucuccacgugucuuggaagggaagggggaaagagaugugucggguggggugagaggaauucgaggugucgcucccucaccgcagagcugaaaggaaggugugucucucccaguggccgcgcaggggaaaggcucggaguuguaaggaaauaggagaugucucugauguuuauuuuugccuagcaacccacagccaacugcuuccccagcugccguccacacgcgccucucugccuccccuuguccuagcgacuggcgagcggucacuuggugucaguaaaccggggagggugugugguggaggugggagggcagcccccucuuucgccccugcucagggucaacgagcucagcggccgccccucccgggacuugccucuccgaggugacccucgcacaacuaaguuaucuacaugaugaauuggggagaggggaguggcuaagucgcugggaccaagaauggggggacggggaagcaguacugucugugagcagccauucaguucgaagagcugaaaaugcauuuauguuuaggggugcgcauggcaggggaggggucucugcggcgcuuucggccggagggcagcagcgguagguugagcuguagggcagagaaggggcgccgcggggccggggaggggaaaaggucgccggaguggagccgagggaagcagugcagauggccggagggggcggaggagggcgagcggaggccgccgaguuuuccggggagcggaggggcggcugcgcgcaaaccgggggacugagaggagccgggcgggagguuggguggggguggggugugcguggccgcggccgggggagccgggggcggggccugcggcggcggaggagggcggcggagggcggcgggggcggggccgcgcgccggcgccugugugugagugcgcgggggcgcgcgcgcgcgggcccgggagaggcucccgagccaggcggucuucgguccucgcagcgcuuccagcuccccgcgccccuaugugagggagacggggaggcccgcggcgcgcaggggagggcgaggcaugugcacgggccggagggugcugcagccgcccgaggaagaggaggacggcggcgaggaggagagcggggggcucgcggcggcgggccccggccgaggggaugcaguggacugugugugucuggcuguagcagacgcgaggcggcgacgaggcgccggggacccgcgcgaggggcggccgggaggcggcggcggcggccgccagaaguagcagcaggaccggcggcggcgacggcagcccugaaaugcauuuuccucuccagcggccauguuaaccaggaaaccuucggccgccgcucccgccgccuacccgaccgguaaggaggccgugccgccgcgccgcauccccggacccccgccggcccugggcagccccuguggcgcgggcggccgcugccugcgggaccucgaacaaagucggcggcgcggcgcgggggagcccccgggcggacgacgcgccccgggcuccaugcaggguugugcgcggccccgaaggccccuccgcggggagcccucggcccgaagaggcuucugccugccgggggcccgggcggggaccguccaggccugccgccccgcccugcgcugcccggggcuuggcguggccguggcucccugcucagcuguccaaacccaccucccggcugcuggccgucugcaacgugggccgccuagccccggcgcggcccggcucccccgccgggucgcgaacucgcgcgccagggccccacuuaacuuugcagcugcccgcgccccgcccgugggugugcgcuggggagccgugacccgaacgcccguuuuuacugccccggucucuuccuccgucuuucuuuggaagaggguugucgcugcccagcgggguuggagggggggucugggugacuuucuccccccugacccucuuuugucuccucccgcacguggcuuccaggccgagguggggacagcgccguucgucagcuucaggcuuccccggggcucggugcaggggccacccggagcggaguggggacuggcccgcccucccccaucgcccugccgccucuccgggccagcaacgcugccgccgcagcccacacggugagacccagcccgcgggcggcccgggcggugggggcgggaggggccccaggccgaagcacccggacuuggaggggucugacgccgggagaagaggggucgagauacaagcagccccacgccucgggccgauggucucucgucgacgccgcccugguuaaguugggcgagcccaaagcugcagccacaaaggaagauucguggcgugggccccuuacuuccccuccagagcucgcccacccaugaccuccucuuccuaggaacuuccuccuugcugcuuuccuucuuuccucauuuuucguccuugcaucccagaguucccuucccugacccgguaaacaucucuguccuucccccaccuccccguggguaguggguauuuauagaaacagauacguguuaggggacagccagaccggccugcccggaaaaucgaucccccaaagagccucccaggccuggcuccagccagcagggagcaucgccaauugucccccgcguguguaagcauguuuuaugagugcuacagguuugagcacagcagaaauuguaaucaacauuaacaaaaauaagggccgccgcagcagucaaaacaagccaccccuguaggauucugcaguuggacauuauucaaaaggaaagggcaagcguugcuuuggaggugggaaagaaaaagcaccuaacaggugcuguggucucugggaggggagaggccagcgugggacugguugcugguggcugcggagacuggcaagcuggauucgacuaaagcauguaccuuuucucagcucccagggaucacccuuggauggugauggccagccuggaggaggucugcacuuggaggaggugaugguuuggaggucuuuuuuucccaauuggauuuuccacaggaacagccuaagaugguucugugugagggaggcuugcuagggauugguuuuauuugcuaagugaaaguugaguucuugaagaaaaggccaucuccggucuacaggggaguagcucuggggacauauguuauggggaaacuuguuugucagagaacugugaggggaugucuagacuguaguugcaccuguuagacuuggagagaugugugcaaguuucguaggaaaauguuuuguugcuguuacuaucuucccccucccucugucugucucucuauccugacacaucuggucccaggggcugggaauucauugcacagagguuaacuaaccuguguuggacuguggaugguauaguaggauggaugauucuguauauuacuguuaaguguucuugucacagugauauuuaagggacugccauugauuuuagggguuuggauuuuuuuguuugggaucaucugacaauuuggaaaauauaauacccaguuuuuugcuauguguugauguaaucacaugacauggugugagcuggaaaaagaacuauuugguuugcauguggauuccaauuuuguaaggaugggcuuugcuugaucagagccucuuugcaauugaaauacauguaaugaaaguagaugaaacgacaagucuccacuggagggagagccuguggugcaccagaaaaggaaggaugcgaaugugcuucucaguacuccucauaauggaggccuguauuuugcuguggcauaugccagauuuacuuguuuuuaacguguguguaaacuucgguaugcuguuaauuauuagaugcuugacuuugaaggugugaauuuggguuucgauggugguuuaguuuugauuuuauuucuauaacauagcagauuucauaguacaggaaagguuacaaggaccacagaguuuaucugguucuauucuuucaauuuauagaugaggaaacagacucagacaagguaacugguuucaucaagauuccccagccaguucauaucaaggccagagugaaagccuacauccuccugcaucuaguuuuaauauacugauggagacugcuaauucuaggaaauuguacuagccucauuauaaaugcaagaaccuuuguagauccauauucccauaugucugucagauuuuuauaaauuuuuaguuauuauuuccagaguaauuacaccuaggaagaacuucuagaaugaauggggggcgggagggcauuaaggagauaaaaaugaucuugucauaggagcuugcccacauuuucucuuacaggugauauaguaggcagguuaaauauaugauuauaaagauuauaaacuuuggaauuuaucuagaccauugcccuuuuguuuuauaucuccauguauaaguuguuuuacacuuuaguuauuucuguuugugugagagagagaagugugcccaaucacugucuuacuuccuauuauuuuucuauuaauguuaauugguaguuauuaauagaaguauuuuuaaauucaaaaauauuaaaauauguauaacuuuuguaacuguuuuacuauguaaaacacuccaguuaucaguuuuaccuuuauaaaauaauucaaauugaaauacacauuuuaaaaaauggcaguauuuugaagaagaaaaaguagacauuuuucuuucugacagggccacacagacugucagaauguuugaggaggagcuaaaauuccagucuuuuuggacucaauucuauuaccauaauacuauacagcauuucuaagaugacuucagaaaaguuuuuaaacgcccaagacuauuaucacaguggaauaucugcuguuugccauuuucuuauuggaagaaaugaaaacuaccaaacugguuagacuauuguuuuuauauaauauuuaauaccaaaguacuugaugaucaaagaagccuuugcaggucucucaauucgaacccauaaauuguagcuauuuuaacaauuguauuauguuuuuauuuuuuguuuuguuuuguuuuguuuuuuugagacggagucucacucuguugcccaggcuggagugcaguggcuccaucucggcucacugcaaccuccgccuccgggguucaagcgauucucuugccuuagccacccaaguagcugggauuacaggcacccgccaccaugccuggcuaauuuuuguauuuuuaguagagaugggguuucaccauguuggccagguugguuaugaacuccugaccucaaaugauccaccugccucagccucccaaagugcugggauuacaggauugagccccugugcccggccucaguauguauuuuuaaaugugacacacacugugcuauacauuggcauaucggaauaagccaugaucucagacuucaagaggcugagcuggagggagagguuuuuaguauccuuaaguuuaugauguagucuugacauacguauucuggaaauguucuggcauuucuagucccucagcacccccacccugcucucugccccauuuuuuauaagucaguuaauugugcuuuugagcuugauugugauuuuagaguccugcaauguuugagauucaaagucuucuuuugcuagagcuucucaaaugaaucucuaacaucuggaaagcuuuuaagauugcauguguugcuuuuagguguuugguugauguguuuguugcaaguguuuuauacaugguuugauugaugugucugcuacagguacuuuaugcuuggagguccuuggccuccaagucugugcggauccacugcaagccuaacgucuugugacuuaggucaccagggacguuucuuaauucccugggccuugacuucauguuuccuuaugaagguacacaauguaguucucaggaacaacuccaagagaggcaagaguuaacaaggaggaucuauuggcauguguucuuccaucccaaagauauuuauugagggcuuacuauaugccuggguuuauguuaaugaggacuuggaaacauaagaggggacccagcccuggaauugcucacagccagaugaguacaucugauguuaaaacaauugcaauaaagagaaauaaguaaaagggugaaucaccuagguaugagaaaggagauuacaagaaauaucuggaaaggacaauaauaaugcucucauugacugacuacuaagcacuuuacacauauuaccuuauuuaaucccccuaaaagcccuaaugagguaacuuuguuaccuucuuuuugcagacaagggcacugagguuaacagagaugaaauaaguugcccugggucacacauuuaguaaaugguggagcuggaucauuuaaugugugucuaacugaaaaucuaccauuaugaaaccugaccucacuaaaagcagaggaguguaaaagugugugguguuuuuuggguccugggcuaucuagcuuuguucucuuggagagaagagugacaguaguugaugagaauggaaggacuccgaucauuuagccucuacauuuuagagccuuguguucuuacugguaaguucuugcauuagcuauggaaauagguuacagccacaggccuugggcaaaagcaagaguggucucagguugagacuuuuaaaucagacucuagaagcacuauggagaagagauuugaggaauucuagacuuagaagcaagggggcauguuacgaugcugccucaguugucccagugaaagacaucaggagagugagaugaggcaguguugauggaaagggccugggauaguaaugaugcaucuucuuggugacuugggaaggugagggagguguugagauuuuccaggcacacagugcugaggauucauucgcagguggauagccugagugacacauggaggggaagccuucuuuuuaucaaaaauggaggauuauggaagugggaaacugguuuguuagaaaaaucaugaguuaaguuugaguugcuuaugggagagggagcugaucgauaguuggauaugugugucuuccacucaggagauagcaccuuggaaggucugagcucagggaacaaaugcgcaaacaucaggccaugggcaguugcugaagcccuggcuguguucaggaucaguugcaggggguuaugggaguaagaagccaagagaaucgagauuugaacccuggggaacucuugaauccaccuaagguuagguaguaguugaugcugcaaaggagaccaagagaaggcaguuggagauauagaagauggucguuucuugucagucucguuaguuuuaguuacuaaaacauuugugaucauguauuaaauuaugcgaaacacaaaaauugcuugaaguaaauuucugaggcuugguuuuacuuugcuguguuuuuagaaaucucuaaagccccaagguuaauuuuguccuaaugaagagcuuuaugcuuuuuauagcauguauacagguaaugugaauuuuucugcugaaauaucaccacuccacucuaaagaaaaugauucuauaggagagagauauuuugauucaggccccuuuauugucugguguuugaaagaccacaguggacaggagagggugcagagagcgaggcuggggaagagaagcauuggacaagccuguaccucuuuuauauaugcccaagacuugccugauucauuuuuauggacugcccugcuuuuggcauagaacaaggguaaaauaaccuuucuagcuacucuuauugaauauaaggucaccuagcauggaguaucaucuaugagugugauaaaaaagcucaguuauaagucuaagaaaugauaucccugagccuaugaagucacagucagacaggccccaaguauugucuucuguuuuguuuuaguuagaagugggcagagaggaagcucacacuccacauagucauugugcauauuauguauccaauaaagaaaaugugaacgucuuggucugcuaguaagaaggaguuggaauuucauuuuguaauccagguguucccaaaucauguuuugaauuacuguguuacauauacagagcccuucugcucuuucaguaguauguaaagccccaaagguaggauuuaaaaggggauaguagaaaaaauacugauggcaguggacuucaucuaguuaauuguaaguuccuggagggcagggacucugucacuuuggcagccagccuccuguuaauaccaguugacugaaugagguggauugugaugacaaggugguguaagauuucauacagaaaucaccugccaggcugcuuuaagacuagggguuguccaaggcaggaauuccuaacugggagaggauccuggcugccaguccucuccuaccccuuaccucucagcagccauaaugcuuaaaggaaaucccaagaagauucucaguagagggcuggggucccuugguucacaccauugauagaauuuagacaggaauguucagggauggcaugcauaccugaaacagagguugcuucuuuggauuccuauuuggaaaucugaguaucccagcagcuuguagaaauggacaucuucagagagcugagccacugaccccuccggaggaaggccaaacaguguggucguugcuugguuuguugggcugaaugccuuaaaugguuauuacaguuaguaaagccuggaaacuuuuaaaaauaggucagggguccauaagauacuaugguacacaucuacaugggaaucuuucaagucuaaaaacacaggguuuuuguuuuugucacuggaucaugugugcacuuagguuucaucagauuuucaaggaaaggggaaauacuggugaugaaguguuuucaggauagagcucuagguauuagggaaagaguagugaacaagacagacauggucccugucuucauguuaauaaacuacuagaugaaauaugaaaggugcugugaucuggggguggaggagccaacauagagucuuaugugugcauguuuuuuucuguauccuguuucauuuuuguaucaaauguggauugaguggaacaccuaugaugugccaggcccuauacuaaguguuagauauagaaugauaaaguuaaggucucugucuccguggggaacccugaauauguacagcaaaccaucuugucuguuaggcauggcauuuaugagguccauuuuucaggaucacauguuuuguggcuuuuacucaaaccaaaugggauuuuguaaaugugagguugggggcggugguguuguuggggguuacuuauacaccauuugaacagacaccacuucuuuucuauuuauauuuccugucugaauuccagauuggcggcaguaagcacacaaugaaugaucaccugcaugucggcagccacgcucacggacagauccagguucaacaguuguuugaggauaacaguaacaagcggacagugcucacgacacaaccaaaugggcuuacaacagugggcaaaacgggcuugccaguggugccagagcggcagcuggacagcauucauagacggcaggggagcuccaccucucuaaaguccauggaaggcauggggaaggugaaagccacccccaugacaccugaacaagcaaugaagcaauacaugcaaaaacucacagccuucgaacaccaugagauuuucagcuacccugaaauauauuucuugggucuaaaugcuaagaagcgccagggcaugacaggugggcccaacaaugguggcuaugaugaugaccagggaucauaugugcaggugccccacgaucacguggcuuacagguaugagguccucaaggucauugggaaggggagcuuugggcagguggucaaggccuacgaucacaaaguccaccagcacguggcccuaaagauggugcggaaugagaagcgcuuccaccggcaagcagcggaggagauccgaauccuggaacaccugcggaagcaggacaaggauaacacaaugaaugucauccauaugcuggagaauuucaccuuccgcaaccacaucugcaugacguuugagcugcugagcaugaaccucuaugagcucaucaagaagaauaaauuccagggcuucagucugccuuugguucgcaaguuugcccacucgauucugcagugcuuggaugcuuugcacaaaaacagaauaauucacugugaccuuaagcccgagaacauuuuguuaaagcagcaggguagaagcgguauuaaaguaauugauuuuggcuccaguuguuacgagcaucagcgugucuacacguacauccagucgcguuuuuaccgggcuccagaagugauccuuggggccagguauggcaugcccauugauauguggagccugggcugcauuuuagcagagcuccugacggguuacccccucuugccuggggaagaugaaggggaccagcuggccuguaugauugaacuguugggcaugcccucacagaaacugcuggaugcauccaaacgagccaaaaauuuugugagcuccaaggguuauccccguuacugcacugucacgacucucucagauggcucugugguccuaaacggaggccguucccggagggggaaacugaggggcccaccggagagcagagagugggggaacgcgcugaaggggugugaugauccccuuuuccuugacuucuuaaaacaguguuuagagugggauccugcagugcgcaugaccccaggccaggcuuugcggcaccccuggcugaggaggcgguugccaaagccucccaccggggagaaaacgucagugaaaaggauaacugagagcaccggugcuaucacaucuauauccaaguuaccuccaccuucuagcucagcuuccaaacugaggacuaauuuggcgcagaugacagaugccaaugggaauauucagcagaggacaguguugccaaaacuuguuagcugagcucacguccccugaugcugguaaccugaaagauacgacauugcugagccuuacuggguugaaaaggaguagcucagaccuguuuuuauuugcucaauaacucuacucauuuguaucuuuucagcacuuaauuuuaauguaagaaaguuguucauuuuguuuuuauaaaauacaugaggacaaugcuuuaaguuuuuauacuuucagaaacuuuuuguguucuaaaaguacaaugagccuuacuguauuuaguguggcagaauaauaacaucaguggcaggccacugauuacuucaugacugccacgcauuuacagauuggugucaaagacauucacuauguuuuuaugguucauguuauauccuccccagggugacagccccuuaaggcccuccuuuucccuccaugcuccagguccaugcacagguguagcauguccugcuuccguuuuucauaaauuaaucuggguguuggggguagugggaggagaacggucagaaucaaagugacauucuaagaaaaacuguaccuuagagauuuuccucuagugcucaaacaaauacaaaauaagauccccaagguuuaaacugcccaguuagcauucugacauucuaaaagccggcaaagcagcuuuuaguggauaaaugggaauggaaacguguguguuccuccaaauuuucuaguaugaucggugagcuguuuuguaaagaagccucauauuacagaguugcuuuugcaccuaaauuuagaauuguauuccaugaacuguuccucccuuuucucugcuuuucuccucucuguuccucuuuuaauaccacacgucuguugcuugcauuuaguuugucuucuuccuucagcuguguaucccagacuguuaauacagaaaagagacauuucagcugugauuaugaccauuguuucauauuccaauuaaaaaaagaacagcagccuagcuacuuaagguggggauuuccauaguuccaaagaagauuuagcagauuagagugaguucacacuuuucaggugccacuguaagguucucucagccugggaaacuaucaacucuuucuuuaaaaagaaagaggguugaaaauccucuggacgaacagaagucacuuuggcuguucaguaaggccaauguuaacaacacguuuagaggaggaaaaguucaaccucaaguuaaaugguuugacuuauucuucguaucauuagaagaaccccagagauagcauuccucuauuuuauuuuacuuucuuuuggauugcacugauuguuuuugugggaaugacacuuuaucuggcaaaguaacugagaguuugguaaaagaauauuuucuucucugaauaauaauuauuuucacagugaaaauuucaguauuuuaucacuaauguaugagcaaugaucuauaucaauuucaaggcacgugaaaaaaauuuuuuaguaugugcaauuuaauauagaaagauuucugccuguuuggacaauagguuuuggguaguacagauuaggauaaguaagcuuauauaugcacagagauuauuguauuaccuguaaauugauuuacaaguacuuaaaagcgugguccccagugaggccaagaaaguuuccgguuaaguucuuuaauaauaauccuacaguuuaucuuaagaaaaaaaaaaagguuugaaaaaaacacuuuaauuuaggcuucguugguugaugguggaaaaaaaugcucaggaaauauuucagauauuugccaaaaaaccaguaauaagguuaccuuauuaaaauagugauauuugcuuuacuauuuaaggugucacugauaaauuaauuuguacuucuguguuuagaaauuauagcuucuuuucccuuagucaaauuuuuuagcauauuauacacauuucuguguaaucuguggaagugcaauaauauguuaguaaguuacauuuuaaauaaugcucaugugacaauacucccaaucaauggcuuauagaauuuaaagaucuguauauuagauuuuggcuuaaaggcaugagaaguauaagacuugguuugguggcuuuguaagaccaccagccucuuaaugaugguuagcuucuuuaggucauuaaaucaauaaaaacauauaaugcuguuuugcucuucuaaugcuccucuuccauuuccaguuaucuucacauuuacauuuaaauauacaaaccugagccugccauuauuaauuucccuauaaaaugacgauacaugugaacauuuauaaauggacuaauacugcuugucuuucccccaccgcacaaaacugguucuuaagaugccagcaaugaauuugagacuaucuuuauuuauaaauggaaaccggaaacuuuuauaccaaacuauaauaaugugcagcacuguagggcuuuuuuuuuuuucccuccaaauacagugaaauuuuuuuauucacaagagcugccacaucucagcauuuaguaauagagcugcuuuaauaaaauucuaguuugauugucaugucaaaaaaagaaaaauguugcaucuuugugauuuuaaaacauaaauuaaugaaggcucugauaggcuauuaggaguuggcuuggaaacaguuuuuggucucacagguuaccauuguuuggggaugucugagcuguuuucagaucuaggaauagcacaguguugucuugucuuuggcagucucauuuggcucuguuucuugcaccaccagcguguucauuaccacuuaaauauauugcuacagcaguggaacaacagaguggugcaagacacuguagauuaacgguagaggagaaauugugcccuuaguguuaacaaugugccuuuuguucugaaugccauguuguagggcaugcauuuuuuggccucuuuaacucuucgaauucuagucaguaagaauggaacccaucucugcaaagauacaucugucuuaaauaucuaguuacaggccuuaauagaaaccauaaggcaugacucaucuucaggcacugaaaaaagauaaccaucagguaguguuacacaaggacuuccuauauuuaagggguuaaagauggucuuuguuguaucuuaacaucagacugauuuuuacauuuuuuuuuuguuaugcuaacacuagacaaaaaucaacuguauuuguaaaaauuuaccucaaaccauuuaauuuuauagugugauuaaucccagggcauuugguaugaaccaaagugcauuccuuuuauaugugccuggcucuaguaaggauggccagggauuuuuacaauuugggugcaaggcacuuaagccacuuuuaaacuuaaugggugguuuggggucguguuaaaugacuccaucagaauguuagaaaacacuuuaggcaucaguagcauugggccauauuggaauccuaaagugugaauuauuuuaaggagagcauucauuuuuguaauuuuuuucaucaaaaauauuucugguaagcagaagacuuuuuaaaaaaacugaucuggucucgguaaagguuuuaauauugcccaacauaaugcuguaauagcauuaaaaaaaguauuugugaacucuguuucuuaggggcuuguacaucucucugcuauggacauacauaaaauuaauuguaauuauacucagcucaacugcuacaguucugucuaggcaguggcuuggguuuuuaucgagcaacaacuuagacacgugacuguaauaugcugcaacuguguguacugaaaauaugugaaaaugguugaauguggacuguguauauauguauguaaaaauuucugugagaugcugcugucgccacuuaacauuaaauauguucuaguggauuuuaauccuaguggccaguucuaugauacuguauguauuauacagcugaugacaggaguaagacuguuuagugaauaucuguuaaauuuuauuguuguggccagagauaauuucagaauaaaauuuuaauguccuaccuuacuucucu

SEQ ID NO: 16406 - RNA, 16121 nt, Homo sapiens
ucauuuaucuuaaguuagaagcuucagauuuaugacuugauugaccuccugauauaauugaauagaaaaacauuccucuuuagacugaagacauugaauuucuauuuccaccuccaggaagcagcugauuauguugucacauuauuauuuuaaagagcagcuuaauauaaaguaugccaaagcuguuguuauuuuaacaaaauaacaaaauaauucuccaacaaugauaagcaaugccuuccugaagccuaguucauuuaguuguguguaugggagaauguuuuaagguuaauuucaguuggaagaucuuugaugcauuauugcugcugaaaaccagauguuuuacuggaacauuacugaggguuuuuuuuguuguuguuuuguuuuuuucugagguugugauaccuguugcuaagauauucaggcuugugucaucucuggugauauuuucuaaacuguauuccauaagacauuaaucuugcaaaaugcuccaauaaauggggacauugugauuagauaaguuuacugcacaugcugugccuacuuugggagguccacauugcuugugagcuaauuaaaagcuuugagaaguuuuggaguaaagaaauacauggauaaagaguauuauuuguuaugguauuuuggaguuucaagcacuuguuucagguacuaaagcagauccaaagcugcuuuuugaggccaauuuuugcccuagaugcuguggcggccgacuuguuuggcaaccucuuauccaggugaagauuguaggcaguuuuucagcuucuauaauggaguguuaauuuugcacauucauguuugguauuugaaguucuuucaggcaugaacacgugguaccugcauuauggguuuuuucauuagaguuuaaacuugagguaacuuccaucuauauccuguaacagccacaccugaguagagaaagaaaauaauagucaugccuuuucuauuaauuuagguuccgcucauaaauuaaugaucaugguucaugagagagagauauuccuugacuucuucgauuguagcccccacaaaaauacccucacuagaugacauuaauguuauuuucuuaaauuuuauugaagauauauguaauacauaacauuguuaggauuauuuuuucagucuucuauugcauauuuuuguugaagacauauuacuaaaugugccuuauuuaaauuccccuuauuaauacuccuugauaaagucuguuugaaauauaguaauaaaauauuuguuuuucccuuaaaaaguauuuuauccuaucagauaugaaucaaauauaauugaauauuuuuucauguuuuuucuuuuugccuaggcugccaggaagaucaaagucacauuuaauacacaucaaacaucauaguaauaucuauacauuuuuuuuagaaaacaggcuucuguauuucuucaauuccuuugguacuuaaauuuuguagugaaagugaaauacuuaauauuuaaagucuguguccagaaaauuaaucuugaaaccauuugaauggauacauuuuuucauagauauaacauuauauguguguuagauuucacacuggccuucagagcuuccuaauccaguaauagcuuuguaauauauacauagaaauuaugauuaaaaaagaaauacuccuauguuuuauaaaauuaaguaugccaacauuuuggaauauuauuuaaacugaucauuuuuuaaaaguuguaaucauuacaaaguaaaacuaaaauguaaugaaacauagaugcuggcuaugaaauccagagauguagguaauauuauuuuauuuuaaaaauguagauugauguaauuacuuuuucuagaguaagcugaagaugcagguuuauucagcgaaaaccagagauauaguuauuguaggcaacauaucucagaugcuggugccaggaauugauggcagcugguugcacacuguguucacuccaguguugcucagugcauugaacuaaguauuguuaauaagggaugacacauugaacaugccaacaaaguaacaucaguaaaauauuucaauauacuuguauguuuuuggacacccucuauauuuucauuaauuuugcaugauaagaaaggaagaaaaaugagcccuaaugaucugugguuauauuuuauuauauccaauuucaucuacauacuauuuucuugauucuaggagagcaccaggaacugcucuuacaauuaucccaaauaaagcucucacauaguaggagucauuucuucaaaccuucucucucccaaaauauacucccuuuuuuucuuaguuacauggagccaugauauaauaauuauaaacaaaggguaugccuagagaguagaaugccaggagaagagaaugaugacugaacuccaaucuuaaaaggcaaucuuguggaaaggguuaguggacugacucuguguauacuuugcaauaaaacuagagccaauggguugaagccuucagaacauagauuuccgccuuuaaaaauuuuuuucuaagaguuauaaguguuaaaagcauaaucaaccauuuuguagaauuuccccccaguggauauauuuaaguagagcuucaaagccaauuuccagauauuaaagcaccuguuuuaugggaucucaaagcuccaguuucucccacuguuguagcaccugauaaaucaccaugcucugaguuuugcauaauuugcuucucuacccaucuccagggagagccccuugaggguaacaaccauauauuacuuauuuuuguauccccauccauuagcacaaugcuuggcacguaguagaugcucaauaaauguuuacugaauagaugaagguaugaacggcugcaguugaaauaaugguugaaaaauguuuucuucauguuguagaaccuguccuucaaauugaagucugaccuggagauccaguauguaaaagugauaaagauggagcuguucugguuaaguggaauucuauggccuagggacguacccucugaguccuugaagcaccuuugaagaacuucuagggacauaguuuuagaaucacuggucuacaaagucaaguuuagaaaacguuuuugauuugcguuuugauuucuaauucuuugauucucagucucuucauuucaaguuuccuggguuucauuuucacacucacuauuucuuuuccuuguccucaaaauguuuuugagguuaagagaaggugugcuaaauaggaagggccugugguuauguucacaccgagacccaacuucauaaguucuuaagcuggaaagguuguaugacugacacauucugcagcucuugcuuaaagauuucugcugcagccuuuugguuucaauacagauuugguggucauaccauggcuucaguguccuggcuucggucccugauuacgggugaaccaggaguuuugcaagcccauggucacuccccaaagguggaauuacauuuuauagaaugcaggagaagaaaguaaagggaaggcucaucucugaagauagauauaggcccuccacccugcuucaucuuuuguacuuaggcagagagagaaugacaacuggggagaaaggcuagugaugaaguagucauuaaacuggccagaaagacagaaggaaggagaauaaugaaugcuaggaagagauguguccugagccuaagucuugcuuccaaacaagggaaauucauauuucaugugcuucugugucugaaauugcauguacuaccuguauagucauuagugauagugcucuucaaccuugaaaguccauuaaaagaagacuuugauuaaaugcacugaccagagacagaagaguauugugauugauuauaaucugcuuagaugagauaaaaaaaacuuaaguugugggaaugagauaguuuggaugcuguccaaaauagcaugaaaggccuuugauccaguuuucaguagauuugacauuauuauggcaguaacuuggaacuauuuuauuguguucagccaguuaacuaaagaugauauuuuagacauauuagaagagaaauagcuaggguaaagacaaagagaagguaggggaggggcuaaagagaaagaaaaggagccaaaagauguuuuagaagaaaaucaucuaaaccuuguucucacacacacugucucuaccuccauuacagcagcuuucauauaauuacuuauguaacucaaugaggacauucuuuaggcacuuaguaaauucuaauuggcuauaaguaggaaaggaguaaaagaguagagugugaaggcagcaaggucagggaagaagccuuaaacugaccacgugagcugauaaugaaaacaucuuuguugaaauguucuauauacaggauuuacauugaaacuaguuuugcauaugcaaugauuuuucaaaacccuuaucagucuucaacagguaaauaaccuauuuguuugagccauucugaauuuagcauucaccccaagcucucugcuccaccugcauugcucagucuuuggcauaugaccuucucucauuauucauagagaacauuggaaggauaugaugauuggugugaaagaggccauuugagauagaggugaggaaaguacuaggagcucaugucacuaggaacuaaugcaucauaauguacuaacguggaaaaauagcaaaacaaagacaugaaugauaacaaggauagagagaaggaaggagauuuuucaaaaagauuaaaaacagugaauuagcaagaaaaaauuuaaaauaaguaauaaaugguauuaucacaaauguaaagagagcauaauaacaaaaauauugaggaaugugcugaaaaggaagaaagagguguuuggugcugggugcauugugaagucuaagcuccuccauugagggauagauagaguuacuaugucugaggcagucuugauggcaaugcaggcuucauuuggcuccucuuaaauccaaggguuguuuucagaucagaaguucaagguagucauucuccaggcagacaucuugcuuccacuacucuuagaucugcaaugaagacauuuuuauggcuaaaaauuauugcagcuaccaucaucaaaacaguaucccugaagauauacaguccucuuccagcaaaaaguuccauaucauuuuuucccucuggucuaggaauauaacaucuuccauuaaaauauuuucuauguccuauauaccaugcacuccaaucucacuccucauaaacaaacucugugcaagaggguguuuaauaugcaacacuguuucuucagaucauauuuguuccucaauuuauuuuaauacagugucuaccccauuaccauucugaaaccguucuaacaaaggucacccaugacagcuaaccuguuaagggccagaucuuacaugaaucauuuucagcacuuauccuuuuuuaccucucuguagaaaggggugccuccuucuugaaauccucuccuucccugauuucugugacagagacuuuccuggacuuuuugcuguucucuggcuaggccugcaucagauugucauugacuuucagccugccacccacacucugccuggucuucugcccuccugccaaaaaagcuguguucugcacucucuuauucaucucaucuuguugguuuugagauggaaugucauuagcaucuguauuuucggccaagacuaggacauuuagaagccauaaaaauggaaaucauaucuuccauuugauguaauucaaaauaaaaacaauauggagucauuaaaauaaguuuaaggaaguuuaacaaaguucuuaaaauuuccaugaugcugauacuucuuuggaaaaauaauaccuuuauuauuuuuuuucacuuuggguaacccaauuuugcuaaugcccuaaucucugucaucuugaagggcaauccaacacuguucuugucacuuugcaugucuucuucuuagguuggcaugacccuuucuccuuguuccagccacccuccccucaaauaauucagaaaaaugaauggaacuuguuguugugcaauugauguaggaaucucuuucuguuuuacuuuucuaccuguuuucuccccuuucuuuguuguuauuugaaguuucucaucauauuuccaaccucauguagucuuucuucacacuacccccuucuaucgucaucucauugguacagcauuugaaauuacuggaauaugacaagugcugcuguccccaugucuuuggaaugcugaccccccacuuccuggaacacucuugcuccuccuuuuaccugacacuaaccccuggucaccacacagaucucaacuugccucugcuuccuccugggaaccuuuccuggcccuuuagcuaaggugagauucauuugcugaauguaacccaguccuucuuaucucuuccuuguuaugcuuaauguaccuguuguggcuuguuuaauauucauaaaauacauaugagcagaggccauuuaugucuuguucaaugcuauauuuccaaugccuaauguucuauuacuauaaguaauguugaguugaacagaugagauagaaguacuaaauuggcaaaaucuuacuuuauuuuccccgacccaguucaaaugucaucuuucuuuaaaguucuccuccccacuagcaaaaauguacuucucucauagaacuuacacauuccaucaugauuguuuaaaagucaacuaacaaaaaaugacaagguuuugaaagacaagaaaagacugaggaacugucccagaauggaggcgauuaaagagacaugaugacaaagugcaaugugggauccuggagugaauccuggaacagaaggaccauaguagaaaaacuggugagacaaaguuuguaguuuaguuaauaguauuguaccaaggucaauuccuuaguuguggucauugguaugaagguuaugugagauauugacauuaaggcaagcugggggaaaggucuaugggaaccuuuucuacaauuuucaauuuuuuucucaagguuuaaaauuacuuuaaaauaaaaaguuaaaaagaaaagccaacuaggagcuuucuauagacaaaguauaucuuaagaauguagauuucuagccccugaugguguccagucuaguaggugcccaauaaacaccaaaguaauuuacccuugcuugcucccauuuugguuauuugcagucuguuuugugccuucccguucuggucuuaccuagcaacagcuuggcuccuuuagggaugaccuagucccagagugcauaugcuugagaggccaguauccugccuuucuguggcaaugaugcuguacuacauacauccuauguauugguaacuugcuuucaucaguacugagaguaauaaggaagauauauaaaauaauaagagaaagugggaaaucugggcucuuuucuaccuuauuuuauuuuuuuuugagacagggucucacuugguugcccaggcugaguucgguggugcacucacaacucuucagcuucgacuuccugggcucaggugauucucccaccucagccucccaaguagcugggacuacaaguguguccaccaugcccagcuaauuuuuuuguuuguuucuuuguuuuuguagagaugaggucuugcuauguugcccaggcuggucuugaauuccuggccucaagccuagccucaugugauccucccaccucagccucccaaagugcugggauuacagguaugagccauugcaccagcccuaccuugauuuuaaaugauacaaguuuugccuuugaaauuaaaauuuuuauuaauauuugcgugccuagauaguccagucagauuuucaauugagcauccuuuuuuucuuaugauuuaauacauccuuuuuuuuguuuuacacaucgagaacugaccaccuuuuuacuaauagcaucucuucucaaauuuugugcagaaaauguuccuuuaaaaugucuuaaagauauaaaaggauauauuuauccuauuacauuguaguagaaaucgaaaacacuauggcuuuuauuaagguaacuugcgaaaguugaaaaaaucauuuaaaaaccugagaaacucuuguaaaauccucacugagcauugccaagagcauucuaaacuuagucugucacuuuaaaaugacuauauaauaacacauguaauuaauaugagcuauaauaagaccuucuaaucagcugaaaauucaagaaagguuuuuuaaagguugaauccuuuauauaaauuuugggucgauguguaguuauuuuccccuugcucauaaaaccuuugauuugcaauuauuuccuauugaaaacacagaauauuucauuucaaucauaccugaauugucauuugcucucauaaaccauguauuccuaacaacagaguuaagauuaucuuagcaaagaaaagucccucuugucuguuucucaguauccuccccuggggcuuucugcccugcccaacuacugaccuauguaauuccaauggcaucuaucaucucuaucuaggcacuaggcacucacaccucacaaacacaaacauccacauauggaaagugaggagcuuggagcagagauuuccuacaaugaacauuuuuauaaaacaagaaccaggcaacuugccacauucauguuccuucaacuuauaguaauggguaacuggauggggcaauuugaacuagaauuuaaaguaaaaaggaaacacaaacagccuccauuuguuuauauauuacaauuuugaaaauguuuacugaauacccaaaugcuaucuacuuugugagguaucacaaaugcuuuuacagagucaacaugcauagagacucagcaauauuucuuguaucuaaggacuugggauggugaaaucuccuuuguugaggacaccgcagcaccauagaaguagccaaucuuuuaaacucucuuuugcuuuaccaauaaaaagacaaacaaaaacaaagcuuacuuuuuuuuguuuuuuuuuuugagacggagucucauucugucaccaggcuggagugcaguggcgcaaucuuggcucacugcaaccucugccuccuggguucaagcgauucuccugccucagccccccgaguagcuggggcuacaggcaccugccaccaugaccagcuaauuuuuguauuuuuaauagaagaugagguuucaccacguuggccaggauggucuugaucucuugaccucuugauccgccuaccuuggccucccaaaaugcugggauugcaggcgugagccacugcucccagcccaaucugaacauuuuaacaagcuuccuauuuaaaggaaugggguuucauaagcaaauaacuaauauaugaugaacuccccaauuagauaugucuuuuagacacagucucagaauauaaauucccagaauuucauacacauuucuaaccuucauuuuuuaaauucauaauugaaaacaccaucagccaacucucagaucaauugauuuuccaucugugauccuugcuucuuaucauuuugacuaauuaauacuuccauuacuuccacuuuuccaugcaguucuuggccagugggcagggcagcaccaccaugcagggguuugaaauauuuguucaauaacugaugugcaaaagucuggguuauagaaagguugaaaacgucucuacuaagauuauacuacagugcccucuagccuauauagcagggagaaaaauguuuccccuuccugcuguucauuucuaguggcacauuacaguauuuguuauauaaaggguaugaaccugcuauuaaauaccauacuuccuaaaaggcagacauaaaguugcuuucuuauagcacacauaaaauuacucucuuaaacagucagugccuucuugcugaagaaauacccaguauccuaaagugucaacaggugcagaaacacugcacugcugugucuagggacuuucuguugaaaaccuuugcuuggcugaguaaaaguagagaagaguuuaacuuccaucucucuuccucauccuccaucagaaggcagcaguccauaaacccuauucuuaaguguggcaagugcagaugccuuuggugauaucuaauuauccuugaucucuaaaucuuuauugucuauuguuaauauucuuucccuucauaucauuuugggaaagaacaauaucuauagauuuaagcccuucugugucuauguuguuuuacauucaacaaauagacuuuaaagagaaaauguaguguuuccuaaaaucuuucuuugauuacuugauaucugugguuuucuuuccuaccuccccuucaaacagaagccuugaaauacuaaaaacuuaaccucaagaauuucauuaggcaaagcucacaauauuuuuuuuggagauauucuuuaaaaaauaauuuaucuuucuucaaaaucuucaaauuguaaaaguaggugaggaguaggacauaauuuauucuacuguguugguuaauaaccuugaaaguuuacuuaaaaggcagucucuuuccugauuauacaaaacauuuaaugggaggaaaaaagcgcucuugaaguauugccauacacagacuuuuaaacuuacaaaaaaaaaaaaaauacugcagcacguuuacacucugccauaaaguacuauaaugaauaauuaaaacaacuagaauugucaaaauaaauaacuauggauugcgguguagugcucuaaauuuuuuuaaugcuuuuuugcauguugauuuacauagcauaguaauaagucaaggauuucccagucauuaaagugaauuaacaagaaaguauuuuaauggguaguuuugucuuauuucagaauuugacuaguuauuuaauucuauacccuucucuugcauuuacucuaaaaaaaacuguguuuguauaaauaauguauuuaaaaauaaacaaaucagaacuccauggucugaaaaacagaauuuagcaacuaauuugucacguauaugugaagcuuucccuaguaccucacuuccaagcauugaagaaaugaacauuucacgcagaacauguaucuuuacuguucaauaauucaaaagcgcuaacaacaauaugcauuuaagggucuuuauauuucauucgaaauacaagcucuuaaaacaacaacaucaguauuucugugucuauauccaaauauauuaaaugaugucuaagugaauuuucccagaagauugucacuauuucccauauuaagucauugguaugaaaaauuccaguucacuuucaucucucccuguaucucuuuugcaauauuccgaaguggccuacuugguaaccucaacuuugagcugaugaaugaaacuggcaguuuucacgaguugucuucuaguccuggagcaaaggacugaguauaggaggaagacugcugaaugacaucugggagacugcucagcugaucugagauuugaagcuggugguguucacauacuucugcaccaucccagaaucuuugccugaaaccaucccucaggccagcuauuucuuggaggucuaugacuaaugucacauuguaaaggaacaaaaguuuuuaauccauguuggugauaugauuggcauucucauuuaaccucauaauauauuaauaugaucaaauuuugcuaaauaugugaauguaaauccaaaacagugaauuguugagagugggaaagaagucuggggaggugggagagagggagagauucuaacacuuguugaauaucugcuaagugccaggugcuugcuguguaucaucucauugaaucauugcaacaccacuguaaagaacuaguuccccaguuuugcaugugaaaaauauuaauugcuuucccaguguuacccuugcccagugaaucaugggucuuaauucuccaccaaguauuucugacugcaaagcucauguuuucugcccauaugcacaugaucugaaggaucaacucagcaagaaauacuuaaaguuuuuuguugcugaaugcauuauaauuuugagaagacuuuauguaugccguugcuucccaaacauuacaauacaauuguggaacacucaauggaacuuuaguucauuauggcagugagaagguaacaaggaaauaagagcaggucuuugcccuuccuguugcuccgugucucuugccugaugccagguuucccucagaccggauaugagacuuggaccugugguuuaggugucauuugcagaacaguaagucucagguagagucuuauaguuccugauuguaaaggucaauccaaguuuauuaaggcuacuguacaucccagcuuuccugacauagccuugaauugaagggcuuuuauucuucaucauaaaaaugaucucuuaaugugugccaucuucccuuguaagacuauuugauaccuuugcaaacaagaaagccucuugucaaaauauauaaugugauuuuucuauuuggagggucucaagaagcauaagcagaacugagugaaauauggagggccucccuuuccaccagauguguccacacggagugauugagugguaugcccuguggcagcaagagugacaagucuuaggccuacuucugcuuucacuuuuucuuuugucuauugcuuaaaauaacugagcuuuauauuuuguuccccucaucaugugaaauugcagauguuuacugguuucauucuuucuuuugaugaacuaacucccccucuaauggaugguuuuuguuuucaaaacaaagcuguacauuucaguuugaauagcucccucugauauaauaaaguuguucuuuuaacccauguaaucaagauuuccuuucauuuuaaacuuaaaaauaauuuggaagaugugagugauaaauuuccaugcagcugauuuaaauauucugguucauuuucauucauguaucucuacucccaugggagaaaugucaaauuagggaaauagcagugcauucccuuccuacuuucaaaaaacaugcaggauuuaagagccaagaccgaaaguauuuugucuuagcuuuuagcuuagaaacugcuaguugccuacccaauauccauucuccauuuacuccuagaaaccugauguuuuuccaguuggcaaugugcccagauacacacucuuauuuccuagcuucccauggguggucaaugagauuagguagaaguccuugggugugcuuucgggaaggcuaugugaagcaggcugacucaguugagagggaaaucuuuuuggcccuucccuucuuccuccucuuuuugccugaaauguaauaucugaagcacuauagccaccuuaggccuugcagauagaaacuauguagaaagauaggcucuagaguuccugaugacuuuggaccugcuauagcaguguaugugucuguuuuagucaguucaggcuaagacuggguggcuuaagcaaaagauacuuacuuuucacaguuccggaggcuaggaaguccaagaucaagaggcuggcagauuugguguccagugagggcuguuuccugcuucauagaugugauggcaguguuugcccucuguccuaacauaguagaaggagagagugagcucucuggggucucuuuuauaaggguggggguuaggauuucaacuuuugcauuuuggagggguacagacauucauaacaaaugcuuacaucucuacuucauuuaucugaagaggaaacaaaccugucuuguuuaagccacauauugggaguuucuauuauauacagacaagccuaaucacaccugauacuauuuucuuuaccuuuuccaugacuguaauacaaaaacaucuauuccugcuucaccaaucucuuuacuucucccaacucuaauuuccuccuuuuccacuuauuucuaacauucaagaggacauuuucaggcaggaagugccugccuaaaaaucacauaugcuauccugcccaagaauggagaauguauucacagcuauuucugcuagcauucaagaggacauuuucaggcaggaagugccugccugaaaaucacauauauagacugguccugcccaagaauggagaauguauucacagcuauuucugcuguucccuucuuuguucuccugugaauauggagauuuucaaagaggcccagagacauuucacagcagcacucauugcaguaguugugggauagagaaguauaggacagaguaguucugcaugcaugagcaauugaagucuaguaucuaccccauagcaaaagaugaguuguaugagguuagaaucucacauggguuggaugcaguggcucaugcuuguaaucccagugcuuugggaggccaagaugggaggauugcauuaggccaggaguuuucaaccagccuggacaauauagcaagaccucaucucuauaaaaaauuaaaaaaaaauagccagguaugguggcgugaauuuguaauccuagcuacucaggaggcugaggugggggaucacuugaguucaggaguuugagaauguacugagcuaugaucgugccacugcauuccugccugggugacagagcaggacccugacucaaaaaaaaaaauuuuuuuucacaugggacaggaacaguuucuuuccaaugaugucuacaggaaguacauucuguccugacagcagcauuucacugaaugaguguuucauugacuagugaaugagagagcucccuuuaagccuuuauuggaccuggguacucuuacuugccuuccugcaacuuucuaugggacugcuaaugucaaagaagauagagaucaaguucagucuggggugaauuaaaagagugauccaagaagcaauauggacauaaauugagaaauuagagugaguuacccaggcagaaaugcaaagagaagcgcuagggauacaacaccagaaaaacaagacaaccugaucccuuucugugcuacaugccccugcuguaagaagauacugaugcugucacaugcaugcucugucauaaugcucuguuucuucuugcuacugccaggauccuugguguugaggccuuacauaaacuuuccuguucaacaacucaaucccugucagcacaggcugcuaucccucuaggcaucaaagcacuuggcauguuuuuagagaguaauuucaagguaguuauuguaauuguugcuaauaaacacacuacauugggcacaagcuggacuaggaaagagugucauaaaaagaaaucuguaacgauaagggauuguaaauugcuaacgaauauccuaacaaaauaaagcuuuuauuaaaauuaagaaucucuuucucuuaugaaagaacugggaaggauuauuuuagcuuuacuuggcauaggcucuucaugauaagaggaguguauauauaugaauuuugagggcagcauccagagcuuggaaaagguccagagaagagcaaaugcaauuaucaauagguuagaaaauuggcccuuuaacaaaagguuaaaggaguuggaugcauuuagccuggaguagaagcaauuuaauaacuguuaaagagcuguuauuaaggaggacacugaccaauguucucucuccccaucgaggacacaaauaaaaggaauuguuuaaacuggaagagaagagagggauuuagauuaaauauuaggaaacauuucuuaggagugagcaucauuaaagaaaaaaaugccauaagcuauaaccaguuccugaggaaggcuaaggacucugugucucgggauauuaguguagugggcacaacacaggcuuugaacucagacagaacugcuuuugaaucucaguucuugccucggcuaacauaaauaaaaggaucuuaaaaauuccuccacuuuguagauuuuuuggggaauguggaacauaguauuuggacacgcauuuaggugauaaaggugauaaauaaacauuauuuuccccuuuaacuacuguacuguugcuugagauuuuacaguacacagguuaggcaauguauucuugucaguacugauuauuuuucuuuguuuugcgaggauuuggcuuuuauuuuuuauugaaaaauggauccuagcaauuuguggcggauuauuauuacuugguuuuacaaagccauaacugguguguaugcauguguuuggauucacacuuacaucuugaacaaggaaacauuagaaagguauuucaaaaucacaguaaaaaauacauauuagaauucacaaaaagaaaucacuggucuaaacacgguaugccugaggcauagcguuaauuuccccuguuuugcc

SEQ ID NO: 16407 - RNA, 36528 nt, Homo sapiens
cuggcggccgccaggccguucccggaaguugauggccuuacagucguagaacugauuggcugaucaugaccaugcaguuagccaggguuuucccgaguuguuuggguugaguucaggagaagcauggccaggucgaguccguaccugcgccaacuucagggaccucugcucccacccagggaucugguggaggaggacgacgacuaccuaaacgacgacguggaggaggaugaagaguccguguucaucgacgccgaggagcucugcagugggggcguaaaggcuggcagccuccccgggugccuccgcggugaggaaggcgucugcccgggggaugggguuggaggguccaaaguagcgcuucccauucuggcuuugcccugagcaaggcacccagucgugcuaacagauuuagcuuaucaguggucuagcugcuucauccuaccaaggguaaaauuaugacuauaauaauagcagugacuuuaacuggacacauacuaugugguuuuuuuuuuuuuuucuuuuuuugagcagcagcaagauuuauugcaaagagcgaaagaacaaagcuucuacaguguggaaggggacccgagcggguugcccuuuuuuuuuuuuuuuuuuuuuaaaauuauucucauuuuaauggucguccuuuaauuuaauguaccuuuaauguaagguaguuuuacgcuuaaggaaacaguggauguugagucucuauuuccacccagaaucggaacuuuuauuuuuccuucugaccacuuauccucaaguucuauagaaugagaacuuguaauuauuauccuauauugccuggagucaaauacgugguucuuccucagcuucuuggaaaaacaaaacaguccgggcgcgguggcucacgcacuuugggaggccgaggcagguggaucacuugaggucaggaguucgagaccagccugaccaacauggugaaaccugucucuaguaaaacaacaacaacaacaacaaaacuacaaaauuagccgggcgugaugucgcacaccuguaauccuagcuacuugggaggccgaggcaggagaauugcuugaacccaggagguggggguugcagugagcugagaucacaccauugcacuccggccugggcaacaagaaugaaacuccaucucaaaaaacgaaaaggaaagaaaagaaaaagaaaaacgaaacacaaggaacaccucagugcacagaugauuguuaauugguguuaguaaccuugugguucggguaaaccuuguauaaguaguuuccugugcuaugagguaguuuccugugcuauaaguuauaccuguuauguauacuuugugacugagacuuaaaauauuuuaaugugccgaccggugcuguucaguagaacuuuccaugaucauggcaguguuuuauaucugcacugucugguauaauagccacuagccauauguagcuguuuagaacuugaaauccagcuaguguaacugaggagagaaauuuuaaguuuuauuacauuuuaauuuaaauagccacguggguggacagcgcagauuuaggcagaaaaguuucaaguauuuguggagggcuuagucgucauucuaaaguaucaucaacuggcuagcauguuuggugcugggaaaaccuagagaaauaaaauaacaagguugcagucuuaaugaagcuuacccucuaguguauuaaacaaacauucuuuaaucacagaaguaacuauaauguuacuaaaugcuuagaaggaaugcuaaauagugcuuugagagguuuuauacaugagauucagggaagacuuuucuaaguaagugauaguuaagcugaggucuguaguaaauguaguaaacaguaaaggggagaucaguuaaggcagauggaauaacuugagugaagggccauggcauuuuaaagaaacugcaugaaggccaguauuggcugaagucaagaguagcagagaggggacugauuuuagaagaggaacagcagacaccugcuguguacugugcuugcguuuuggaauacaaagacaaacgaaacaguguccuguuuuaguauuuacaguguaguggagggagacagaaaaagagguaggcagaaugcaguguuacaggcacccuaccagacaucuuuagagagugcuguagggagauuaaagauagugguaaguuugaugaaacuuugaggaaacgguuucuaaauaaucuccagaguuaacuuuuguggguuuuuguuuguuuuuuuuuaguuucuauuugugaugaaaacacacaagagacauguaaaguguuuggacguuuuccgauaacaggugcuugguggagagugaagguacaaguaaagccuguggugggaucaaggagcuaucaauaucaaguucaaggauuuccgucuuacuuuuugcagucugauaugucaccaccaaaucaaaaacauaucugugcucucuuucuuaaagagugugaggucuccagugaugauguuaauaaauuuuuaacauggguaaaggagguaucaaacuacaaaaaccuaaacuuugaaaaucuuagggaaacacuaagaacuuuccacaaggaaacuggaaggaaagaucaaaagcagccuacacagaauggucaggaagaguuguuccuagacaaugagaugagucuuccucuggaaaacacaaguaagugugauuuuuaucaucaacuuucaguguaauugacauacuuaauaacuacaguguuuaaaauguuaccacuagcauaguauucuuuuuaaaaauccauuuggugaaaaauguguuuauguugcuuuuggaguaugccauugacauuucagguuucucaucuguagcaugaagggauuauaugagcugaucuuuaaaaucuuccaguuccuuuccaccucuaaaacugugauuuuaaucucucuuucuaacuuuuguauucacagcgauuaccuugaaucauuaauaaaaaaaaauucaguugcuggccaggugugguagcugcucacgucuguaaucccacuuugggagacugaggcaggaggaucacuugagcgcaggagaucgagacuagccugagcaauguagugagaccuugucucuacaaaaaauuuuuuaaaaauuagccagguguggugauauauaccuguagucccagcuacuugggaggaugaggcaggaggaucacuugagccuaggaaauggaggcugcagugagccaugauugcaccacuguacuccagccuaggugagagugagacaccgucucaguuaaaaaaaaaaaaaaaucaguuguaaaugauucuguuuaaagagguagagaagaacgacaaggaugugaauaauacauuuaggaaauacuucaguccaaaaugguuucaaguaauuuuuaauaugauuuguuaucuggauauucauauauauggaauauuucauuuccuaauuguaucaaauaaauuugaugguacaucaaugaaugauuucaaugacaaaagauuaugauuauagaaaaugauuaugaagguuacuauguaaauuauuuuauauccuuagcuuuaaauuuaucuuuauauaauugagucagaauuuuuauucuguuauagugcaggcaguaggaaacaaaaggcuaagaaaucauuauuuaagcauuuaaagaacauaaauuuugguguuaaacacaaugaaaaccaucucaguacaaaagcaauugucauaauaugaucaaaauuuucuuacugguuaaagcaaguguacuaaucuguuuuugacuuggguuucuugaaucgguugugcaaaaugagaaaguacuucaaaucagucauucuuuggguucauuuauguuuuacuuuguuccuuucugauaucuuguaguuccauuuagaaauguaaugacagcuuugcaguuuccgaagauaauggaauuccuuccaguucuucugccucgacacuuuaaauggaucauagggucagguucuaaagagauguugaaagagauagaagagauuuuagguacacauccguggaaacuuggauuuaguaaaguaaguaaaacauuugcucagcauauaguaaucuuguguaaggcaugguuucagauuuggcaauuuuccuuucucuuucaaaggaaaaaaauuuguguggaccccaguauugauuuauuuuuauucaaauguugcaacuguacauaaacuucuuauggcuauagcauaagaagcuauagcauaagaacauuuuauaaguuguuaugcaacuuguaaaguugcauaaauuuguaaaugaaaaaaaauugaugacauucaaauuauggguauuaauuuaguuauguaauuuaaugugacaaauguccuguaacuaaauugucauuugcagcuugaaucuuauugaggucaacagcucuuacaaauuuggcaaguccauucugcugugcaacucaauuucccacuuccaguuugaacuauugacaauuuucauuauucaugugguauaucauggugucauuugauuuuuauuuuguacacuaacaucauuuacaaaugaauccgcuucuguucuuauuauuagagacuaugaguaguaaaggggcacacugaggcuccagugguauuggaaaccaaaugugguacuuaaucuugguaguucuugcuuauaaggugguuuugcaaagaaaaauacaguugagaaacucugagaaaauucuuggaaccucaagaauguuugcagaugcugaguuugagaaauacuggaauaaggaauuuuucccuuacauaaaaugucuaugaauucaguaugcuuuuaaagaugagauucuggaacaugagauuauuauauauauuuauucaguggagaagaguggaagagcaauuacauguaaaaggcagauaauaauaguuuaccuuuuuguuuaaaaaaacccuguaaaauccaauguucuuuauagagauauuaagaagggaagaucauuuuuuagcucuuuuagaggucuuuagagccuguucacauuucaagaauaaauuauauaacauuuuauuauuaacaauacacauuguguuaggcuaauauaauugaguaaacauuuauugagaccuuaccaguguagaauggagaugcgaucaggcccuuacucucacucuugcuaggcucaccaucuuccuggugaagcacagaccuugcguuuuucuuuuguggucaagugaguuugaggcuaugucuaucaagauccuagggccagccuucuuccuucccugccacuaucccuuucucucuaccuccccuuuucuuuucuuuuuuuuuuuuucccacccagccuggagugcaauggugugagcucugcucacugcagucuccaccucccggguucaagcgauucuccugccucagcucccgaauagcugggauuacaggcgugugccaccacacccagauaauuuuuguauuuuuaguagggacaggguuucaccauguuggccaggcugguauugaacuccuguccucaagugaucugcccaccuuggccucccagagugcugggauuacaggcaugagcuaacacaccuggucuucuaccuccucuaaaaaaaaaaaaaaaaaaaaaauuaaagcauuacauaucagcuacuguauuuucugccuucuggauuaagugaaccccuguuuaaggagcuguugaaguccuagauucucuccccauugugggcauuaagugauuacugcuucccacccuagcaagaggauagagguuucucuugccugaugccauucaacugagagcauccaggcuuggggauaccagguggggauaaggcagagauuaucugguggugacucagguuuuucauuagggaacaguccccucccucccgccaugucaggaucuggaaguguuuucuccuguccagucacucuucacagagaagaaucauacguggagauuuuaagccuggaugcagcauucugggacucaugagaaaaggaggccugaggucucaccauucagcauguaaacugcuauccaaguauuguauuaguuugcuggggcugccagaacaaguacugcugacugguuggcuuaaacaacagaaauuuuuugucuuacaauucuggaggcuacaagucugagaucaagguguggacaggguugauuucuuccaaggcuucucuccuuggcuuguagauggucauuaucucuuauuaguucuucacauggccuuccuucuuugccagucuauguccuaaucucuucuucuuauaagaauaccagucauauuagaguagggcccaucucgaggaccucaucaaugaggugaauagucccauuuaaccuuaauuaccucuuuaaaacccugucuccaaauauagucacauucugaggauauuggggguuaggacaucaacauaugaauuuuggggggacacaguucggcccauaaaagguauggagggcucaggagugaugucuccauuaagaaaaaauggagccgauagaugacgugcucaguagauuauagugaagggaguucuguaucucuucugcagaguuuaggcagaauuguugauagacacauagaaaacuaaacaagucaagaaaaugaggcagauguuaacuucaugauacacaccgaguucaacagaaaacuuaauguaacagaguacauccugucacucagcugugaauccuauuugcauaagcauaauaaauaccuauuuaaccaaaauugaacaaaauguauacuacaacauuuuucaaauauagaaaccaaagaaacaccuguggagguaaugguauaaaauagagugaccuuccauagagauagacuuuccauaguaaggaguuaauaaugaauaucuaaaaucuuuuaaaaaucaaggaaaaauaucuauaguacuuagaaauauggaaguaaauucuggaagaaauaacuaaaguguuggagauguugccuuuagaaggcaugagaagggauaaggaaaggauucauaauuuuuuugauaagccuuauaguauuauuucacuuuuaaaacuguguguuagugugauaaaauauaauuuuuauuuaaaaauuauauagaucucuaauuacggugcagccaguuagaaaauuagugauguucuaugguauuuucuguaaauuuuguugaaguucaugucuucugggauuuaaaaaauuauuaauaaagaacauauucauaaacacuuaugauguuuauaaaccaaccugaacuuuauuucuuaaagauaaccuacagagaguggaaacuccugcgaugugaggcaaguuggauagcauuuugucagugugagucucuucuccagcugaugacugauuuggagaagaaugcauuaauaauguauuccagacugaagcagauauguagagaagaugggcacacauauguugaagugaaugacuuaacuuugacauugucaaaucauaugucauuucaugcugcuucagagucucugaaguuuuugaaggauauugguguggugacauaugagaaguccugugucuucccuuaugaccuuuaccaugcugaaagagccaucgccuuuucaauuugugaccugaugaagaaaccuccuuggcauuuaugugucgaugucgaaaaggugcuugccucuauucacaccacaaaaccugagaauucaagcgaugaugcauugaaugagagcaaaccugaugaaguaagauuagaaaauccuguggauguuguggacacacaggacaauggugaccauauuuggacuaauggugaaaaugaaauuaaugcagaaauaagugaaguucagcuggaucaggaucagguugaaguuccacuggaucgggaucagguggcugcuuuggaaaugauuugcuccaauccugugacagucauaagugggaaagguggaugugggaagaccacaaucguuagccgucuuuuuaagcauauagagcaguuggaagaaagagaaguaaaaaaagccugugaagauuuugaacaagaccagaaugcuucagaagaauggauuaccuuuacugagcaaagucaacuagaggcggacaaggcuauagaaguuuugcucacagcaccuacagggaaagcagcuggcuuacuaagacagaaaacuggucuucaugccuacacacugugucagguaaaaccuuugacauuucaucuguagauaaaacauuugucggccgggcacaguggcucacgccuguaaucccagaacuuuugggagacugaggcgggcagaucacaaggucaggagauggagaccauccuggcuaacaugguggaacccugucucuacuaaaauacaaaaaauuagccaggcaugguggcacacaccuguaaucccagcuacucgggaggcugagucaggagaaucauuugaacccaggaagcagagguugcaguaacugaggcugcaccacugcgcuccagccugggcaacagagcgagacuccaucucaaaaagcaaacgaacaaaaaaaauuuaccuuaaagacaaacuuauuucuuaaagcaaucaguaggaauuuauugaauguuuccugggucccugucuugcaguaacugaucauuuagaucaaugcuuuucaaagcagcagucuguaaauuguuaccaguuugcaugagaaaggagcuaaugguagaaguaaaucagugcacugcuuccuucuuugaguaagucuuauggaaaaaaaaaaaaaaccuauuggguucagugcugugguuccugucuguaaucccagcacuuugggaggccaaggugggaggaucacuugagcucaggaguuugagacuugccugggcaacauagugagacccccaucucuacaaacaauuaaaaaauuaggugggcaugguggcaugcaccuguaguuccagcuacucaggaggcagaggugagaggauuguuugaggcugugaggucgaagcugcagugagccguguuuagaccacugcacuccagccugggugacaaaguaagaccuugucuaaaaacaacagcaaaaauucagucccacuagaguguaggcguaaugauauaguuaguuuagauccugguacaauaucuguuucucaugggggcugguuacaaacaugucacaguccauagaccacauuuugaguaacauuggaaauggaaguaaaaggccuauauuuuguaggaugaaagugaggacuuugcucaucuggaauaagucuuuauuucuuccaccuagaacagugccagacaaauaguaguuacauaauaaaaauuucaaauaaauuaacauucuugaaaaaaauaguauuggcuauaauuaagaaucauggaguuuaagcuuguaaagaguuggagagguuccucuagcccuagcccugaccugccauuuuuuagauaaagaaacaugguaguuggaagauuucugaagaagguaaucauugaauuggacuccaaggaacauggagacucaggugaggagaaggacauuggacuuaggggaaaggccuuugcaaaggcaucgaggaauaugaucguagugugccuggaggauuuugaggugacuucauugacuggaaugaagccugugucugacagaauaguggaaauuaaacuuggguuagacagugaauucgagcuuuaaaguuaguaaaguauuuugacuuaucucauuacauccuugauaaagugauguuaucuccacauuuacagaaacgccaguugaaguguggggauguuaaacauuuugccuaagaucucaguuagguguagaacugggacuugaaauggagauuucuggccuuccagcuuguuguucuuuccauggugucauuauuuccucauuuauuacagaugcuguacacuaacaaugaaacucgaacuugaucucuuagggagccauuuagguuccuaagcaagagagugaaagaaguuuuaaggaagaucauauagagucauagagccaugagccacuuaucauaucuugccuguuaccuuuauuuaucacaugaaugaauggagaccuagagauguucaguguaguuuaucaguggaagaguuuucugaucaguuuaugaucuuuuuuuuguacuaugccuucaugucugauuaaucugaaggauugaauuagaaggggacacccgaaagggaucauuaccaaguuuuaucugaugugucagcucugauuaguugguaguaucuuaauaucugcuugggaugcugagugagagaauauuucugaagcuauguuuaggcucaggagagagugcaagagcacggaaagagcacuggagugccauuuaucauccuuggacuaggguugccagauuuaucagauaaaaauaugaauaauuuuuuaguauaaguuuguaucaaauaauucauugacuugcuuauacuaaagucauuuauuguguauuugaaguucaaauuuaacuggauguccuguauuuuauggggcaaucccauccugggauugugugugggggaaccuggcugcaaagcuauuggagucaucaaguugcugauagauggaaccuguauugagcugguagcacuagaaauacaguggaaaaugucagcauuucuaagauaauaaauugaauauaucaaauaagagaaaagaaauggcuaauuccgaauguugugagacauggcuacugugagcauaggggguuuuguugaagggaauugaugcauuuggguaggaaauaugaaggcuuuacuuaauagacaguugaaucuaguuuuaguagaaaaauuagaugaagaugugauaugauaccauuuagaaaaucuguacauaacacagauugaaaaucugaaaugcuccagugaguguuuccuuugaguguuaugucagugcucaaaaaguuaaggauuuuggauuuugaauuugcagauuagggauacucaaccuauaaauguucauacugaugacauagaaacauuuuugggaugauauacacuaaaauauugaauguucucugguuguaauuuuacaaccaauuuuuuucucaucuauauuaaaaaauaauaaauaguauuacauuuguaauaaagaauuuuguuguuuauuuguuguuggggguggugcggugguaguuuuuaaaaaguuuugaggugaggaaguuuggaguacuugaaagaaaaaguaguauuuucauaauucgguugagaaagcgcugcuuuuauuccagaauggaguacuaugguugggagaagggaagagcuucaguggcauaucucagauggccacgagaagguuuauuugggaauggaaaagaauagggagcuuucuguguuuaagaacgaugagggaaguguugagauuuuggaacaaucugauuuuuuguuuguuuguuuuuagauuuauuuggucugucuguucugcauauucaacccuauaacuuuuguguuucuuuacuucccacccaccccugccaauuuacgaguuuugccccaaaauaacuugcuauuaauuuuugguuuuguagauuuuauaaccugacuuuaggaaugccauacuuugcuuguaggucaauuauagcuucuauucauggacucaaacaaugaugaccacaaacaaaccauggaaauuuucuucgguuagaguucugguuguggaugaagggaguuugguaucuguaggaaucuucaaaucggucuuaaauuuauugugugagcacuccaaacuuucuaagcuuauuauccuugguaaguuaaaauauuguuggaauucugauguuuauuucaaaguauugugguuaguugguuguuuacaccauuuaguugguuguuuacaccagaauugauaccaaagcuacacgaagauaccaaagcuacaugaaauuaaaucugaccacucuccuaaucagcuuggguuguuuuguuuuggccaggauauuagcuggcugggaugugaaugaaauaggguuguuaagggcuacugcuaaucaccuaaaugauggcuauuaaaauaguaaaagugccacagauucagaguaaaucaggaugugaaucauuuggaaaugauaaaaaguuugaauuauaggccacuuaaaaguaauuucauaaugcuaagcuaauaaaucagaccucaccagccucuuaaguccuuccaauucugauaagauucaguuagauucucuuggguagucaugcucuguagaccauaugauuuaauggagaaaaaaauaaaaucacaauuggagaaucaaguuguauauaaaaauuauuauuuuuuuagguauuugaggaugucuuuuaagcaguugauuguauuaauggcuuaagccuucucucugcuucccccaguacauguuuuucuuauauuuagggcuuauuuguugcaugcaaaaaauauuuuuaauagagcagaacaucacuauuagauuacuggaacguaucuguuaucaaaugcauuuauuuauuuguuuuauauuuuguacacuuauuuuaucuauuugaggcuguagauucuuccacuuucaguaagacauugaacaugauugaaaaagggacuaacuacaaaugucuaaggccuguuuuuuuuuuccccuaauauguugacuaaaacauaugccuguacccaguuucccugugguuauagguaugaaagauguucuauuuagauuuugucaccuuauuguguuauuacuauuuuuauaucuuuuacuguuuaaauguuguuuuuuguaagguauuuaacuuuaaacuguuaaauaauuuuaaacaaucuuggggguauuuuuucucagaguaagucuugcuacuguaucuuuuuuucuuuuaggugacauuagacaguuacccaguauugaaccugguaacuugcugaaagaucuuuuugagacucuuaagucaagaaauugugcuauugagcuaaagacaaaccauagagcagaaucucagcucauuguggacaaugcuacaagguauaauauuacuaagaguuugcauuuucugucuguuguauuagaaauuuaaaaaauggccuuugaauuagaaugauuuaguacaauacauuaacuacaccuuuuagcaaaacucuuccauccuucaacuauaaaccuuuugcccuacaguuagaaaagcaaaguuaauguuuuucauuacugguccaguauaaguuauuauugaaauuuaaaaauggaugagguuuccugauuuuaaaaguauguauaugaauuaaaauuguauuaagcuuaaggacuagaauaagcccaaggggaauggagauuuggaaauaaguucauuuacgugcaagggagaauuggggaagaaauauccccuaauuuuugugggagaaagcugaaggcaaaauaauugaaugugguauuucacuccuagaugaauccuagaggcacccauggcaucuuacuucccuuaaauagaaaagaacccuucucuucccuucgucuuugcauaagccuuuggaguuauccucugucagcucagacauuugguuucuccauaauccacacauaugaaaaucacaaucauuauuauuucaugacuuuuuuuuaauacagucaugcgccacauaauguuuggucaacaacagagcacaucuaugacaguggugccauaagauuauaaaacuauaauuuuacuguaccuuuucuauguuuaaauauguuuacauacacacaaauacuuaccauuguguuacaguuggguacagcacuugguacaguagcaugcugugcagguuuguagccuaggagcaauaggcuguacuauauagccuagauguauaguaggcuauaccauccagguuuguguaaguacacucuaugcuauucacacgacgaugaacauugccaaaugaugcuuuucucaaaacauaucccuaucauuaaucgaugugacuguauuaaaaucucuagauauaaugggaccuuugaauacugagucuauguuagucauuguaccaaaauguauaucugguuuuuacucuuuuuuacaaaauguuuuguugcuugaacaucuccuaaguaggauguagcagaaacuagaaggguguccagucuuuuggcuucccugggccacacuggaagaggaauugucuuaggccccacguaaaauacacuaacacuaaugauagcugauaagcuaaaauaauaauaauaauaauaauaauaauaauaauaagccaggugugguggcucaugccuguaaucccagcacuuugggaggaugaggcaggcagaucaccugaggucaggaguuugagaccagccuggccaaccuggugaaaccccaucucuauuaaaaauacagacauuaggccaggcgcgguggcucaugccuguaaucccaccacuuugggaggccgaggcggguggaucacaaggucaggagaucgagaccauccuggcuaacauggugaaacccugucucuacuaaaaauacaaaaaauuagccgggcuugguggcgggcgccuguagucccagcuacucgggaggcugaggcaggagaauggcaugaaccuggaaggcggagauugcagugagccgagaucaugccacugcacuccagccugggugauacagcaagacuccaucucaaaaaaaaaaaaaaaaaaaaauacaaacauuagcugagugugguggugggcaccuguaaucccagcuagucgggaggcugagacaggagaaucgcuugaacccuggaggcagaaguugcagugagcugagauugcaccauugcacucuaaccugggugauagagcgcgacuccaucucaaaaaaaaaaaauuguaaaaaauauaauguuuuaagaaaguuuaugaauuuguguugggcugcauuuaaagccauacuuggccucauggcucgugggccagacaagcuugaacuagaauuuucaaaaccuacuuucucuaagccucugucuaccuuggacaaaauugugggaguagaggaggaauugacaggaauaggguagacaguguggguucauauuaagacauuaagaaaacuaauggaguuggauguagaauaaucuuuuccuguaaucuuucugcuucuaccuaaagaccaccccauuuuugguagacgauuagucauuuuaaaguccaagaaacguggaggaaucugaagcauauuagcuuucucagaacucaauuuuaucugaaacucaggaauuccuuuuaguaacuuuuucaauaucauuugguucuagcugugcuccuuucaucauuucaucuuaaucauaauccucaaguauuuauugacuaugaaggaucccugcuauauaccagggaaacgguccuggagauagaaggugcuacaugccuugggucagaagcaaaacaggaaaucuaugaugauucuucaggucccaauuaaaucugggcuaucgccagcaagaacagccucauucccucucuguuccuuuccacuuuuguuugggaaaaggugaagaagacacaguaggguaccaccaccucugauaaccaggcugcuguuaguucuguucgaggagucaaucuucuuccaaauaaccauaccuuacucuguuuucugauaugauuugcuagccucggaaaauauaagaaugaaagaaggaugaggaaggaauagaagcaacuagauguggauacuugguucaguugggaaagugggauuauauguagaauauacagagaagaaaggagaagaauauaauguaaacauauggaaaaggccugaaccaguucaaauuaauuuauauagaaagggguauggagucaaaugcgccuauuugccucccaauucuccuguuuucuauuauuguggccuugggcaacccacuauacuugacuaaaccucacauuguuuaccugugaaaaaaggauaauaccuuccuugcaugguucuuuuguggucuggagauaaauagaccagguuuucagaauggugccuaguaaauccucugauaauuuuuuuuuccugauccuuuuaguuugcuaaggacugauugcuaauguguaguaccauaaguuauugcuaauguguaguaccauaaguuuauugucuucuauuauaaaacucauuuacuauuuauaaugcauaccuggaugaccuuuucucucuguuaucuauuaauagauacuaauuauuauaaggacauuagcucugaucauauaugaagacauuuuuggaugauaauguucuuuguguguguguguuaucuuuauucaagaaucucaagacgccaauuuccaaaauuugaugcagaacuaaauaucucugauaauccaacauuacccaucucaauucaagauaagacauuuauuuuugucaggcucccagaagaggaugccaguucucagucaucuaaaacuaaucaucacucuuguaaguauaaacuucuaugagauguagaguuaaguauaacuauuuaaguuuuguaacauaguuauuaaaugacuaguuacaauuuucuuuaaugguaaagagaaauauugcuagcaaaaaaagagacauugaaaauaaaugaacuuaguaaucaucaaaagcagaauacucuagaauuugguaaagaaguaagcucuugacacauaaaugcucaguaaauuuuguugauugaauagauggauguagaugauuuuguuuaaaauaaagcaaagccccaauaauucagguucauuuaggacaaagcaagucuuaauuaaugaaguuuuuccuuccuugcuauuugaaaagcagauacauuuauuuugaauacaaauacucaaugcuaauaaaggcaaauacuuuuauuuuguuucugaaacaaaaauugugacugucaaacuguugccaaguuuaauuccuaauaguucuguuuuauaaaauggguaaacgcauggcuucuuauuauggauguuaggaugacaauaggacaggguugagaaagagugugggacaggaaaucuucuccuuuauguauaugaccugugucaugucacuuaaccauuuguaaaaugggaaccauaguggaacucccuguggagcuauuacgaggguugagggcauucaucagugugagacacucuauaaaugucaguuuguugugacuaauagauguuauuaaauuagcuauugcaagugaauuuauuuaaauagauugaacuuaucuguugaucuuuauuuucauuauaaacucaccuagcaaaccuuuuaaaaaugguguaaugguuuucucaaaauugaauuaguaaagguuuaaacuauuauuacugaggacuuuuuguaguugccacuguucucaaagguauauccuucccacuuaaccacuuucacuguguaugugaaaguaaugauauacaacuucaucugucagccuuuuccccuuaguguguguccccagucucacuucccguggguuagugaucauuuacauguuacaacaauguauuuaaauaaaugcgaucauacauaguguucuauaaugugcuuuuuugguuuuuuuuguuuauuguagaaacuuuuuuuuucuauuuuucauucagcaaauacuuauugaacuccuguuauauacuagauacaauacaauagauaaagcagaggaaaagauuaaaaaaaaauugucccugagguuauugugcuuucauucuagugugggaaacagauaauuaaaaagugaacaaauauauuuucaaacaucagaguacaaagaaucaaguaaacuuaacuaaauacuuaccagugacugauuaaauuuguugcaagauugcuuuagauugugggggccaaugauuugagaaacaauuuauacucuuuaaaaaaaaaagucaaugauacaggaauguuugaaguaagaauuaauguucccugguaauuuuccuuucucuucuucccccaggacaaucccauuaaggucacacacauaguaaaagcuugguguuuauccuuuuaaccuuauuauauccauauacaaucauauuuauuucaguuuuacauaaauugguuuauaagcugcauauuguuuugugacuuagaaauguauguuaaauaauuaauagcuaauguuucuuuucacagcuuaguuaauaguagguccuauuuacaggugaggaaaaugagacuuaguuaaauagaucucuuucuuugccacuucacuuaauucuaccuaaaauauuguugguuuuauuucugguacccauucuuugcauuaaugagaauguacuuuuaaaaaaaauuguccauuuuagacugguagcagagcuuaccugauacugcuuuucuaaauuaaaaacuucugcuggaaaauuagucucuucuucaaggaaauugaguaaauauuccuuaggaagcauauaguacuuuuucacuaauuauuaaguuauuaaguaaauuaugcccauuauuacaaaguacuaagaccuaagacaggauucauauuugggcuagaauuucagaguugcuaaaaugugagaaaaauguauaucuuagaaucaauaaaauacguuguacauauugaucugcaagauguggggaaagugaaaaaagguauggaacagugccauccuguacauguuaaaaagaacaguaugcugggagaccuuuggaaauuccuguuccggaagccagggguugguugagggugagcugagucuuggcuguuuucuagcgguaaucuucccuucaucugaaaaaugaagggcucagcaggcagcuaaguuugucuucccagagcagggcaucacaaggcaugggcuuuuucauucccuugugauucaucugcuauuagggaaacauacaugggaaaaugcuuguacuuccaugagccuuaguuuucacauucauaauauggaugucaucagaagucagacuacccaauggcuguagggcaugagcaccauuggaauggaugcccccgcuaugccaggguuaaccuuuuaguugcuagaucauggggaggucuggggagaaggaaagagaugguugggguggggaguagagcauuguguuguuaggggaguggcuguuuuccagcuaauauggaaguauugcuauguuuuauacaagugugugccaguugaauaucagcucugaauauaagagcaccuaccacauguggguguccugcauauuaagugauauaacauauaaggccuguauauugucaaguucuaacugauuacuaacaugaucacaaggacuuaaaacaggaaguuuuacauuagucaugcuguuacacacuuuguacucuuguuuauuucuuaaauucaguguucauaaaccaucagcaaauacacagugagucuauuacaaauggggaacuguccuggccagggguugaccucucuguugaggguggguugucuuggaacccuucuuuccauucucuuuccuauugcccuggcugauguggggaaugagguugacauucccauggugaacuuguauuccauuuggugagauauuuucccagggcccuuagcaggaaucccagauuaguuucuucauagaaauuguguuauaauuuggugauuugcuguguuaacuuuuuucucuugaauuauuagguuuauauucugcaguuaaaacuuuacuacaagaaaauaacuuacaaaaugcaaaaacaucacaauuuauugcauuuagaagguaaagcauuuauaauauuuuaauguuuuuaaucuagcuuuuaaaucucauaacuuauuaauauagauccuguuuggaugggagauuccaauauuucaucacuguuaauucucuuucuuauuuugggguaugucuuuguuagacauggcagagggcgcuuucuaaacagagcucuuuccaccaaguauuauauuuagaagcucauagggacucugaauggaacaaaagcuuaugcuaagauaaaaaauacaggcugggcuugguggcucacaccuguaaucccagcacuuugggaggccgaggcaggcagaucacuugaggucaggaguuugagaccagccuggccaaaauggugaaaccccuccugccuacuaaaaauacaaaaauuagccaggcgucauggcacacaccuguaaucccagcuacuugggaggcugaggcaggagaauugcuugaacccgggagguggagguugcagugagccgagagcacgccauugcacuccagccugggcaacaagagcgagacgcugucucaaaaaaaaaaaaaaaaagauaaaaaguagaaaaauacuauuuccuggagaaagucuuggaaacguuuuguagaaucuaguaugucauaauugcugauaacaaaaguaaaccuguagcagagaccauuaaggugaccccugcauuuucguguguuucaggcaagacugugaucuaauuaaugacugcugcugcaaacacuacacaggccaccucaccaagugagugucuucgagaacugaaacuuuuaaggacaguccuucuucgauuugcugguuuuuuuuuuugcuuugauguuugucaccuauuuacauauauucccaaaauaguuuuuuuucccauuugugaaauagaaugaucucuucaauuaaauacaauauaugaauacauccuugggaauugacauuuuaguaaugaguggaauaagaagaaaaauuaggagugaaauuuuuuugguuucaaccuuggcagccuucagcuucuccaagauaagcauggggagcucaggggaauuuuaaaaauuauguguguaguguuucugagaaucuuagcaacagggugccugcagagagcaacuuagugagugucugucuaucagagaaauaugaguguagacaagccacuguggucauacauaggaaaaauuaauucauuucucuugaauugaccaauaccugcuuugcacuaaguauagacauccuagauauguauaagguauagguggagugccugucugcugagggaaguuacacaaaaaucugucagguagcccaacaagaggccagaaagcaugggcuugaggccauguacccagggucccaguaacugugaugaugggccaggucguuucccucucccacgucuauaaaagcggguauggacacagaauuucccuuaccaaguuguaguaagaaugaaaugaaauaauguaccuaaagcaguuagcgcaguagcuggccuaucaccaccacuucuucaguuugcugcuguuguacugauauagugccauaauuauuacaauagaaauguguauaagugcuguaagaccucaaauaagguaaugauaagagagauuggagagcagaggauuaauuuuaaaggaaaaaaaucaaaauuuguguuaaccuuuagaauauaaggggaaagagagacaucagcauuuaagccaaaauuucuaacuugaaaaaauuugacugggaaaugucauugaguuugagacguugcagggaguauguauaaauaaucagaugacagcuaugggaaccugauuucuuguugcucauuggagaaugaaaguguuguaaauaaaauguggaaauuauucugaaaauugaaacgagucugaguaguaguuaauguuugaacaagugaaacggagacuuuccaaacuuugauuauauauuaucauuuucuaucccagagaccaucagaguagacuuguuuuuggaauuggugauaaaauuuguuguaccaggaaugcauaccucucagacuuacuaccugaaaauaucucuggaagucagcaaaauaaugaucuagaugccaguagugaagacuuuucugguacgcuuccugauuuugcuaaaaauaagcgugacuuugaaaguaacguucgacugugcaauggagagauauuuuucauaacaaauguaagugaaaacagaagauaauaucuuuuaacuaauuagagauauguuugguuauuuuauuguccuaggauucauucagaaucuaaugauaucaguugacauucuuguuucaugauuuuuuguuaaggauuuuuggcauccauguuuaugaaggauauggguaguuaucugguaauguccugucuggcuuuaauaucaggauaauacuggccucagaaaaugaguugggaagugcuucuucuuauauuuucuagaagauuuuaugaagaaacauuuuuaauaaaaucgaaguacuugaguaacaaaaaacaaggcauaaaugagacauagauuuuaaaaagcaucauuuccuuuguugcugcuuaaauguagaaacuauagaagugguugccuuguauuuguucucacaguguagauacccucacugaaagcugugaggaaaaguaaacugcaaagaaucuacucagacuuauguagucaauacaagaaaugaauguauagacuucaaaauaagaaauaacaggcuguucuucacagagucaaauugaagauaaguuucaaagacugaaaacuucuauuuguguuuauuaaaauauuuagguauagauauauuguuugugcugaaaugcaaauuuuaagccuuuugaaauucuuaaugguaauuguaauucuuauauuuuauguuugacccaaagauagaauaucuuugaacguauuugaacguagaacauauuugaagguaugcaaaauaguucuuugguuuggugacaggauguaacugauguaacuuuuggaaagagaagaucuuugaccauuaauaauauggcuggccuggaaguaacuguggauuuuaagaaacuaaugaaauauugucgcauaaaacaugcaugggcaagaacuauucacacuuuucagguaagaggagacuuuuaucaaaccuuuuaaauaauuuaccaaccuuagagcgccuugcauuguuuucguaaauuuuuguugcacuuauuagcaaacaaaaauuaggaaacaaaauacacaaaaguacagaacauaauagagaagacgccacccuuuugcucuuuuuugcuccagagcucucuuuauuuuuagaaacaaaggcauuauagguaaagucuccuccuucaggucuuccccucccugccugagucuccaguauggcuuggcauggcacuguacucaucuuaucuuugguuaaauucugauauuuuguucaucauggauccuuuugugccuuaauuuugauuuacaaaacuguuacauuaaaaugucuugauuuaucuugauugcugaguuucuugggaacccauuaaauuuuguacuggaggugaguuccucacuugccuugcccuaguccugggucugccucccgccuuccuccaaagugacuucugccccgaauuugguauauaucacuccuauucauguagaagcaauauauaugauuguuuucuguguuacugaggcuuauguaaaugguguaaucauguuucuauacuuuugcaacuagcuuuuauuuuuuauuuuuugccuuaucaacuuugugggguauaaugugcauacaguuucauuauaaaguugguugaguuuugacaaauguauccucucucuccaucuuugugaggcaaccuuuuauccccccgcccccaacuuaugugggaauauuguuagguuuacagaagaguuggaaugauacuacagagaguuuucauauaccuuucacccagcuuuccuugguguuuaacauuuuauaacuauggcauauuugucaaaacuaagaaauuacuauugcuguaagacugcuaacuaaacuaugcauauucgaauugcaccaguuuuuccauuaauguccuuuugcuguucuaggacagcauauugaguuuagugcaacuugccuuuaugcuuuauuuuaaugcccuugaauucucaucuguuauuagugagucucuuauuuaucucuuuguuuugagcuuccuucucugcuguugguauguugcuuuaauggagagguugcaucaaccuucauuuuuuuuuuugagacagucucgcugugucgcccaggcuggagugcaguggcgcgaucuuggcucacuguaaguuccgccucccagguucaagugauucuccugccucagcuucccgaguagcugggauuacaggcacaugccaccacgccuggcuaauuucuguauucuuaguagagacgggguuucaccauguuggucaggcuggucucgaacuccugaccuugugaucugcccaucucggccucccaaagugcugggauuacaggccugagccacugcacccggcccaacccucauuuuuaugcagaaaaauuuaggucagcccaaauuuucuacuaguaaacaaacauuaauuagcauagaguuuuguuuucuuuuuuaaguggguggggcuuuauuuauuaacuuaccccaucucgauuccaaaaagaauuugaaauggcuuauuaaaaaugcccacaauucagcugauuuuuuuuuuuuaaagguaaaaaagggucuggugugguggcucacgcuuguaaucccagcacuuugggaggccgagguagguggaucacuugcagucaggaguucaagaccaacccuggccaacaugguaaaaccccaucucuacuaaaaaauacaaaaaagguaacugggcaugguggugggcaccucuaaacccagcuacuugagaggcugaggcaugagaaucacuugauccugggaggcagagguugcagcaagcugagauugugccacugcacuccagccugggcaacagagggagacuucaucucaaaaaaaaaaaaaaaaaaaaaaaaaaaaaaaauauauauauauauauguuuauauagaaaggaugucaagugaaaaauaaggaugauaaaaugguucuugccaggggugguuggaaugcagccaugcccgcuucccuguuugcuaaugucgauugcagauuuggcuuuaaguucccuuaagaccaaaguuccccagguaaagugagaguaaaaguguaauauuucuggcucuggguccugaagaauuucuuccguggaucucuaugaugccauccuucaccuuuacgaaauuuucuuuuucucaguuuccucuguucugucucucuagaauuccuaauaugugcauauuagacuuccagaaguaguuaccuaaauuucuuaucaaacugucuuauuuuccuucucaucacuuugcucuauuuucugagagauuuccuuaaauuuauaauccaguuuuuuuuaauaagaacgaaugaagaguaaaggugucuuuauuauuacuggguugagguuggaguagauaucuuucugguuauuucaugguugaaguagcaucucuuagcucuaagaacauucaugauuguuauaucaacacacuguuucuuccaaguucaauuccguucaacaaauacuuacugagugagacucuguucuugguguuugguacaggucagucuauaaaacagacaaagauucuugccauugugaagcuuaaauuuggugggaaaggggauagagacagacacagucauaaaaauaaaaaaaauaaaaacaagaaagaaaacucuguguuauguuagaagguggcaaauccuguggaaaagaggugggagugggugcaauugugauuuuaaauagaaugucgauauaagccucauugagaagauaacauuuuauccaaagauuugaagaaggaaaagaaguuagucaugugaguaucugggacaggagcauuccagguugaggaauaaccaagggcaggguucuaaggugagagucugucugguauaguugagaagcaggaauagcaagguggccacugugggagacugacaggaaaugagacaggaaaauuaauaugagguaaagagggcaggaggaugguggggccaggucaccuccuagggcauuugaaggccugcacuauccaguauguuagccacuagccacguguagcuauugagcgcuggaaauguggcuagagugacugaaaaacuaaauuuuaauuuuaaaaauggauacuaggcugggcacagugucucacaccuguaaucccaguacuuugggaggcugaggugggcaggucaauugagcccaggaguucaagaccagccugggcaacauagugaaaccccaucucuacaaaaaauacaaaacaguagccagacaugguggcaugcacccauggucccagcuacucgggggucugaggugggaggauuuccagagucugggagcuggaggcugcagugagcuccuagcccgggugacagagugagacccucucucaaaaacaaaaacaaauaaacaaaacaaaaguuacuagauacagucauuggaaaacuucuguauguuggaaaaacuauguuuggaauaacuuggguaugugaaucuucuuuuucaacuacaaauuuuaugaacucuagaaauagauuaaguauuucugaugaaaauuuaguaucuaaauugaaauguucugguuguauaaaauauagaauuucaaagauguagucuuuuauuaauaacuuaauauugauuauauguuaaaaugaugauauuuuggauauguuagcuuaaguaaaauacagguauauuauuaacauuaauucuauccauuucuuuuuuaaugagacuacuagaaaauuuuaagcugcauauaugacuuauuuuauauuuguauuggacagugcuguucuagacuauuuuaaggacuuuggcuuuuaccugagugaaauggggagcuguugaagauuuuguggcucuucauacaagugguugaguuguagaaccaauuuauagaauagacauauacauaauuaaaaguaaauauaggaaacuuacuuccuuaagcaguuugacaguucugauuuucaagggagauuuaaagcaaugaggaaauuauuuauagcagguuaucaaggugaaguuaggugucuuacuuucugagguagacuuaaguaccaucuuggagugcagaauuccagggacagcagauauuuggcuccuguagcaugacauuuuaauuuuuaaucaucauucacucagugaggcacuggagaaagaacagugaguaggauaaaggugaagcucugccuucauggagcuuccagccugugauagaggaaguacagggugcuggagaguaauagauggggcggcuacuccagacaugggccaaauugaggccauggacugaggaaugcugacaggaccuggaagucccuugugcuggguggagcaugguucauggaaaagaaagggaaaaaaguaaggagaggagcagggccaagcuggcucuugaagggcuuuacaaacacauuaagggguuaggacuuuauuuggagucccugcgagccauuagagguuuuaagcagcaucuaauaugauuggguuugcauuuuacaaauaucacuguggcugccaugaggaugauggauugggcaagagaagguacagggagacugauaaugagaccauuaaguauuaauaauaguauaucuacuauuauuacuauauuuuucucaguguugcuuaauaauuaagaacuagguuagcugaguuuagguagacauuuucauauuugagaauguacaauauaaaguccaaggugaagaguggugccauauaucuguggaaauguauguaaucaaauaccauuuaugucaauuucugagacccagcaacaucggaaagauguauuuaucaaacuuuuacaaucugaggagcugcuucaaacucucugucuacgaagauagaagagcuugcugagcaagaguuuauuugcagcggauguguauuuuuuacuugccccaucuugucaguugucuucccacaauuuuuccuuuggcaggagcaaugucagagcaaugggggagauaaugguacaaaccacuucuuugucuguguuggcacuggauccgcugacucagaauauaggacuaagaauagcccucaaacuugaaauuguuuucuuacaguuacacggugauauugaguauuuuucuugccuauccaauuuuuuguuaaaagacaaagguucauuguuuucuuuuuuaucuugauaaaagaaauaaauugcccaacaauggaaaaauacagacaaguaggagaaaaaaaagucauccauaggccuuccauuuggagacauuaauaaaaaauuugguagaauuucucucuuuuuuugugauuuguuuuguuucauuguacauagcuauguucuuuuuuuauauacuuguuuuggaucagaguaacuauauugcuauacaguuuugaccauucucuauguguguguguaucuaucuaucugucuauauauauauauagauauauauaugguuuuuaaaauguggcuuuaaaguaucucugauguucacaaaauaguaugucaacuguguauauauuauauauauaaguauauaauauauauucaccuauugcuacuuaaaauuucuauauuuuaucauuacauguaauauuuuuauacauauauuuauauauaauauaucuauauguuuaccuauuacuggcuacuuaaaguuuucauauuuugccauuauauguaauaauggguuaacacauuuacacaugaagccuguaccaucauuucagucuuuuauuaggaaagguuuaauacugcaugcagucuuuaaaauuugcugcuggguuucuacaagccaguuguggaccuaugaaaccugaacuuagcagcauguuuagcaguguguuuagaguucuuggaggaugaauaaaaauggaacccauaaaauggacacauaauaauagucuggccagguagaagugcuugagagcacuuugaacacuugucuccuuuccuugucuguaaacugucugaaccuauuuuauagcauuuagucuucacaccauauuuuuccugccagggguccgaggagcaaacaguugucuaugugguggggaaggcgggccgccagcacuggcagcaugucuacaccgccgugaccaggggccgcugccgaguguaugugauugcagaggagucucagcuccggaaugccauuaugaaaaacaguuuuccuagaaaaacucguuugaaacauuucuugcaaaguaagcucuccucuagcggcgcaccuccagcagauuuuccguccccacggaagagcucuggagacaguggaggacccagcacaccgucagcaucuccacucccuguagucacagaccacgccaugacaaaugaugucaccuggagcgaggccucuucgccugaugagaggacacucaccuuugcugaaagauggcaauuaucuucaccugauggaguagauacagaugaugauuuaccaaaaucgcgagcauccaaaagaaccuguggugugaaugaugaugaaaguccaagcaaaauuuuuaugguaggagugauguuuccauguucccaaguuuuauuuaaauaucgcuaacuucggugugcuuauaaaugacugugugcuuuuauuaguguugcauugugcuguuggacuuaaaaacaauuguuuuucucauuucugucaaauuucccuuaccucacugucugauuuccccuucauuuccucacuccuuuucuccuucccagccucuaacugaagacaacuccccaaagcucaguucuuuuuuccuuugagaacugacucauucucacaguuucagccaucuccuuggcaccagugauuuggcuaacaaaguuuugacuauaguaacauuucaggcaccaggaauuagagauaagugagugacaguucucacucucacacugauugucaugguggagacagucggcuaucaguaauguggugauuugcugagugcucuggcacugaagaggaguuaaugaaccagcugccuaaucugcaucuuuguucccagaaauugauuuucuggaaccacagcccagaaucuuacucucuuuuccaauuucuccauuucaaucaccaucuuccuaguuacauggcuuaaagucuuagaaucaccauggacucgccuuccuuucacucucuaccaucuucuuggaugauuggugaccuggcugcccuccccuuucuuguucccauucucguaauguagcauucccccuuuuccaugguuuugcuuuccaagguuucaguuacccauggucaaccgugguccaaaaauauuaaauggaaaauuccagaaauaaacaauucgucaauuuuaaauugcaugccauucugggcagugugauaaaaucucacaccaucucauuccaugaauccucccuuuguccaguguguccacacuguggacacuccccaccuguuagucacuugccaccaucuuaguuaucggaguaagucucaguguugcagugcuugugucaagugauccuuauuuuacugaauugcuuuauuuuuuauguuauuguugcuaacuuuuuacugugccuauuuauacauuaaccuuuuuuauagguauguauguauaggaaaaaccaauacauuugggucugguaguauucaaggcuucagguguccguuaagauucacuucuuuguucaaaagcuucagagacucccaggugccuacaacauaaauucuagacuauuuagcuuggcauuugagaccuuucucaauuugauuccaguuuucucaacaucauuucauuucccacuaugcuuuuucugcuuuugucaagcuagugucuucaacucacuaaaaugaaucaaacuuuuucauccuccuuuugacucuugcugugucccucaucuugaaugccuuuuucugucuccuucucauucagcauuugaaaaaaacauuuagcaaaacauugaaaaaauaaaaauaaaaaccugccagucacugaucuaaauguuaagggaggaaagcgcaccagugccggcuuuguggacauuauauuccagcauaggcaauaaauacaagagaaaaucaaauuucagauuaagagucuaugaggaugaaaaacaaggcaaggacauagggaauggcaggggguguggugggcaggaggugcuauuuugaccaggucaugccucccuaaaaaggugacaugugagcugagcacugaauguuaccaaggagcagcaugggggccucugaggauguagauaaugcaaagccuggaaagggaaugauuuuauucaaagaggaaggcagguuggccuagugcagugcucaugccuguaaucccagcacuuugggaggcugaggcggguggaucaccugaaaucaggaguuugagaccagccuggccaacauggugaaaccccuucucuacuaaaaauacaaaaaauuagccaggcaugguggcagucaccuguaauccccgcuacucgagaggcugagggaggagucgcuugaacccaggagguagagguugcaguaagccgagauugcaccacugcacuccagcaugggcaacaagagcaaaacucuaucucaaaaacaaaacaaaacaaaacagaggaagguuggcuaagguggcuagugagcgaggaagagggugcaggugcugguguuggagagaugggcagggccacgggaaugaguugggauuuuauucugcuugcagugggaauucauuugagggcuggaagcagugguguaauaucaucugaugccugcuuaaacauagucccagcaugguggcucauaccuguaaucccagcacuuugggaggcggaggugagagaaucgccugagcccaggaguuugagaccagccuggguaauauggugaacccccaucucuacuaaaaauacaaaaguuaacugggcaugguggcaugcaccuauagucccagcuacgcgggaggcugaggcaggaggaucacuugagacugagaggucgaggcugcaguaagcugugauugcaucaugguacuccagccugggugacagagcaagagccugucucaaaaacaaaaccacaaucccugcugggugugguggcucacacuuguaauuccaacaccuucaggagccaggcaggaggaucgcuugagcccaggaguuugagacuaaccugggcaauauagugagauuccaucucuacaaaaauaguaaaaaauuagcugaacuugguagugcauaucuguagucccagcuacccaggaagcuaagguaggaggauugcuucaucucaggaguuccaggcuauagugagcugugauugugacgucccauuccagccugggugacagaccaaaacccugucucaaaaaaaaagaaaaaaaaaaaaaaaaagcaaggcuaggcacaguggcucacaccuguaauccuagcucuuugggaggccaaggugggcggaucacuugagcccagaaguucaagaccagccugagcaacauggcgaaaccccaucucuaccaaaaaugcaaacaaaaauuagcuggggguggugcugggugccuguugucuuagcugcuuaggagacugaggugggaggaucaccugaccccaggagguugaggcugcagugagcugugauggugccacugcauuccagccugggcgacagaaugagacccugucucaaaaauaaauaaauaaauaaauacauacauacaaaauaaacaaucccucuggcuucuguggagagggaacuguggaaagugaaggggaagugaggagaccaguaggaggucaucauggggagagccuagugaaagaguggggcugguaaucugugguuggaguguggaugcauuuuggagauggagucuguauaacuuucugauuagaugugaugagguaaaagagaaaguaauccaggaugauuccuggauuucuggcuaaagcaauuuggggaauagcagugccauuuccugagaugggaaagaugugaggagaacucguuuggggaaauaaagcguucucuuguggcgugcuguuguuuaaguuacuaauuggaaauguaccuggacuuguugaguaaguccgugguugguagaggaguuuagagccucagcagggaguaggguaggaaaggcccacuugggaaucauuggcauguagugauauugcaaggacuaggugaguuaauuucaggagagacugcagauagaggagggggccugaugacagaauucugggguauucccagcuuuuagagaucuggcagaggaggaggaacuaaaaaggagugugagugagauagaaggaaaaccagggcuguggggagggaauaaaagccuggacugagggggcuggugagagaaugggagcugaaagggcggaggaagcaguggaggcagguuuugaagagggcugcugaaaaaagaaggaaaggugguuguaucugaauagaggacuuguggucaaggaaaacuuuauugguuuguuuacuuuggauggguacauuaaggcaucuuaguguguugcuagaaugguccaauggagaaccagaaauucaugauucagggagagaggauaauugcagaauuggaguccugacguggguaagaugggaaaaaucaagagaauaacuagagggguugcccugagacaggauuagggacagaggacccuuuuuccaugacaaccagaaggaauggguguaguacguuggguauauauagcagagggaagauaaagcaguuccaagcugaucaccucaugccauccucucucucuucuuauuauaauccagcucaguuucuguguuguuccugaaggcuucuuuuucucugaacuccuguaggagggcacacaccccuucuguacugcaccuguaguaaccuuguuugacucuguaaauaaagcuucuugaggacaguguaucauuuuugaucugcuagaacauuugguacaauugcuguucacaugguaauaccucaaaaauacuuagugaucaaaauaugagucaugaauauauggcgaugaaacuuuuuuuuaaaaaaucagacauucagaauauuguucuuucagguuguacugaaagucauacuuuuauucuucuagugccccuccuuuaguuugacaguuccuuuuggaauugcuuuugaggcaguaaaagauccuuuugaauguuuauaagggaagcaaacuucuguugagaccuauucugaguuuaggaaauaacccaaaggcauuugcuuucugguuuuaugaguuagaggauccaauuuggguaauggauuuuguguuaaaaagaaaaaaaaaggugggauuauaaguaauuuccaaaugugguucuaauagaaguguaagaauugcuuuaagugcuggcagcagacuuguucaguugagucuuuaagcuuccaaggcuguaauaaagguaagaaggggccacagggggaacccaggggagaaagugcugguguaaccugccagaaccaggcugaguuguaaauggggaauacuuauauccucuguccccauauggauauggcacagggaaaacguucucuaggagucggucugacacagggcacgguguguggaguccuggcacauuaggagacuacagauguagaacagcauggcuggagcacagggcacagugagaggaugggcugcagacacaggaacuggcagggaggauggacacagggucuucugaagaggucguagauucuucugauugcaacugagaacaguagaagcauuuuaaguacucugugaauugaaauuuaugauggugauauugacugagguuuaguggaugaugaugguuagggagagaguagggaaugaguucucagccaaaagauuauuucaguaaccugcguaaaaugaggagguucuaacauuagguaguagcaaugggguuggagaagagaugcuaaggauagagcugaugggacuuaaugaucaguuggauucaggugggguugggccugaggauaacuccaagacuucuggcuaaggcauacagguggauccagcaccauuaaucagauugggaaaagagucugagggucagguuuugugggaaaagugaguaaaauggacauaguugaggguggagggggaaguuucuucuuuuuccccucuuggacaguagaaucccugcugauucuagguuccauuuuguaccccaggucaacucuuugauagaauuuccaucucaggaaaauaucuuuuucugaaauuaaacuugucaucucuuacagagguccuggaauaaggcuuuugacaugagcagaaaagagaggcaauuccaaagaaagacccuuuuccuaaaauugaauugugcuuacucuuuucauuucuuuaugguggugaaacuucaucaugacgauacuggcccacuucagaaucauuaguagcacaaagaauaugacuguggcauugcaauguuuuaucuuacacauccagaacugacuucaugggcaggcaacaugggcaguccuccaggacucaggcccacacuuaaaaaaaaaaaaaaaaguucuguaaucaccaucuugaaauucuuaauuuugaacaaggggccaucauuuuaauuuuggacugggcugccaaauuauguagugggcccugucuacaccuuuagaaguuagacacacauacuaauucaguacauaguuacuucuaaaugccagacccagagcugggugcuagagauaccacagugagcaaagcagaugugauccuacaaggagcugauagccaauugcuuugguugcugaagccuuucaaggguuggggaaggugcaugauuucuuuuucugaagcagagggaauacaaguacguaggguagacuaacuacauuuuuacaaaauuaacuuuguuauuuuaauuguucuaacaggugggagaaucuccacaagugucuuccagacuucagaauuugagacugaauaauuuaauucccaggcaacuuuucaagcccaccgauaaucaagaaacuuaguuuuauuucaaauuguuccgaguaacuauguuuuucuauuggagacaaaaugaacaucguaacgucaaaguaccaagauaaaaaaaguuuccuauaacuggaguuuuaagguauuuguguuagcaaauguuuuaaauccauuucaucaaaguauuaaugauuucaacacgucaucaugagaacugguagcacuggacauaagugaagagauuagauauuuuauauacauauauauuuuuauacaauuauguacauuaagccaggcacgguggcucaugccuguaaucccagcacuuugggaggcugaggcagguggaucaccagaggccaggaguuugagaccagccugaccaacauggugaaaccccaucucuacuaaaaaugcaaaaauuauaugggugugguagcacaugccuguaaucucagcuacucaggaggcugaggcaggagaaucgcuugaacccgggaggcggagguugcagugagcugagauugcaccauugcacuccauccuggguggcagagcgagacuccgucuccaaaaaaaaaacaaacaaacaaacaaacaaaaaaaaacaaacaauuauguacauuaaaacauuguauuuuuaggauaaugccucguaacuuugaugaucguuguguguuaccuuugccaauggguugaagcaguggcaaagaaaagguguaauuacaucuguugauguuauugacaugccuccuaggauguugaaauguggucauuuuacaagacugcugcucacuucaucacugcugccuggggcccagccuaccugggacuuuuccuuggaagugcuuucugaguugggagcacauuguuuugaauauguuccacuuaggaagguuuuuucucucucagaaugauuugauuuuuaaauuuuuauu

SEQ ID NO: 16408 - RNA, 60350 nt, Homo sapiens
guguuccucgaugaacauggauaguuuuucugacaggauaaaaaagaaguaguccgggacaguggcuaacaccccgaaucccagcacuuugggaagccggaggugggaggaucgcuugaggccaggaguuugaaaccagccugggcagcauaacgacacucccucucuacgaaaaacgaaaaaaaauaauuagccggacgugguggcgugcgacuguggucccagcuacucgggaggcugaggugggaggaucgcuugagcccaauagguggaggcuccgugagcugagauagcgccacugcgcuccugccugggcgacagagugagaaccugacucaaaacaaagaaaaaaggaagaaaagaaaggaagggaagaaggaaggaagggagaagcuuucaaaaauaaacuuuuguaagaaguaaugacaccgcuagccguccacaccaggagaccgccuagccguggggcacggugggcuccugggagcucugagcucugggcuuucuccaguucgcacucugcuugucucggcagcuccguccccaccgcagaggugugaaggggcgcaaagccagcgaagggagaacccgggucggguaacccccaggccuggccaggcggacgcaggggcaucucgggcgaggcgcgccuugcgucacgugggcaccgccccugcagugaccggagaacggcguguuccuagggcucugcugccgucguggaagcaggauuuccgcgguuguguaacggccugucgcaggcgugcagggaccuggacuccgccucguccccggggcucgggcagccgagccauggcggggaacuguggggcccgcggcgcgcugucggcgcacacgcugcuguucgaccugccgcccgcgcugcucggagagcucugcgcuguucuggacagcugcgacggcgcgcugggcuggcgcggccugggugagucggcggggaccggccgggggcggcgggggagcccagcgcgccgcggggcccgcucggcgucgcccugcauggcuggggucccucgcggggcuggcgcggccuccgggaaguucccgccagggagccggcccccuccuuuccuggguuggaugcagagacucccugggacccagaugccuucccucccuucucuuucaaagaauuuuggguaucgcugcaaagucaagggagccgaggccugggaaagacagauaaccagcgugaaagcaucuucuguucguccgcgaugccacccucacuggguucgcaauguaugaugucuucugguccuugcaaaaucaccccagaacaucauuuuaguauugagacauuuuuagaacuuugagauacuuauccuuugguguuuucaaugcaucccuaagccccuaacuuaauuacaagugaaaugcuaaaguaaacuacgguuugcaaugaacgcggcuccuaauuuucuuaauuaaaucuuauuuacccaauuucguugaaugaagguuuaugcuaaaggguggcuuuuuauuuuaaucuaaaaaaauuggcuucagaacuguauuuuaugcagacauuggaaaguugagcaacugccugcuggaaguguugaguguagccagagauaauucggacaaaaaucuucguuuuguuaaguacaggcauuuuugguuagauuugauauuccacaaugucauguuuaauguuuauugaaaagaaucaugauuaugucaaaauaacuuagcuuuaauggucugaaauaggauuuuucuuaccaggacuagcagaaggccuaagaggagaguuuucuuuguuacugaugaacaguauggugacagucuuugaauuguagcaaugggcuucugguuauacaaaaaauguuuauauauuuuaagcucuguaauuuuaaguuauggcccuuaagaaaaaaaaaaaagucugauuucuagaaaacgagauuuccagugugcauuugagggauuuugagggauaaggucacuuccccaucagaucuuuuugagauggauuuuggcguggacaguauuuauacccguugauuuccuagaguuacugacuuugagaaagaaaaguguuuuuaguccaguuuaauguuggugaauggggccaggugggugugguaaauuagugaggcagauuauucucucucuuucuguugauagcauugaaauccagauauucaugcuuuacauggcuugucucauauaacuucuccaauuacucugugagucauuaucaucgccaguguuuuuuuaacaggucaggaaacugguacaaauugguuaaguaacuuguucagguucaccagcuggaaauggaagagccaggaucugaaccaugguagucuggauccaaggcuuauguccuuaaccccagcuacucuacacuucuccccuuacugcuguguucuuucuggccacaucuaacagccucccuaaaguacagacauuucuggcaucaaagaacaauucagugauccauuucaagcaugcagcccuauuuuccuaguggugaaaaugaaugaggaccacccaaaugagaacaaacaaaagcuauuuuuuucaaagcaagggagccagcaccauugcuuguguuuggcagagacucaaaagcagacagaggauggaggagggugggagaagaaggcuucagcuguguccugauuggaggcuguugauauggggaagcuguaguugagcuaccuaaaaggggguauuuuguguguuuguuuagggguacauaauuggcuuucucugguuggcccuaaguuggaaguaggagcaaaaauugaggaaguggucaguaauuauucaaguccuggccauuugagacagguugcuacagggguucuuguuuggcugccugggcuaguugcuacaguuuaacccaguuacugauaguuuaacuuguuagauacuguagacgguagguugguuucuuggacugguugauguacauugccugcagaguucuauuuuuauauauaagcuggccauugucccuuuguguauucauucucucacagggaaagggucuaaaauguuuacuccaugauacuucagcuguaauucauugugcagguggucaugccuacugacugccuggacuacugagcuggcccugaccaggugcugcacaaguucuuggcucagcaagaaggcaaggcuagcccaguucaggguguugaggcaacugccugugcuaaacaugccgaguuuuccugugggcacagcgaagggagaaagaggggaagaggugcagguagggaaaacuugaccuucgagaggggaaggagagugacagaggacugaaucaaagaggcaguccuuuguaugcucaggacagcugacagcccaagcuuaaauguagaaaacaacuguaauauacuaaguaaagcucucucgagccgaucgugauucuugaugacggugagugucagguuauguuuacaaaggcagcucauauagcagccuauaugauaugaccagugugugcaggauaagguaagccagucauucacaaacacaaaucaccuaugcagucuuuuaaauacacagaugcaggucccacuccuagagcugcugauucaggaagucuggguugaggguccagcuucuuucauuuuuugucaagccccaggagugagucugaggcacaaccugauugguaagccauugcuuaggccaaauucucuuuuuuaauagugucuucauauaacagauauuuuacuacauucuuucauuacuucauuuaauuacuuuuauuuuuaaacauauucuacauaguacucuucaaaucacuuuugucaaguauuguuauuaaaaauaauguaaucacaagauaauauauucugugguuaucauugaugacuuuauggcuuuuagugaaagcaagagcccaaaagcccaaaugaaauauguuguuuacguuacagacaugauaacguaguacauacagaaccucuggagacaacucaucugauuacauuaccauagauugguauuuaaauuaaauuauuuggagcagcugacaccguaaaaaccucucaacacuuacgauguacugagaaacgcuuuuugcaaaugauauauaauaggcuguauucaauuuucuuccucucaagaaagaaaagggaaauuauuauauaaaucauuaauaauuacuuuaaaaauuaaauguaaaaucacauuaagugugcauuuguauauucaauaaagauucaaaauaauaguaguaauaauaauaaagcuaccuccugucaaggcuuacuauuggccauugugguaagcauuuuacauggauuaucucauuuacuuauuacaacaauucuaucagguagacacucuuccuauuuccauuuuauagauaggugaacugauucucagagaauuuaaguaacuugccuugagucacagucuucuaaauggcacacuaagauucuaaccagaugaucagacugcauauucuauguucuuuuuuucuuuucuuuucuuucuaaauuuuaaauagauguguuuuuuuauguuauuauuaucuuuuuuuugagauggaguuucgcucuuguugccuaggcuggagugcaauggcgcaaucucaguuuaccgcaaccuccgccucccggguucaaaugauucuccuaucucagccucccgaguagcugggauuacaggcaugcaccaccaugcccggcuuaauuuuuuuuuguauuuuuaguagagacaggguuucuccauguuggucaggcuggucucgaacucccgaccucaggugaucugccugccucagccuccuaaagugcugggauuacaggcgugagccaccgcgccuggccuagauguauuuuuuuaagaacaguuuuaaauuuauggaaaaguuuagcagauaguaggaagaguucccagauacucuacauccuuaguacacuccgcacccaguuucccauuauuaacaucuugcaugagugugcugcauucauuacaauauugacacauuauuauuaacuaaaguccaugcuuuauucagacuuccuuugcuuuuacccgauguccuuucucuguuccaggaucccauucaggauaccacauuacauuuauuugucguauccucuggcucuucuuggcugugaugguuucucagacuuuccucguuuugaggaguauugguuggaacuuauccacuauuuuguagacuguuccucaacugcgauuugucugauguuuuucucaugaucagacugagguuauggauuugggggaggaaaaccauaaaguacugaccuguauccagggucgguacuauuuacaggaguuaucacugcuuauguuaaccauggcugagauggcaucugucagauaucugcccuguaaaauuacuucacuucccucucuuucuguuucuuacuuuuuggaaggaagucaccauaugcaguagagccugcuuuuuuuguguugcuguuguuguuuuggagacgggaucucacucugucauccagggugaagugcaguggcacaaucacaacucacugcagccucgaccucccaggcucaagugauccuucccaccucagacucccaaauagcugggacugcaggcacaugccaccacaccuggcgaaguuuuuguauggauggggccaggcuggucucaaacuccugggcucuagcaauccuccugcuucagccucccaaagugcugggauuacagaugugagccaccgcucccagguaagccugguuuuuugaccacuguguuauuucugucacaaguuaguuagacaauguuaugucuagcucucacuucucuaagcuaacaccccacugcucuguuccucuuugugguaauauuccucaaaagggcuauuuauacuccagguccuccauuuuuccuugaaccccuccagucaggguuucaccucccaccgcuccauugaaaguccugucaucugaagucacuacagcuaaauccaaugguugguucaaaguuuugaucuuauuugauauaguugaucacuccuuucuccuuucuucuugaagugcuuucuccgcucuagaacguuacaugccccugccggacgcggugguucacgccgguaaucccagcacuuugggaggcugaggcggguggauugcuuguggucaggaguccgagaccagccuggacaacauggugaaaccccgucucuacuaaaaaugcaaaagauuagccgggcgugguggcaggugccuguaaucucagcuacuugggaggcugaggcaggagaaucccuugaaccugggaggccaagguugcagugagccgggaucacacuaccguacuccagacugggcgacagagcgagacuccucucaaaaaaaaaaaaaaaaaaauuacaugcuccuugauuucuucucuucuuauagauuuaucucaaugucuuagcgugccccugggcuuaguccauggaccuugucucuucuguuuaucugcuaaauucacguaaauucaaucuauauacuacucccaaauuucuagcccaagucucccucuggaaugucaucuucauccaucuauuugccuauuugacagacaucuccaauuuaacagcucagaaaugcucccccagcccucccaaaguuuucccaucucaguaauggcaguuccauucuucauuuguucaggccaaaaauauuagccuuuugugacuugucacuuucucucacaaaccacauccuaucucucaguaaauaaugcugcugacugugccuucaggaucugucuaauaaucugaccauuucuuaccacugccaccguaaccaucuuggcaccaaccaccaucgguucccaccucuacuauuuuagcaguuggcugacugggcucagacucccugcuacugcccuugaccuccuugagugucuuuucagcccagcagucggcaagccugugaugccuguaaagcauaugcuaucauugcccuauucagaacccucuggcggcuucccaggccagucagagcaaacccugaaguccuguguggcuuuucucacuuucuucucccucuuguuugcuugacuccaaccacauuagccuccuuguuccuugaacacgcaaggaacguucuuccugccaguaaccuguaggcuugcuucuucacuuccuucauguuuuuguuuaacuauuaccuacucugaccacucuuuuguuuuguuuuguuuuuuuaagacggaguuucgcuuuuguugcacagccuggagugcaauggugcaaucuuggcucucugcaaccucuaccucccggguucaagagauucuccugccucagcaucccgagugggauuacaggcgccuaccacaaaaccaggcuaauuuuuuguauuuuuaguagagacgggguuuaacuaugugggccaggcuggucucgaacuucuggccuuaggugauccacccaccucggccucccaaagugcugggauuacaggugugagccaccacaccuggccauggccacucuuuuaaaauugacacccccccccaccacucucuuaugccucuuuuccacuuuauuuuucucuauaucauuuaucaccucucacauacuuuauguauguaaguaucucuauguauauauaaaauaaacuauauauauauguaaacauauauauguuuauuuguuuauucuucaucuagaaauaagcuucaagggagcagggauauuuccuuccuuuguuuccugcugacucucuuagcaucgaaaauuguacuuggcacagagcaggcacucaguaaauauguacauucugaauaaauuaaugaaucaacaaaugucuauuaaaaaccuuguuggguugucuauuaaaaaccuuguugggcagaaucuuugauaaagcacuguaaauacaauguccuagucccugcuuguaagaauuuuccaauuuaguguaggcaacagaccuauaaaaguuuaacaagggaagaauguguggggaaauaguauugauauucaccugggaaugaaauuacauagcuucugacugaaaccuugguguugagggugaauuaucucccagagguaguuaauguuagguuccuaccugugucuaggauuaagagagcaggacagacagaggggcaccugagaagucacacacagcccuccgcaguuaugaguccuacucaggcaugggguaaaacauacacaugagcuuaaguaugaauaagaacuauuucuuauaaaauauauuaacuaguaaguguuaaugcuaacagucugguaugaagaauagaucuaacuuauaauuuugacuuuuguuuuacucuuuuggaauuaaaaaugucuuuaaccuuaaaaguucuuuuaaaaaauugucuaauuuuuugcaugcuuuguagaaagaaagagacaucuuuccuuuuucccuuacagugucuaaaaacaagcuuugugagaauggagucuuaauuuugcagggguuuuggcaugugguuguaugcaaauacaaagauuccaaauacggauguguugcauuauuugaaaaaaccccuucagagacauauuugcauauggagacgugauuucugcaacugaaaacagucaguccugcacucucaaaacagccuucaaggacuuuugagcaucugauuucugaacuucuuagguugacuuuuuggcuuaugugacuccaauacgacuuucaacaaagauuuguguuccaaaaaaugguuuuaaacaaugcuuaacuaacagcauguuuuucuuaauuuguauuuucaguuuagaaugcuuuuaacuuuaucaacauaauuagucauugagaacuuuucucuguauuuuuauuugauauguacugcgaguaaacaaaguccuauauucugaaaggggacacguaagggagaguugaagaaaaugauaaauauugaagaauguaauuaacauguugagaguuugcauuccuguuguaucagauuggagcuauuuuauagaauuggaucuaaaugaaguauacauuuuauggaugcuaaaaauacucuuuagcaauguuucuauucagaaugcaucaucauuagagaaaagcuauuaagguugcagugugaaucaccaguuggaaaaagagaaaacauauuucauuuccaguccggaagcaauccaugcaugcaggcaguauucauuuuaacagucuggaucaguuuuuuaccaugaacuucugcuauuagaaaaaaugccuuugucuaaucuagcuuuccuuagaugugaugcaaacucagaacuauaugccccggucaauguuagagacccuaaaaccccagcucauuuggcaucuguucauucauauuccagcugaaucucagaaaugugcuuaagggaaagcaucugauauuagcaguuucucagccaagucacaggacgggacaucccagagucauggccugcugcacuuuuaaaagggaaauucaggaaucaaaaaaaaaacaaacagagaauggaauuuauggaaaguauggaaugaaaagcugacauucccugggacuugaaauguuaacucuggauuuccuuaauagcuauaaacugugccuuuccuacuguggcaauuguugugagcuagaacauguuuauaccuuuuuauguauaaauauuuuaucugagacuccugcuacuauugccacccgaugcaucuuccaaaagguaaagcuuccaucuuugcaucaccuucucagaaaucugaauuggucccauugcuuucagaaugaaguuaaguucauaugcuaacacucagggccucugucugucaaucagcaaaaauauauugaacguguacuauguggcuaagcauguuucugcagauacaagguaacauggagaccucauggagcuuguucaccuuuucuuuaacgugaacacucugcuccaagcauucuggccuucccucugcccucuuguguugucuucacuguuucuggaacaauuccccauuugacauacccuuuucuauuccuuuagccuaguuaaaccuuaccccacgacacgacacuucuauugcaaagcuaggugguauuugguuacccuuccuuuccuuuccuggcugugguaguccacaaaagcauuuucucccuucagucuuguuaaauuuugugcauaugucuuaucccaaaguuucaaaggguagcaggaacgauuuuagcuuacaaaagaaaaaugaagaagucuauuauuuaaauauucauuacuaugaauuuauaugauacaggaugccuaauacuauguaaauauuagucaauuaauuuucuuuuccuucuccuuuuuuuuuuuuuuuuguuuuuuggaggcagagucucacucugucacccaggcuggacugcaguggugcaaucuuggcucacuguagcuucaaccuccugggcucaagcuauccucccaccucagcuaccgaguaguuaggacuauaggugcaugcacaccaccaagccuggcuaauuuuuaaauuuuuuuagagaugggguuuugccauguugcccagacuggucuuaaacuccugggcucaagcgaugcucuugccuuagccucccaaagugcugggauuacaggcgugagccacuacacccagccucgauuaauguucuaauagaaaauguggaaaccuaaacuuucccuuugcugaaauuugauauuuagaguucucuuguuggaauguucauuuugagagugggaaguguuuuaaagauaagagguguuauaauuaauuaacaggccagggaagagcaagaagauuuauuauauguauuaggugggacuacaagaacauuuguuauuaagaaguuugagauuguucagugaggcuguguuuugccuggaguugugucauaggucgauggcagugccaccacuaaauacauguguuccuguacucacccagaggcccacgggaaugcucuguuuucacuaagaacuuuuuuccuuggaaagcaggauagucugcggggcucagacucauuuauuugucuuguuuucaaucugaaacuguagugauuauuuuuuccuccccaggauaguguacucuauccaauacuucuuuaagaauuggccucucuuuggaaguacucaguuuuagacauggcauagcucaggcuccagaagccaccccuccagaaagccuucccugcuguucucaucuuuaguuagaggccugucuucaugcucaaaccacacuuagugcauacaauuacuguauuacuggcauauagcagauacucaacaaauguuugaacuacacugauuugcaguauuucucuuaagaguuuuuagaaauagcuaaauaaaguguuuauaaaaaaugugccucaaugauauaggcagauuaccucaucagaaagaaauauauuaaaauaacauuaccauauuuggcuaauauuuuugcuuuuuaaaggcuuccuuuuaaaaaugauaagcuaucuaaaacauauauuggcauuuggauagucuuugccucugugaaacaucaucucuucaaagagaugaggaaugaauauauucuugccagaacuugaaauauggaggaagggcaaagacauucuaacucaaugaugucagacauuuuauucuagcuauuuuucuuuccuuacagccuaaacaugcauugaaauagaaugucucaacuuuaucuucucuuguuugauauguaauugcaaaugcugccacucuauuuaacucuguucugguacaaguuguaacagaguaacaaaauucaagauaugaccuuguguauaucagucaggauaaacuaaguuaugcugcaguaacaagcagcaccaaaaaucucagugguuuaacauagcagaggcuuacuuuuugcucccaggaagaacacugagaguccagcaaacucucuuccauguagugacucagcauuucaggcugcuuugaucuugaggcagcccccugucaacuuguagugaauugugcccugguucuucaguguuucuggcuggaagagacacagaggcaugccuaaccugaaagggcagggagauggaauccucuaugaugggauagaggguuggaaguauuggcagcacuaguaaugucuaccgggucaauuuuuagcucauagaaagagggccagucaugguuucauauugugaacacuuucaauuuucaggauuuacucacagccucagugggagcauaaaguugagguaaauugaauauuccagcaaaggcuuauacaacgaaaaauugggcaugggggggaugccauauuaaggcagaagauauuugccuuucugcuggcuugauuucaaauauuauaacugguguagaaacucccuaagaaauuaaugaccuuuggacucuaaaacagacuuuuguguguuuguguguggaaacagagucucacucuguugccuaggcuggagugcaauggcgugaucucagcucacugcaaccucugccuccuggguucaagugauucucccaccucacccuccugaguagcugggacuacaagugcacgccaucacaccuggcuaauuuuuguauuuuuguauuuagucaagaugggguuucaccauguuggccaggcuggucucaaacuccugaccucaagugauccucccgccuuggccucucaaagugcuagaacuacagaugugagccaccacgccuggacccaaaacagacuuuuaacagaagaaaguuucacaagacuuaucauuuuucugagaucugaacaaccauugccuuuuaaaagcacaucugccuuugaagucucccauugguggacaggggaguccuaucuccuaugagaccaccuugguuccugcuggagggcagcuuccacauauugguguguggcaggaugaaaggaugcugagcuccuaaagccaguuaugguggugugucaggggucccccgugaccaccuucagauaacagugggauuuuauccagagacuugcauccaggauccuaaauuuuuuaguuucucuggaagguaaaguuaugaaaggauggugccaucaccaccaaaagcccaaaacacauuguuaauuuuagugcucaauauuccagauugggaauauuaucauaggaacaagaccaccuuuucugucauuugcuuucuuucuccccgcuuugccucaaaguacacuuuaaaauuuggaaguugugcagaaaggcaauauaaauuuuugcuugaagaauccuguuaaaucagggcaccauaaaaacucauauacuuucuguacaguuuuaagauguuuaugccaaaccuuaauugaauuauuuaaagccuaguaugcuaguaaaacauuucccugauuuuacccagauauuagcuuuuaauugcucaaaaguguucaaugggaagacagggggaacaaaacaccauuucucaaaccuucaacagcugaaucuaacuguauuacgaaugaauaauaaccacacugaaggggugaggaagaaaagaauuaaucuaaguacuuuggaacacagcaucuuaacuggaugcgcuuaugcuaaggacagaaauaauuauuguguucugauuuugcuaaugugugucucacagggguauggguuggcaauucugaaagcacuuuaugugcauuguagaauuaaacaaaugaguaaauauauuaucaauaauauuacuguucaagaauaaaguuacaaaugaggaaggacugaaauauacccugugauguuggauuagaaucagaagcaucagaauaaauucuugguauuuaauauaagcgccuacugauagaggaauagagauccacggaugaguguacauaccuacauuuccuugcucugugcucuuggagggccuagaagcaauggaacccuggccacaaugagcaauucuggcaccaggauugagcuucuauacaccauuguccaaucaagaaaccagagaucauuagacaaauaauuccaguccuggaaaggggaaaauacaaaaugagccuggagcaccuuguagagccagaaaauaaggagauacucacaaaaagauagggcuugucaaaagaacacaaaaggccugccgugguaguucucacauguaaucccagcacuuuggaaggccaaggcgggcagauugcuugagcuugauccuaggaguuugagaccagcuggggcaguguggcaaaaccccaucucuaccaaaaaagaaaaaaaaaacccacacaaauacaaaaaugugcugggcaugguggugcagugcacaccuguaguugcagcuacuugggaggcugaggugggaggauugcuugagccugggagauggaggcugcagugagcugagauugccccacugugcuccaaccugggugacagagugagauguugucucaaaaaaauaaaauaaaaauaaaaggaaaaaaaaaaagaacacaagagccaaccaaccuauuggacaaagcuagaauaauuuuagcaacaaaauuauuaaugauaguacuggauuuuaaccuguaugguaaaauaaauauccaugagcccauagauauaaauaaacaacuggauaaauaaauaaauaaauguaggagaagggacagcuguuucuuaccaaacaguucaugaaggaaaaagggaaaauagaaaaaucaccauuaagcaaauauuguaguaauaauugugauaaauaagauccacugguggaugcaaauauuaguggcccaaaucugaggagaagcagaguauuuccauaaucucaaaguaucuuccccgaaauauuuauuaauuauaaagagaaagauaauuuuauaguagagaagcucugcagacagucccuucacugaaugauaaaaauaaacauuauuauugauaagacauugcuaucuuaaaccucuugauauuaugcacugagaaggacaauaucauuucacuguccugaaagacaaggaaagacugagggaccaucauagauuggaggagauuaaggagaaggaacaauuaaauauaauauggaaaacuggauaggaucuuagaacagaaaagaggcauuaguggaaaaacuagugaaauuagaauaagguuugcaguuaucacugauucugaucauuguauugugguuaguaagaugucaacauuagcagaaggcaggugaauauauuccaaauuaguucaaaauaaaaguuauaaauaagaggaaaguuaaaguuauaaauaagaggaaauaaaacauuagguacacaaaaacaaguauuuugauaaaaguacaguaaacaauucuuuguuuauauugcaauuuccacagcagagagacuuucaagcagcuggcuggauguucgucauauugaaaaguauguagaccaagguaaaaguggaacaagagaauuacuuugguccugggcacagaaaaacaagaccaucggugaccuuuuacagguccuccaggagaugggacaucgucgagcuauucauuuaauuacaaacuaugguaaaugcugauucuuauaauguggcucuuaaucuguaauaggaacuguaauuuguaaauucgaauauugcauuuuauccaagacauugacucaugcucugugucaguguuuccuuaccuguggcuuuuaucuggaagggacuuuccagcuucacauuuucuugugacacuuucuucccuuaucaccuaacuuauacaacauauuucuuucuaucacuuuauaguuuuguuuuuuuaacuuacuuuuacuuacaaacuacacuuuuaaaaauguuucauuuuuagcaguuaauagaaucagcucucugucaaaaacucugaaacucuuugagucauaaacaguuggaaucacaauauuugagauacagaucaugcuauucuuuguuuuacuauauauuacaaguuaaaaauauaauuguauuuucccccauauuuaauauuuuauauuguaccuaccuccagaauaaucuggggauguuucuuuuaucuucacugcuguuuuuacaccacagcguuuaacccugccuuacuuguuacuacccauuccacaguagccuaauucuucccuuugucuucucuauuucugggucugugucaugccuuauauuuagaacaacaugaucaauaaaguucaugaaguuuucuccauuuauucuuugucagugaaauaaucuaacaucaccuguucuguuuguuccacuuagauguauucauuucaacaauaaugaucuugggucuuauguuauagacccaaggcucuuagauuggaaacucuuuugaaucaacaucuuuauucuuuggcucuuuucauagaucgcauuuuuaguuuuguguauuugcacacauguucuuugguaauauauuuagugcgcaugagcccuugcgcacacacacacacacacacacacacacacacacacacacacaaggaauccugagagauuuguaccagaaaacuguagcuucacauugacuuuuauuuugaucuuuccuauuauugggauauuaguuccuaauagacuuccaccaugauauuauucauauaacuuggcuaauucccuuugucuuuugcacauuguuucuucacuuaguuuagggcagcagaauacuucacugugaaguugacugagcaagugaaauucagugagucccugggaacuguaaaugcaaugccuuuucauuaucugagccuuucccagccacugaaaccacccacauggcuugcuguucacaauacaaacuuacgccacuuuaauaggacacacagguauguuuuauacuucaguguucuggaauaaauuuuaggguauauuuucacucucuauguuguuuauuugugcagcagagaauaauguggacuguaaguagacaaaaauuccacauucuugguugacucuuagucuguugcacaugcaacauuuauuuuucuuuuuuugaugugagauuagccgauugguaaaaagacuuuacugcccuaguacaaagagauagguaaaucugaagugaagaggaggauagcaccuuacuucuuuacuaaagaaaauagcauuauuuaauuguaauugauugaguugauguuucaaauuaaauaacaauuuugaaaaaguuaauuauguaguuguuaaaagugagaugugaugauuuguuggaagcauaaguguagcuugcucaacaggcguuuccuaucauagcuacucauuaaauuaggaguuggagcuccuaacuaaagaugcauaaaaugauuuaguccuucuaugcugccaccguggacagauuuaucaguuaucuaaauaaucaguuauugcccaccuuuccuugcaauuuuauucuguuuuguggaacugauuuuauuuuagaagaauuuggggcuuuuauauuccagcuuccaggcaucacuuuguagauuuggauuuuccuagucauauugaaaugggccuuuuauuuccucccagguacuaugccuacaauucagguugcugcugcuaggugguuucuucacaucaguaaagcauucucucagaucucaggacauaacaaaauugcucaagaaacuagaaucucuauuuuuuguuauuauauuucuggcaugcauguccuuauguaucacauuuuguauuuauaauucaauguucagcaauuguuuuccaguuuugacacaaaauucgcagcuuucuacuggcuucuucuuaagagagacauuuucaaucuuccauuuuauaugacaaugaaggauucucucucuuuucacaaacagcaaaagaaauaaugacuuuuagugcccauacagcccccagauuucacauuuuuuucuacacaaauucaguauguuuguuauuuuuucuucuugccuaguugcccuggcuagaaccuuuagcauguugaguagaaguggcaagaccagacauccuuaucuuguuccugaccuuaaggguaaaacauucagucuuucaugauuagugauguuaacugucgguuuuuuguagauggcccuuaucauauugaggacauuuucuucuguugguagggcuuuuaucaugauaggguguuggauuuuucagaugcuuuuuugucaucuauugaaaugaacauguguuuuuuguccuucauucuguuaaugugguguauuacauugauugauuuucagauauuaaacaaaucuuggauuccugggauaaaucccauuuggucauuguaucuaauccuuacaugcuucuggauucaguuugccaguauuuuguugaggauuuuugcaucuauauuuguaagagguauuggucuguuguuuucuuguaaugucuuuauccggcauugguaucaauaauacuggucucauaaaaugauuugggaauuguucuaucuuuuucuauucuggaagaauuugugaaggacugguguuaaucuucuuuaaauguuugguagaauucaccugugaagccaucuaagccucggcuuuucuuugugggacguuuuaaaguacuagcucaaucucuuguuaugaguccauguauauuguuuauuuuugcuugaguuaguuucaauaguuugugucuuccuagaaaccuguccaugucaucuaaguuaucuaguuuuuuggcauaucauuguucauaauauuccuuuauaauuccauuuauuucugugaggucaguauugauguccccccuuuuauucuugauuuuaguaauuugaaucucuuucuuggucaguuaagcuaaaagauugucaauuuuaaugaucuuuucaaaaaaacaauuuugguucuaucgaguuuucuuuuuaaaaaaucuucuauuucggccaggcgagguagcucaagccuguaauccuggcacuuugggaggccgaggcaggcagauugccugagcugaggaguucgagaccagccugggcaaaacggugaaacccuaucucuacuaaaauacaaaaaaauuagcugggcguggcagcaugcgccuguaguugcagcuauucaggaggcugaagcaggagaauugcuugaaccugggagguggagguugcagugaucugagauugcaccacugcacuccagccugguugacaaagugagacuccaucuccaaaaaaaaaaacaaaaaacagcaaacaaacaaaaaaauuccucuauuucauuuauuucuaaucuuaauuauuuccuuccuuuugcuugcuucaguuuagguugugcuucuuuuucuaguuccuuaaugugaaaguuuaguuuacugauuugaugccuuucuucuuuuuuuaagguaggcauuugcagcuauaaauuucccucuaagcauggcuuuugcugcaucucauaacuuuugauauguuguguuuucauuuucauucaucucaagguauuuucuaauuucucucaugacuucuuuuuuaauucauuuguuauuuaugauuuuguuguuuaauuuccagauacuugugaauuucccaaauuuccuuuugcugcugauuugugcuuguauuucaauaugaucagaaaauagacuuuguaugauuuuaauccuuacacauguauuugagguucauuuaauugccuaaggucaggucuguucuggaaaauguucaauuuauacuugagaaauauguguauauuuugguuuuggauggaauguucuauagaugucuguuaagucuagcugguuuauaguguuaucaaggaaauuuguuauugauugguuaugcuuucuugcuaguuuucuaagcaaaauaauuuaagaaacacuagaagauaaucuagaaagaagaaagcuagacuagaaaaugaaaguuuucuagucugagacaaaauguuagaaaugacagcaaaauauggcaggguuuuacucuuuuguaggaagcuacauaaauuaccucaguccagacagcacucuaccacauagaaguuauagucgacauuuggggugguaaguauuugucauugauacacacacacacacacacaaacacacacacacgcacacacaccaccuccaauacuuuauggcacaagaugauauaaaaaaauaaacuaacccaggaagauauaauaucauaauuguaacauuuaaaaauauaugugcaaaaaugcugauaauacagcugggcgcuguggcucaugccuguaauccuagcacuuugggaggcugaggcagacagaucacuugagcucaggaguuugagaccaaccuggccaacauggugaaacccugucucuacuaaaaauacaaaaauuagcugugcaugguggcagggguuuguaaucccagcuacucaggagguugaggcaggagaaucacuugaacccaggaggcggagguugcagugagccaagauugcaccacugcacuccagccugggugacagagcgagacucugucucaaaaaaaaaagaaaaaaggcccagugugguggguggcucaugccuguaaucccagcacuuugggaggccgaggcaggcagaucucuugaggccaggaguucgagacuagccuggccaacaugguaaaaccccaucucuacuaaaaauacaaaaaaaauuagccaggcaugcugauaggugccuguaauccuggcuacuugggaggcugaggcaggagaaucacuugacauucucaaguggaggcagagauugcaaugagccgagaucaugccacuguacuacagccugggcgagagugagaguccaucucaaaaaaaaaaaaaaaaaggcugauaauuuuuuuuaaauuuucuucuuugugcuuuaauauuuuuaaugucuaacaacaauuugucuuauuacuuguuuauuauuuaauuauuuaaauuauuuaaaguuaauaauagauuaaggcaacuacuuauguuuuaagugaacaaaaguauguuuguauaacauuuguuaauuagaaagcuauuucacaaauauaauacuucacaaauaauacuuucacaaauuuaucguaauguugcaugggaaugaaacuuuagaaaugaacaauggcuagcaagacauuuauuuucagagucucagaaaggaaaaacauuagggacauaaaauuuuuuuguaucuaccuucccauauuucucuuucaggagcaguguugaguccuucagagaagaguuaucaggaagguggauuuccaaauauauuauucaagguagaguaugugugcauagaaaaugagccuugaacuuuguugcauguauaauugagcauaaggaaugaaauuagcaggcagaaaaaugcuggauuugccggcacuuuuuaaaaaucagaaaugccuuuguucucucauuauucucuauuuaguugaggauuuaggaaauuagagauuuauaaauauuugagaaauuaagagcuuucuguucucagugaucugucagagaugagacugagaacuacuaaggaugcugugauuuauacauuugucuuaacucagcuuuuaauuuuccuuuuuugguugguguuuugcaugucacuguuaguuuuuauuagagcaaacuagcagugaucauuuuuauagcauuaaaaguaauuuaaaauugacuuugacugacuaugacauugaaacuugaguuuuuacuguuggugugaaagccuuaaauauggcaaugaaugcuauuaaauaaagugaaauaacuuugauuucugcuagcuuucuuuuaaauuagguugcacucuguugcacugcauaguccccagggagcuuuggauuuguguugaggcucuguucuuucuagauguaugaaauggaauuacuuuaguauauauuucuucucuuaggaaacagccaaugucaccguggauaauguucuuauuccugaacauaaugaaaaagguaugaaaaaaccaguuuuuuuccaacaauuuuuuuaaaaucauacuuucauuuaagugaauuaagagggagaaauacccaauaaacacaauaaucauuuauauucaaauucgguauaaaauuucauagauauuaaaauaacuucaauuugauugacacuuauaguucuaauagaugauauguuauuauguuaaggcuccauuggcuaaugaagaaugcaauuguggucucuucacacgggggauauuuuaguuuuuuguugguaaaauuugcuauguuugugugucaugggaaaacauuuuuaaaauuauguugagauuuauauaguuuuagaaaugcucacagcaauuacagaaaucuuucaagaugauuguagagcaaugcugaaggucaguaugaaaaucuaguuaucuuccauaucaacuuuccuacuuuauuaguaggaagaauaauuuaguuccaccuggaaucauucugauaaauguuaaagacuauuuaaggcugcguugccuagucuuugccacuagaucugaugcuucuuucauugaaaaaagaauuaggaaaguuagauaaggcuuugguucuucaacaauaaggucuaaaucaaacauuaagugucuucagagaggauuuuguauuagcuauggaaauauagccaaaguuggguucugaaggacauagccaaacuuuuccuuuucaauuuguauuugauuccuguuugcauguuuucucccaaucuccacuuugggugaguuuuuaaaaggcugaaucaucuuucuaauucacucugaggaaguaaauuaggcaguuagaggauuuggcacaugagaaguguuucuaucagucaugcuuggagaauauugcuuagucauguccauauuuccacuuccauaauuuuuuaguaguuuuagguucauagugggucaacagcaacacauugaccuaaugaccagaaaauugaaucuuggaagaauuucuuccacuaagcucuuuggcugaucucuuuugagaggagguaaaaaucacaaugcugcuguccgaagaaacccuuugcucuguggaauggugggaacuagauccaaguaaaugugcagagagcacaugguggucuucggcuuugguuccugggccuuucucuacuaaccuuccacuggacucugauuuguuucuaauauagaaauuuugguuauaauggugauguuccuucuuagcuaacuuaucuucccccuacuuuccuuccuaaggaauacugcuuaaaucuuccaucagcuuucaaaauaucauagaaggaacuagaaauuuccacaaagacuuccuaauuggagaaggagagauuuuugagguauacagaguggagauucaaaaccuaacauaugcugucaaauuauuuaaacagguauggaaagaauuacugucacaggacaucaguuccacuuauuuguucaucuuucauauuaaaauaugucauuuuucaucaacauugaaagggguauuugaaaauaaaauuuuauaaguggaaauaagagauaugauuucagaugacuggagaaguaaagaccugucuugcaagaaugaggaaguuaaaugcuuuccauccccagauguuauagcaugaaagacuuuucugggcuggguguggugguucacgccuguaaucccagcacuuugggagcccaagguggguggaucacuugaggucaggaguuugagaccagccugaucaacagggugaaacccugucucuacuaaaaacacaagacuuagcugggcguggugguaugcuccuguagucccagcuacuugggaggcugaggcaggagaaucgcuugagcacaggaagaagaggcugcagugagccaagauugcaccacugcacuccagccugggugauaaagugagacaccaccucaaaaaaaaaaaaaaagacuucugaaaagucuccaggacuuuguuaaagagggucagguagugcuagccugcccugauuuucuuggauuuuuaggaugagccggguccucuccaggcagccucacaggcuaagccacaguuuggcauuugguacugcuuuauaaauugucuucuaucacaacucagaaggguggaaggaggaggcuuucgaguaggaacaacaaaccaacaaacagaguaggaggucagaagacaguugauugacugcagccaaugaagcaaaaagggaauuccaggaucaagcucaggagucagucagagauagguccacacacaaacacagaagagcugcucuucguuuucuucauaguuggucaacaauaaguaaacauuuacuaaacucuuauauggacugggugcugagcauguagagaugaauaaggcauaguucuguccucaaggagcucacagucucucuggugaaauagccaggaaaacaaaagauuaaacuguuguaaaagagguacuuuagcgagaauuguacaaaagaucacagaagcacauaaaagauagcaacucucacagccauaaaaaagaaugaguucauguccuuuguagggacaugaaugaagcuggaaaccaucauccuuagcgaacgaacacaggaacaggaaaccaaacacugcauguucucacuuguaagugggaguugaacaauaagaacacauggacacagaggggaggggaacaucacacacccagggccuguugggggguugggggaaaugggaggaagaguauuaggacaaauaccuaaugcaugcgggucuuaaaaccuagaugauggguugauaggugcagcaaaccaccguggcacauguauacuuauguaacaaaccugcauguucagcacauguauccagagcuuaaaguaaaauuaaaaaauaaauaaaaaagaaaaaaaaagaaaaagagguuuaauggacucaguuucacauggcuggggaggccucaguaucauggcagaagaugaaaggcacgccuuacgaugcagacaagagagaaguugugcagggaaacucccauuuuuaaaaccaucagaucuugugagacuuauucacugucacaagaacagcacuggaaagacccacccccaugauucaauuaacucccacugggccccucccacaacacgugggaauugugggagcuacaauucaagaugaauuuggguggggacacagcaaaaccauaucagaagucuaucugaaaagguuacauaccauaugauuccaaguauaugacacuuuggaaaaggaggaacaauugagacaguaaaauauggugucuggguguuugguaaggguuagaugaauaggcagagcacagaugauuuuuagggcagugaaacuacucugauacuguaaugguggauacauauuaucauauauuugucaaaacccauagaauauaccacacuaagagugaacucuaguguaaacuacgguaauaaugauaugucaacuuaagaucauugauuuuaacaaauguaccucacuggugugagauguuaauaauugggaagcugugugcaugugugugggaacgccuuacuuuccucucaauuuuuuguaaaucuaaaucugcucuaaaaaauaaagucuacuaauuaaaaaaaaaaaaaaaaaagauagcgacucucuccucccagaggagggcugugucuggcacccagaagaguaucuggccagaguaaccacucaguaaacaguucucaaaaacaaauggggaaaccauccagcuggauuuugaaggaugaguagaauuuuggcaggcaguaaaggaggggaauuacauuccugguggaacaaauagcaguugcagagaccuggagguguguguaugaaaacguaggucuuccucaugaauagcauuucauucagugcagcggacuggguguagggaagauggugagaagaggaugcuggaaagauauuaagucugugggugauuuuuaaguaggagacugaaagauuuguguuguuaaaauaugacuuagauucuagguuagauaguggauuggaaguuggcagaagaauugggggaaagauggcaagagcuagcuggaggcaggcugggcaugguggcucaugccuguaaucccagcacuuugggaggcugaggugggcggaucacuugaggucaggaguucgagaccagacuggccaacauggugaaacccugucucuaccaagaaauacaaaaaaaaaauuaaaaaaaaaauagcugggugugguggugccugccuguaguuccagcuacucgagaggcugaggugagaggauugcuugaacccaggaggcagagguugcagugagccaagaucacgccacugcauuucagugugggcaacagaguaagacccuaucaaaaacaaaacaaaacaaaacaaaacaaaaccaccagacuggaggcagaaagaccugguagagggauauuucagaugugcaaaccaagaaauggacaggguauaaacccguguucccaacccugacuauauauuagaauuaucuaggagcuuuuuaaaaaaaugagccuuuaaaaaaauugacuuuuaaaaaaaugggccuuuaaaaaaaugaacuuuuaaaaaaaugguagucaccaguauuuuuuaaaaggucccaaggugguucacauguguagccacuguugagaguuaaugcuguuagccugggcaaagucagugaggaugcagaggagaaagcaugucuaagagacgaggugaaguggaccacaucugauuaucuguuggauaggaguggggaagaaggaggguuucaaggugauuccgaguuugcagcuugcauuaccguaccguuuuaaaaauuauuuaccuaauuucuccauuucuccaaauugcauuuaguacuacuuaauuguacauagaaaucucaaaauuacugagaagaugaacagucugcuaaagaaacaaccagcuggcccaacuauucaacaaauagaaugugguugcucuagagguggccaagcuaaagccuguuucuuaaugccaaugugucccuggccccaauucguacauugucuuaugguugagccucaggaccccauccccaaaggguccguccagucuacuuuccuacucucucugcagcugccaccaaaucacacucccuuuugggaguuuucuuuccaugagucugaaugguauugauugcuucuagaaccccuucccuuucuuucuuaaagaaagguguuauuuccuggauugucuuugaccccuccagugugguuugggugacacuccuauguguagcaauagcaucaaagcauuacguuauucacccaccucucucaaaggacugggcagcuuuuuuugaagagcucuuauuugucuuuguauccuagugccuuauuacagggccuugcccauaguagcucaguaaauguuugcuggauaaauugaaugcagcauacauacccuuuucaagaauuuaguugcuaguuguuacgaguaaaaauaccugagauuaccaagguguguacaaagucuuacugucucuacauacauuuuaacuuucucuuaaggugguaaaugaaaguauggccggacuuugcccuucugcuuuuaucuccgcccccuauuuuaacccaacaugcacacacacacacacacacacacacacacacacacacacacacuuaucaggaaaaaaugagagcauuuaaugaagccuuagccacagaacauuguuaaagaaaugcaguuuuguaacauugguucauuaccaauuacuuuucuuagagggacugaggugggaaauuguacuagguguguuagaucugugcuucucuaacuuuaaucaccugggaaucaucuuacaaugcagauucugauucagcagaucugacaggagcccuggauuugccauuucucggcagcuccuaaugaagcugggguuuuuuggucauagaccacauuucaagcaacaggguguuagagugcuacauuagcauaaacaaaaaaaccgacuccuucauuuuucagacuggaaaacuauggccuuagggaaguuaagugacugacaaagaaucacaaauagcgaguguuagagaugggcggaaaauccaacccaucuggcucccaggacaauggucuuguaaaauguaaauucugauaaaaugguccuugaaaaugauuuuuuagccugauuuauuguuucugacuuccuaguucaacuuggaaaauaguuuccaaaauuccuguugaauuucucucccuuuauuccugagggcagaacuccaaaacuccaccuucucuagcaauuugcaaaugauagaacguuacaacuggugagaccuaggagcauacuuaauuuaacucuuuugguagaaguuggaaaccugagauccagagacaugcaaugaccuaagauauaugaaggcaucaagaacagugcuagggacagaguagguguucaguacaauguuacugaacucauuaaaauauucaugugucaggcucugggcuaucuucuaaagcuucuugaaaguaaagaguuauauuuuuauuugcuuaguaagcccaucuuuucaaaaggcaaagguaaacuugaacugacauauccaaauaacccaagucauaaacaccaaauuagugaaauuuuguagcagaauagaaauaacacaaguuggauucuuuauaagaucaaguuggggagguucuagcugucaugggauugucuuugaauacauagaauguuuuugaauuuauguaaaugugugcaaaauaugaugaaagaguuaacauggcgauacacugcaugaaaaaccuucaauucaagaacacugguucuagaucucuuuuggggcuaauggauuguugaaaaucuguugaaagcuaaaugucaucuccccagaaaaguguucauauguguuuacaccaaaaaguucaucuaauuuagggagacuauagacccuggguuaagaaucccagaaacagauccuuuccuuaauuuuguucuugucuuucuguauauguaggagaaaaaaaugcaguguaagaagcauuggaagagguuuuuaucugagcuugaaguuuuacuacugugaguauguuuucucuggaauuuccuccucuuugugccuggguuucaucucuguucauuuuuuauuuuacagcacagagcuuggcgugacauguaauaaauuuggguuggauguuagaacuucgaauaaauuuugauaucugcuuuaguauauuccuuaaaguacauuuuaaaauagaucauuuacauaauucacuugaacauauuuuaacaggaaacugucacaaggaaguagguuaaaucaugugugacuaacauggcugaauaguaauacuuagaacauuagaguggucuauauuucaccauuuccuccuuccuuagagaaauuccagucuagaagcuguuucaucaguauaacucuauucaggaagagaguuuuagacaaagaaaucaagcgcuuuugaugugcauauuauuuuucuggaauucacuccugagucugagaguccuuggagacaaauugaaaugacuucguuuucauauacauauucauaucugcagcugugcagccuuccucauugaaggccucuaacccuguagaguucacuugucauccuuuacaaauaggaaacuuuuucagauuuuuuuuuaaccaagaugugaagucgggaagcagggaggaagcugaagagagaaggcauuauacugaauccauuuucuuuuauacugaagaccagaaaucaaaauaguagaggcuaaucaucaaagcuuacauaucacuuagucaauaaaaaaugaaauccaaaauuguaauaguaaaaaguuuuuacaugugaguuuuauuuauuggcuuaugaaaguaagauucaaacauugcaaaauuucaaaaguacaaaagcauagaccaggaaaagauuuucucccaccauuaucauccaaccacccagcugaucuuuccaaaguaacaguauuaccaguuccuuguauauauuuccagagauauuuuguguguaggcaaauauguauuuuguuuucuuauuuuucucccuuaacacaagaggugacaugaacacauuguacacauugcuuauuuucauauucuauuauauucuauacaguaguuuacauaacccacuguucacaauuucuuagauuuguuccaauauuuuauuauaugaaauaaugcugcaacaagaaaaccuuguauauauguuauuucauacuuauuugaguauaucuguaaaauaaauucucauaaauaaaauuauaguaucaaaugguuaugugcauuuuaucauaacaaauuguccuccaauauaaguuauaccaauuuacuuucaaagcagucauaugagagugccugguuuuccauuguugccaaccuaguauuuauucuuaccucuuaauuuucgccaaucugauaggugaaaauaguuuaucaggguagcuuuugaaaaaauauuuaauugacaaauaaaaauuguauauauuaauguguacaaugugauuugauauacaguauguacacauugucuaaagaucaccacaaucaaauuaauacaucuauuaccacccaugcuguacuuuagauccccagaauguguucauuguacaauggaaagguugccugcuuugaccaacaucugucuauuuuucccaacccccagcccuugguaacuauuuuucuacucucugcuucucuacguuugacuuuuuuagcuuccacauauaagugagaucaugcaguauuugucuucugugucuggcuuauuuuacuuagcauaaugucuuccagguucauccauguuguuggaaauggcaggauuuucuucuuuuuauggcugaauaauauuccaucguguguguguguguguaugugugugugugugugugucucacacuuuauucuuuauccauuccucugucaauggacauuuaaguugugucuaugucuugguuacugugaauaaugcugcauuaaacaugagagugcagauaucucuuugagauacugauuuuauuucuuuuacauacguacccugauaugguuugguucuguguccccacccaaaucucauccugaauauacucccauaguucccauguguugugagagggaccuggucggagauuauugaaucacgggggcaguuucucccauacuguucuugugauagugaauaagucucacaagaucugaugguuuuaaaaaggggaguuucucagcacaugcucuguucuuuugucugccgccaugugagaugugcuuuuuaucuuccaccaugauuguggggcauccccagccacauggaacuguaagcccauuaaaccucuuucuuuuguaaauugcccagucucagguaugucuuuaucagcagcaugaaaauggacuaauacauacccagaagugagauuguuggaucuuaugguaguuguauuuucaguuuuuuaaggaaccuccauuauggcuguaccacuuuauauuccaaccaacagcauacaaggacuucuuuuucuccauacccucagcaacucuuguaucacuugucuuuuugauaauagccauccuaauaagugugaggugauaucucauugugguuuugauuugcauuuuucugaugauuagugauguuaagcaucuuuucauauaccucuuagucauugguaugucuucuuugaaaaacuaucucuuugggucauuugcccauuuuuaucagguuauuugcuuuuuugcuauugaauuguaugaguuccucacuauuuuguaucuuaacaccuuauuagauauaugguuugcaaguauuuucucccauuccauagguuuccauuucauuuuguugauuguuuccuuuguugugcagaagcuuuuuaguuugauauaguuccacuuguucauuuuugcuuuugucaccuaugcuuuuugugucauagccaaaaaaucauugccaagaccaaugucaagguaaauuuucccuauguuuucuuccagauuuguaugguuucagaucuuacauuuaaguauuuaauccauuuugaguuaauuuuuguauaugguguaagacaaagguccaauuuuauuauuuuguauguggguauucaguuuucccaacaccauuuauugaagauaauuuucuucuucuguuguauauucuuggugcccuuuucaaagauuaguugaugauauauauguagguuuauuucuguuauuuuuuuuuuuaaauucuauuccauuggucaaugagucuguuuuuaugccggugccauacuguuuuuauuacuauagcucuguaauauaguuugaaaucaggacgugaaugccucuggcuuuguucuucuuucuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggacggucucgaucuccugaccucgugauccgcccgccucggccucccaaagugcugggauuacaggcgugagccaccgcgcccggccuguucuucuuucuuaaacucacuuacuguuuugggucuuucaugguucuauauaaauuuuagcauuuuucuucuauuuuugugaaaaauggcauuggaauuuugauagaaauguguugaauguguagcucacuuugaguaguauggacauuuuaacaauauuaauucuuucaauucagguauguaaugcaucuuuccauuuauuugugucuucuucaguuucuuucaucaguguccuauaguuguuaacgcacaaaauuuucaccuccuugguuaaauuuauuccuaaguguuuuauucuuuuuaaugcuguuguaaauaggaucauuuccuuaauuuccuuuucagauuguucauuguuagcauauagacacauaguugauuuuuauauguugauuuuguauuaugcaacuuuucugaauuuguuuauuguucuaacaguuuuuuugguggagucuuuuggguuuucaucaugucaucuguagacagagccaccuuuaacuugcaccuuuccaauuaggaugcuuuuauuucuuuuuuauugccuaauugcucuggcuaggacuuccagcucuaucuugaauagaaauggaaagggugggcacacuuaucuuuuuccugaacuuagaggaaaagcauucagcuuuucacuguuaagguaugauguuagcuguggguuugucauauauggcauuuauuacauugagauacauuccuucuauaccuaauuuguugagaguuuuuaucaugaaaggauguugaauuuuaucaaaugcuuuugcauuuguugagaugguuuugugauuuuuauuuuucagucuguuaauaugguguaucauuuacauauuugcacauguugaaccauccuugcuucucagggauaaguccuguuugacucugguauuucauccuauuaauguucuguugaagacugggcacaggggcacaugccuguaaucccagcacuuugggagaccaggaaggugggucaccugaggucaggaguucaagaccagccuggccaacaugaugaaaccccaucuguacuaaaaauauaaaaauuagccagguguaguggugcacgcuugcaaucccagcuauucaggaagcugaggcacaagaauugcuugaacccgggaggcggagguugcagugggcugagaucaugccaccacacucuagccugggcaacagagcaagacucgaucuccaaaaacaaacaaacaaacaaacaaaaaauguucuguugaauuuagcuugcuaaauuuguugaggauuuuuguaucuauggccaucauggauauuggcauauaacguuuucucauuguguucuuaucuggcuuugauaugaggguaaugcuggccuacuaaaauaaguuugacaguguucccucgucuuuaauuuuuuaaaagauuuugacagggauuaguauuaauucuucuuuaaaugcuuguuagaauuuacccagaaucucuaugguccuggacuuuucuucguugggagguuuuugauuauuuaaucaaucuccuugguuguuauuggucuguuuagguuuucuauuucuucaugauucagucuugguggauuguauguuucuaggaauccaucuauuucuuuuaaguuuuccagauuguuggcauacgauaguucauaauagucucuuaugauccuuaguguuucugugguaucaguuguaaugucgccucuuucauuuauauuuuauuuauuugaggccucucaaaaaaacaagucucauaguaucaauuuuucugagagauauuaauaauccuuuuauauauuuaagagauauauuuuauuuucuaugaaguagcuuauaauauuccuuaccuauuuuuuaaaauuaggcuuuuuuuagugguucaaaggaauauuuuauaauuccuauuagaaaaucagccuauuuuuauguuaugagacgcaaauaauuuuuuaccauacugucauuucaucuuugcuuauuauaguuuugacauguagaaaugguuuuaauauagguaauuucacucgcgucugugugaagagaccaccacacaggcuuugugugagcaauaaagcuuuuuaaucaccugggugcaggcgggcugaguccgaaaagagagucagcgaagggagauagggguggagccguuuuauaggauuugaguagguaaaggaaaauuacagucaaagggggguuguucucuguggggcaggaguggggugucacaaggugcucagugggggagcuuuuugagccaggaugagccaggagaaggaauuucacaagguaaugucaucaguuaaggcaaggaccggccauuuucacuucuuuugugguggaauaucaucaguuaaggcaggaacaugccauuuaaauaucacuucuuuugugauucuucaguuacuucaggccaucuggauguauacaugcaggucacaggggaugcaauagcuuaacuugggcucagaggccugacaguuaaguuuaucaauguuuucuuuugcggauuccagauuuuauguuauaguuuuugccauuaaaaguuaucaugguuugaggccaggcgcgguggcucacgccuguaaucccagcacuuugggaggccgaggcaggcggauuaugaggucaggagaucaagaccauccuggcuaacacugugaaaccccgucucuacuaaaaauacaaaacauuagccaagcauggugacgggcgccuguagucccagcuacucgggaggcugaggcuagagaauggcgugaacccaggaggcagagcuugcagugagcugaguucacgccacugcacuccagccugggcaacagagcgagacuccgucucaaaaaaaaaaaaaguuaucaugguuuuugccauuaaaaguaaacauuacuuuuuuuuauuuuuauuuuuuuuugagacggagucuugcucugucaccuaggcuggggugcagugaugucaucucagcucacugcaagcucuuccuccuggguucacgccauucuucugccucagccucccgaguagcugggcaaaaaccgcaguaauuuuugcaccaaucuaauaaaauaauucucccauuuuuucccaguacuuucaugguuucauuuuuuacauuuauuugucugauccauuuauuugucuggugagguguuuucugugaacuacaacaacagcuugucuagguuucaaaaauucuaucggcauuuuuaaugcaauuuuaauaacuuuauagauuaaucuggagauauuuacaauuuuauaauguuggcuauuccugggguaccauuuuuauuuugcuaauauuuauuuuguguuaggcccuguuucaagugcuuuacauguguuaauucauuaauccucaugaccauccaaugagauaaauucuccuguuaucuccauuuugcagaugaggaaacugagguagaucuuaccuuuucuauaagauccaaguuauuuccugaaucaucuucucagaugugacuaaggcagaugcagcuuucuccucuuagaauguacuaucagaaaugggauugggagagaagccccuaaguaaacagacaauuucaauaaucuaauuuaagugauaagaugaggaaauacagagcacagaggaggaaaugauaacuugggggaugagcagcagaauagguuucuugauagaaauaauaucuaagcugagaccugaaggaugagguuucuuuaguuuaauauuaaggaaauuaccuuaaacagaauuguaaacuccauagaauguggcuucugauuccuuuuuucccuccuuucucgagggaaggggaaaaagcuaauaauuuuuguggaccuggcuuuuggcuuaaccuuuuauuucauuuucauaagaaccuuggaaauagauguuuuaauuacugauuacaguuaaaggaacaggcucagagcgauuaaauaacuugcccaaguuaacacagcuguuaaaaagaccagagauucaaucccagguuaguuguucaaaucuguuuaccacaccauggggucugcaucauuuugucugaacaaggcacucagaacauuugcugaagugauuuuagaagguaucagaucugcuaaccuucugauguauauaaucuaaaacccuacugauuuaaaaauuuguagcaaaagauuggguggcauggguccauagguacaacaccagcaaacuuucuccaagguaucuccauguuccauaccuugguaaccucuaaaguauccguuuuucuguuugaucaguaauacuuaaaaauaagcacauguucuuuucuccucucugagcaagagaguagagcaccaggccguggcucugucuaucugauguccacuaucuacugccuuccaaaagauuagucucucugaauuauuuuaaguugcaggagaaccaaccagguauacaccgacugugaaauacacuaccucaauuuccuuucaauccacugcuuuucauuucauagauauaguuggaaucauaauagguguagggaucuuguaucacagaagacuuugauauauuuaaaaauaaaaacuucucuauguguauuguguguguguguauguauacauacacacacacacgcuuccuuccuugaagaggaagaaaaggaaucagaaucccccucccccgccacguacacacaauauauguaggaauguguguguuuauaggaaaauuuugcuacugcagaaaugaauaauagguuuuuauaaauagaaucuuuuuuacagauuuauuuuaauauccccaagccugcccagaacauaguagaugucccauaaguaauuuuugaauuaaaccgaguucacaguaugugugaauuucacauuuuauauuucauaguuguuaccugggcucauagugauggcacacacaaucgaggaauagaguuuuuguuaauaagcuaauaaauaauuauuaggaaaaaaaaaagccugagaaaugcauacuacacugacauagaaaucugugauuuaaaaucaaugguauguucucaacaucaaacauuacuagucauauggauuuagacaauaaugcaagcuuugugaagacacugacaucucuuuugagcuguguagcugguaucuagcacaguaccugacauaguagugcucaauaaguggaugaaugaaaauggucuuuauucuuauguuuuggugacuuaaacuuauauacuuaaauaaaucaagcuaacaauuuuaguugcacuguuuuuacuuaauaagucauguugucuuucauauugauaaaaauaaguuaauauugaauaguguugucuaucuuuuguaaacuuuccaacauuacaaaucuuuaaaaaucuuuauuuuuuuaaauuuucugccuuauauuuggauguuuuauuuauauuuacaugauuacagucaaccaaaagcaguaacuaguauuuguuagaauuuuuuuuuuuuucuuuuuugagguggagucucgcucuugucgcacaggcuggaggguaguggugugaucuuggcucacggcaaccuccgccuuccgguucaagcaauucuccugccucagccucccgaguagcugggauaaccaggugcucaccaccaugcccagcuaauuuuuguauuuuuaguagaaacgggguuucaccauguuggccaggcuggucucaaacuccugaccucaagugaucagcuagccucugccucccacauugcugggauuacagguuugagccacugcaccuggccguuagaacucuuuagaccaauuuggaaagcaaaucugugucuguacccaauguguccggcugaauuuauauuccgcuuuaggccuauuccccaucccaccuuacuacccccacaccaguguguuguucauuuccugucugaauaagcaauuugauggcuuuaaaacaucuuuuguuucaagguuucaucacccaaacauacuagaguuggcugcauauuuuacagagacugagaaguucugucugauuuauccauacaugagaaauggaacacuuuuugacagauugcaguguguaguaaguucuaucuauuauucugucugauccucugaccccuugaaucccugggagagcugcugaaaccgucugggagaguugggaggcaagauguguuugcaugaggggaaagccaagaauggguuucccaaggaagcaguacuucuuggauuaauuucuuacuuuuagaaggcugagcaaauaccugaguuaacguguucugugcaacauuuugguaaccauguuggguucuuacucauuauaugguaagaacccagcaaaucuuuuggcaaccauguuauauuauauuugauucuguaccuccagugaguuggcaucaacuacucuuauuccuuaaauaauuuuaauuuguauaacuuuauuaaaguauccuucaauacaaaggaucaccauagcagugacacagacucuaaagagaaagaggcagccuggacaacauagccagauucucgccucuacuaaaaaaauaaauuggcugggcgcaguggcucacgccuguaaucccagcacuuugggagggcgaguugggcgaaucacaaggucaggaguucaggaccagccugaacaacauggugaaaccccgucucuacuaaaaauacaaaaauuagccaggcaccugugaucccagcuaaucaggaggcugaggcaggagaaucacuugaaccuuggagacggagguugcagugagccgagauugcaccauugcacuccagccugggugacagagcgagacucugucauaaauaaauaaauaaauaaauaaauaaacaaacaaacugcuggucaugauggcacaugccugucccagcuacuucagaggcggaggcaggagaguugcuugagcccagggacauggaggcuguagugagcuaugauucugccacuguacuccagcuugggugacacggagugagaccuugucucaaaaaaaaaaaaaaaaagagagagagacagagagagggagagagagaaggagguugaauaaaugucaugauuccucguuagaugucuuuggagguuaaguuuaaaaauugauuccaaauagguuguuucaguuaggaugagaauaaaagcagauugucucaauuacucauacuguuguaccacaaguaacuuaaaaaucuuauuuaaugaacuuuuaagcaguguuaccuuacuagcuauguuuugauuaagcuaauauugagaaguauugaguauuuucguugucuauaaaagaggccuagaacugucaucaguagcagaaggaaacccaucuggaauuaaaaauagguuuuggaaaaccaaaacguugauucacccaccucaccccaccuugcuaucuacuucuauucugguguaugucugcauaaugaauacauagguaguuuuuacucagaaagugcaaccaaaccaauugcuguuguuguuuuagggugacacggccccacucccuuggcacauucgaaucgguauauuaauaggaauauccaaagccauucacuaccugcacaacguucaaccaugcucggucaucuguggcaguauaucaagguaaauuauuccagagcuuuugguuauaccugaaagcuucuuuuauccucacaugugagucauacuucacacuauucucugcuguaguucuccugguauguauguguguguguuaagaauucucaucuagguauuuaaaaauccuauauuuuuauuaaugaaaaugugucuaccaaauuuaaaaagcuauauguauguugccaaaaagagaguuuacauuaucuuugguaauuauuaaugaacaauguaggauagacaauucuguguacagauggucccaauuuaugaugauucaacaaaaugauuuuuuuuacuuuacaauggcacaaaagugauauguauuauguagaaaucauacuuugaguauccccauacaaucauucuguuuuucacuuucaguacaguauucaaugaauugcaugagguagucaacacuuuauuauaaaauagccuuagcacuagaugauuuuacccaacuguaggcuaauauaauuguccugagcacauuuaacauaggcugggcuaagcugggauguucgguagguuagguguauuaaaugcauuuucgacuuaccauggguuugucaggauguaaccucauaaguugagaagcaucuguauuuuaguaauuauuaauggcacuuugugaaaugaaccuguauuuauguacuuuuuuuaaaacugaaguuuaaagaaaaauuaagcaacuuaaauggggauuccuagcaagcuggcaguaguaaauagcaauaaaaauuguuuguccuugagucuccagugucuugcucauccuacugagccugcugucucauaacuuuauauauuaaccuaugacaagcugagcagcaaccccaauguucauuuuugagacaugagaaaauuagaagcaacaucucccacauuucuucuucuagacauaaagaaucauucacccagaguaaauacccccugucggugaauuuuuuucuauuugcccuuuaucuucaaccuguccaaaaguacaugaauacaccuuugcugaauaucaaggaagacugaauuuaaaaggcugcugcugcuucugaaccauuucccaguaucuugaaaaaaacuuguaguaugcuuuugacuugggcagaaaaggagcugauugcuuacuuguuuuucugaugaaaugaacuccauaggaaaagacucuagguuuuacuuaguucuagaggggcggggugaccuacccauagacgucugugccuguugcaguguggcaauccagcaacugcuaauggcuuuguagaaucagcauaaaauuaaugcacacucaugggaccugaauauagagggaccaugagggucuucagucaguggaguuauccguuggaauugcuuucaaagggcugagguggccacccacaaccuaaaacaaucccuccuccacucagcuugcaaccaacacugagcacacuaagugcucaaauauauguuuuacugaguaaauaaauaucuggaauguugcuaaacauauuuguccuuuggucuaaacuuaaaauaaguauuagcuuauuuuaaagccccaagcagcaauagauuaauuuuauuaaguuuccuuuugugugacugaguucaucaaauccuuuccugaaugcagaguuugaagaagaaagaaaagagaagguguugggguuuuggcucuugaugggagauggggacagagggucacuaacugaagcaaagggagcaucagggcagggagggaggcagaggcaagcucugcccaugucccguucuuuuucacagcugaaacugggcaaggugauuuggaugugccuaacagugucucucugcugguauuuggugagagcacaggcuuugggcccucauuuccacuuucucacuguugguucgugucuucagguagguccaggaagugggcucagaagcacagauuuaccugcaggagguuuuuaagggagggcucucagggacagcaaaugaagcgaggaaaggaaaaaggcaggauugggcagcuggagagguugaguugggauauuauugucauagaggccucaguccaugccauggggaagcacugaagcugggguggcgcaucaaagacaucccagaggcaggcagggcacucugagcuuugcaccccugcaucugaccagcccucuuguggagcaguaauguggcugggugaggcagcucccuucuaccaagacaguucccagacuguggcucagcugugagccaucuuuagccaacucuuacugcuggggaaccagagccucccuggaacccaaggagggagccaaguaggguggggaaggacaggguggggaaggaaggggucggggggcgguguggagucauggugggagagugcaccauggcagccaccacagcuaugaaggaagauuugacaggacagaguucugaaaaaugugacucgaagauuuuucuuuuucacauguuugcuccccacccuccucccauccuuuucucuuagcucaguguccccuaauguuuaaaucagagagaccuuccacuuaaaaugcgauucugagcaaauugcuuaaugucucuaagccucaaucuuccucucugcaaaauguuaguaguagaauaauagcuucuaucuccuaggguuaaauggcauaagguccuugacaaagagcacacacaucuucagugguaauuccuauccugacugguugagaaguggugggaguggcacagugacagaggccaaguagugugguggccaaucagucuuuuuacuuaacacucuuaccucuaucgucaauuuauaguguuugaaaaguggacccacugacuaagcucuaguuuaagaaaaauuacuucucuguuaauauguuuacuggccaggugugguggcucacauccauaaucccagcacuuugggaggccaaagugggccaauuacgugaagccaggaguucaagaccagcuuggccaacauggugaaaccccauucucuacuuuaaaaaaaaaaaguguuuauuaaauaucuugacaaucccauucaucuuacuucacaaauauuuauagaacaucuguugugugcagagcauuguguuagaccacagggggagagacagugaugauaauagucuuguccuugaagguucaaccuggugaucagaaagauaacacaaacacaaaauguguagugcaaugguaacuaugcccacugagugguuggucugagaaggcuuccucucguuagagaguuccaagccaagucuuggaaaaagugggucauugcaguggauugguugaaagaagcggagagaauauuccugguggaggcaauaauuuguucaaaggaacagaguaaagaauugccacguauauaguaaaagcaagagaaaucaguugguuggaaaagaaaggacaagguuggagaauaagauaaggugagacuacagaagaaugaggacuguggugagcaggggauggaaugcagcuuuggauucugacuaggcugaggaacuagguuugacaagcugggcucuagugaaagucugcagcuugucuaggauauagguggaaacugaaagguucuagagucucuuagguggucucacaacuuaagaggaggccaguucuuccaggucacuaucccaggaacuugucuggaugugcagaacuauaaaaaucauuuaagcaacacugcuagacagaaugcccaacagguaacaaagauacagaguacccagagagaucugaucagaaacaagaauauuauggaagagacaaggcuugaaaugcaucuagcaauguauuuuauauuuuacuuggugguggggcugcugacaauuguugccuuucugaguguuccaaagaguucaaggacuucaauguaacccauccauagaaugugcccacccaggcaugugucaggguauggagauccauggcugugggcauuuguuugagaacugugguuucacaagggcucaucaaugugucccugccuguuccaaagcaaaucagucccuuccacggccauugaacuuuuggccuuucugcugagccugccagcaaagauguuaauuagugccaacuauaacaguagauuucccccucguguuuggugauaugcacaccuguucucuagaagcuggaaugaaacuaacucaguucauuugggccacugaacaccugucagaugguaaugacagucaguccccagcagccucggccagaugugauuggcugaccuagauuacccuccugaaucucuuuuaaaugaauccuccacugugcucuaaaccuaggccucccugaguguuggucccucuguguguagcucagugcuuuuaggacugagcuguccaaaucccugccuguuuugccuuugucauauuaauuuucuaaaucuauguaagggaagauagcuucuaggagggaugcaguuuuauuguacggcuuugauaauuggcugagaaaaggacaucucaaaaucuguguuaaacaguggccuuuucccagaguaauucagggcucuguuuuuauuggaggagugaacaauggaagaugcuguuaccuuuauuuucuuuucuguauuugggcuucagagugaugagucacaaaagacuuuauccuaacccuuugauauuauuauuauuauuauuauuauuauuuuuaaaaagccaaaauuucagcaacuuuuauugacuaccuuuuaaaagcccuaugcugcuguuuuacaaggcauaauagaccagcucaucuggucaaagcauucuacaucauuaguuugaacuaacuuuuacugaaacagcuacagcaucaaaagaguuaaggcaaauuggaauucauagaaaaggauaagacacuucacacugcauugaaagaaagacaggccgggcgcgguggcucacgccuguaaucccagcacuuugggaggacgaggcaggcggaucacgaggucagcagaucgagaccauccuggcuaacacggugaaaccccgucucuacuaaaaauacaagaaauuagccgggcauaguggcgggcgccuguagucccagcuacuugggaggcugaggcaggagaauggcgugaacccgggaggcggagcuugcagugagccgagaucgcaccacugcacuccagccugggcgacagagcgagacuccgucucggaaaaaaaaaaaggccggaaagcuaagaagagagacacugacggcaacacugaauuacagcaacacucgcacugcaagcacagaacaccaugggugaagucggacuaguuaaacuucagaaagcccauuucauacagcuggaaaaaaaaaacacagauuaaacacaaaaugaacaaaaccacaaaaauccggucaugcacuuggauaagucuucacggucuuugugcauacccagaaaauugaaguuuucuuuucuuuuuucuuuuucuuuuuuuuuuuugcaucauaacauuugauaaaaaucuguuuguuuguuuguuuuacuaaaauaaaccuguucgggggaacagcuacuagaugaauuuaagguuuuuaugcaccuuauagaacuuauagcaaaaauaguuuuaguugauuucguuauaaauaacguuuucaagaacuugugcaaaauugucaauaauuuccuaaagcacaauugaucagaaaaauccaugauuguucagccuucacacccuucuucauguaagaacaccuuucuguacaucucacaguuacuuauuagguugaaagguauauggagaauggucauuagacgucucgacagccaccugcuguugaccacuugccuccucaacaggagccgcugucgucugcauauguucauacuguggcaaguaggcuccuugcauagcugacguugcaggcauguauguuccggugcugccuagugacagaugacucaucugcugggccagagggcugaucauugaugcgggcuguagugacauggugugcuccauugagggaguuaacacggcaccggggugcuguagaauauaugguugagguugcguccaagaaggacuuugcaccugguaggcagauacaggagauacaauauaggguguaauagaaguuugagugaucauucgguuuguagcaauacuguauggugaaggauaaaauccguuuuguauagcagcuguaguugggucguaaguaagugucauuccaguaagucucaccucuccuucucuaugccauggucuuccauuagggauguauuuguuuggguucugucucuuuuucuguccuccaucagaaaacuuacacaauaaagguucugugggggcagaaacuccugguggugucuuaauaaauuuuccauuaaaaugaccaguaacagcuucacauuuuucuguugauuccguccuagcaaagccaacaccacgacuuguaccacuggcaucacguaguauccuuguagaaauaacuuguccaaaugguuugagcauauuuucuaguucuugcuuauccauggagaguggcaaauuagaaauguagagguugguaggaucuuguuccuguugcuuugccauuugagcuugaaccccacuggccuucagggcagacacagcuuuuugagcugcugcagggcugucaaagucgacaaaaccauaaccuuugcauuuguucguugucuuaugcaaaauugcguuuguggagacuauuuucccauaugguugacagagcuucaccagguccuggucggugguguggggaggcaguccucggauauagagguucguuuugcugagcugaucccauccugaguugcugcugcugcuacuguuguuauuacugcugguggugcugggacugggaggggccauggggugggcugggaccagagacugcugcuugcgauagggcguccggcaguugcugcugcccccgggguugccgcugcugcuggggaagaucaucgcugcgggccgcggcggcgggcgcgggcgcggggcagccugggcgcggggcagccucgccgcgagggggaggacgcaaggagggggccggccgggccccgggccgaggcagcuuugggaacucccucucgccgcgcggcggcggccggcgggggcugcagcuccgcgcugacuuccccuccgcacucgucuaaaagugcggcgcggcgcggggcgagacucgagcagcucgggcagccgccgcucugcgugccauggacgggaguucgcgcgcggagcuggcggcgucgccgacucucccggcggcagcggaggagcagcgccgccgcguccuccgauauuauuaaguuauguuuuuaaauaguaugaaauagcauggaacaauguauauaaagugagauuaaguggaaaagaccaaauuaaaguagcguauaguauauaauuauaacuuuguauaacuacaaauucaugcauuaaaaaaauauuaaaaguaaaauauaccgaaauaucaacaacguuuuguuugguuggagaaccuauagcuuauuuuucaauggcuuauuuuuuuacuucuuuauguucuuuagauuguauuuaaagaaguauguucuagucuagcaauaacauaaaauuuauuagacaaaaauaacuuggcgucagaccuuacugucucaaaccaauuaauuggaaaaaguuccaaaagacagucucaaguuacuaaaugaaauccuuaucaguucaaucauucucuguaauuaauuuuaucaguaaagaagcuugauaaucugucauuuuuaugguuuuaaaauaguuuuuaaaaugaaaguuggaaaaucauuauucagcagccuggugcccaaagugugaauaacaucuuuugucuaaagcaaagugaaaugguucucaugucuucagcagggaggagggaggaugaggaugaggauguggaugugggaagaccaccagaaaucuggguucaggccgggugagguggcucacaccuauaauccuagcacuuugggaggcugagauaggcagaucacuugaggucaggaguuugagaccagccuggccaacaugcugaaaccccaucuccacuaaaaauaccaaaaaaaaaaaaaaaaaaaaaaauuaaccaggcauaguggcuugugcuuguagucccagcuagucuggaggcugaggcaggaaaauugcuugaacccaggagguggagguuguagugagcugaaauugcaucacugcacuacagucugggcgauagaacaagacuccgucuaaaaaaaaaaaaggaaaagaaaaagaaaucugaguucagacccaggucuuuuuucucuuucuguggccagagaguggccaaaaguuuucgcacuugcacauucggagccaaccaagacagucuuaaggugaccucuuguugcugucaaauucuuugacauuacaccugccuauuuuuguacugggcucuguacucacgagucuaggacuguuacaggagaacgugacccuguauucucuuaaauccuggucaagcuuuacccugaucagcuuccaaaucagaaugaggucagauauguuuagggaggcgccuccagccaccugcccacucuggagcagguuuuagucaaaguucugaaaugccuguuuuucugaaacacccucucccuagucuuucaucuguccuuccccuucuuuaccagccacccuagcgaucucguuguugucccugucucucaucacugguuaagaguguggccuuuggggucacauagaucucaguacaaaucccuacuccucuacuuucuggcacugugaucuugggcaagucacuuaauccccugaggcucagucucuuaccucaucuggaacuggggugacagugcuccaccuucucccagcauugugaggaggaagugaggugauagacugaaagcacaacccaggccuggcaaugagcuguaauuauccccccacaaugugagaaaagugcuucauccaaccuguacuugaacccuugcuguauggugggcccagcauguuguggggguccagcuccauuugggugcagcucucauuauucagacuucuuuucuguggagcuaaaauccugugacuugcccauuugccgcuggaauuaucuauauacagcuaaagaaaaaggagauaaaagcucauuucauuucucuuugaaaucaauagucucuuagucuuucaugaguagcugaguaaaaagaugucucaguuaacuauaguaaaucaaaagagcaccaaacagaaaaauaguggggcuagguguuaguucuggcccugcuauuaagcgguuuugcauggaacaagucaugucaacccugugggccucauucaccuccucugcaggauucuauagcagugaugacaagucaguguugucucauguuccaugucugauugauugauaaugauuucccacaugcaggguugaaagagaaucuauggugggugcuuucugaacuaaauuuuugauguuugccaagaauaugggaggauguuuugggaggauaaauguuauggcaacauuuaagccacauauucaccauuccuauacugaguagucuagggcuacccucaguuucaaauccucuuuacauaauugauuauaucaacaaauauuuacuuaguaucuucuauagacucaacauuaugcuuaaguaaacaacaucaggugggcucccugugggugucaaacaaugucguuggagcuguacagcaggaauuuuggagaaaggaggagcacuggaauuuggagcagucaagugaaaaguuuauggaggaagugaaucuuauggcugcagagaggacucagauaaaaauaaagcaggggagaguauuuucaagaugaggggaacagaauggggagaggccaagacagcagaaagcauaguuuguccugacugcauaguaaguacuaauaccuuaaggguagcagauagacugcagucagaugagagagcucaaugagagccagagacuuuucaccuggcaucaacgccugcugaauaacuuguuagcaauccucccagcaagccugaguucagguauuacaguuauuaucuccauuugauagaggagaaagcugaggcuuacagagauuagugacuggccucugucucauggcuguagaagggaaaagggagguugcauuccauguuugugugaguccaaucaucaugcacuuuuuaaggaauuaaaggucugggauuaauggaagcauguuggcgucaucagcagagacagggaaauugggaaggagaggagagcauaauuagugugcagaaacuuggaaaugcugacauuggacuccuggcagaagcaagaggcauugaagaggagaucgggccuggaaagcggugagaguagauagcuuucuaaggaagaagcugucaaagacacagcucagaaacacccacaggagaagcagugcccauguuuccaagguguuuucaacaagucuggggguuuauuuagcuaaaaaaugucuuaguaauuugaacucuucaaagagaauguuauaaaaacaaaaccugcuuccaggugguggaauuugagaaggaaaggacuuaaagaaaagaaucuugaaaaguugcagccuauauucuuggccaaagacccucacauuuuuauuggagaaacgaagauguuuuugacuuacaggaucacuuaaaagcaucugaaggcaguaaacuuccuuguuauuucccuccuagcccuuagugagcuuaauuguuuucacauuuaugaacuauuuuaaauggaaaugcauuuuauccuuagcauuuuccaucccagacauuucauuccugcuaauguuuccaaagcaaagagauaaucuuggugaacauuucuaauguuuccuauaaaaucauguucuuuaaucaguauugccauuugucuccugccaagugaaacagucuuucauacaagggaaauggucuaggaaagaaacaaagaagaagccauuugcuucaaaauggacuuuuuuuuuuuuuuaauggaaauugaucagagauguaaggucagagugagugagugcauggguaauuuccucuccaaaagacuagaaaaacugagugguugggaagagggcauagggggccacagauuggccccucccugccaccaggacacccuugccugaagacccaggcuccuccugccuuuauccccagacgggaagguuggagcccagcucaguguuuaacaggcaugucaaagccuacagggaaugcaaagugucuuucuuuguuugacugauaagauucuuuaaucagucuccucccuuucccucauaacccccucaaaaagccuauuuuuaucuuucagaaaaauuuuagauauauauaauucuuuuuccucagauuuuuccuguuuucccccagugccuccccucuucuaaaauauccaaauaugauuuuuucuaagggaugccaaaacaauuaaauaugacauaaauuaaaauuuccccuauuaauucuauuugccaccacucuaauccccaacauucauuuacuuauauacauagauacauacacauaugcacgguacaugccaguuuuuuucugucucuccauugucuuaaaaugucuggaaaauacguuugcccagaacuuccuggaacuauuugaaacucagccaauuuguuggcauuaacuaacugaaggguccucagauuuccagggacauccuacaacccccuguauuuuuguuccuugaguuggugucuuuggacuucuagagacaugcaaccaagccuuuugggauuuuaagguaagguaauggacauaggauggacaauggccagccuauauccuuuaaagcauacuuugagcccucugugagugucacuccuuacguuuucucauuuaauacugguaagaaccccgugaaguaagcaguaucagaucuuuauaccaacagggaaacaggcuuagggggguugugcuaguuguggguagauuuggaguuucacaauuaaaggaggaacacccauuacugggccuuugcaccgagugccuagacucagaaggcaccaacaagcaaaaacaagcuugaauacugugucucucagaccugccuagguucaguggggaugaaaaagaaagcuccgcagucccacaggggaauaaaggguuucagauuuguagcauuccaggcaggaugcagugcacacuuaaguugggguggggugcacaacuguuuuaguagccugcagguucuaggagaaacugagucuugccucaucugguuaggggaggcagggcaucuggugaggggugucucaguguugcaacagccguaauacagacagcacaugugugcuguugccucaggcugucccagaggggccguuggguccucuuuaucucuggagccaaucuguggcucccugcccccucuuccccagguccuucuguggaguccuggccuuuccugagaguuuccaggcacccaggcgcuggacugcuggacccauauauauacuauauauauacccacauauauauauauauaaaauauaucgguauauauauuauauauauguggguauauauaucucucucucuuuaaaaaccaaucaugcucuuucaugccaaauaugguauuuucacuugaauucaaauccugcauuauaaucuagguggagcaucuugucuuauguuuaagguccaagggauugaacuuaauuaggagauaaacuggugagcaaagaaagcaauucucauuacaaaguagcauuuguuugggggauucagguccccccgaaaauuguccuagagaccccuacuaauagagagauuaaguaacauccuagagucagguuacaaacucaucaucuguguaggauucuccauacuuccucaguguacaaccaaugaucauucuguuaaaggaauuaucuggagaggggauggccucucuguuaagguaaauagccuugugauaaagaguagaacaaaucgauuguagaagcaugaaauugaggauaugaaccauggauaugggucaaagaugucuuuuaucuaucucuuugguggccacaguugcuugcaggcugcccuuuugcaugauauugccaugacuguaguuguguuagguucuuaauuuuguuaguuuauuuucaccccacaggauuaacuuacucagcugaccugcauggaagcugaagacacuuuguguuugaacauucuauuuaagguugaagcaggggaaaagaauuaagguagaaauugaucguugaagggccuuuugcaauuuccgcuuuccuaaaacagaacauccuucuuccucagcuaccgcuaaccuuuauuuagaacagaauaaaucacuggacucaaaauuuauguuauacacuaaagucagcugaaaaacgacuuaucuuuucaccgauugucauuauucaaauuguaaauucaguacccuagaauaauuucacaucuuguugauggccuuucacugacccaaaguccucucuggguuuuaugguguaagcauuguuugugguuacucaacucccuucugcccaacuuucacagaagcugacucaccauuugcugaaagcaucccaccagcuuugcuaugggucaaauaaagaauuagauugaagguuuuguuguuauuacuguugcucuuuucucccuuuuuguacuuaaaagauucaggguuuuuuuguguguguguguguguuucaaaaauucagcuuuugcagucucaugauucuggcauugucaauuauaauucuaugccuuuuuuuagagcugugauagaggaagauguuuagguguuugacauugaauaucugccauucagaacauucccacccucccccugugcugaaaugaaauggggcaugcagaagugacuccaaaguugaagggcagaaggugggguccuggcaaugaagguuggagaaccuuuuuuucccaccucgccuccuggcccaccggcaaacuccugcauucaaaugcccccaggacucugaaacccucagggcaucuccaggagccucagacuugaucugauccauugaagagucaaccuagggaagaagugauuaugaacugacagucucuucuuaucuagagcuggagagaagucggaucugacucuagucuguuccucaucugagguaugucaggauagucaacaguucuccaagugagaaaguaagagugggugaggagugacagaugggggugugugaggcccaggcuggcuuuagcagcugcuggguucuccagggagaagggagaaggcaaggagagaaaugacaacugugcucauugauacgagccuugggaaccaggccucucugaccuuccuuccauaaaugcuaagagcacacagcugauaagaggcccuagagcucagaaggugggcuuuuuggauuuuacaauucccuugccacccuuagcggaaggaggagugaaauaaaguuuaaaaugugucuuuauccuuaaaagaccgcggggucugggcgcaguagcucaugccuguaaucccagcacuucgggaggccgaggcggguggaucaccugaagucagaaguucaagaccagccuggucaacauggugaaacuccaucucuacuaaaaauuagccgaguguaguggcaggcgccuguaaucccagcuacucaggaggcugaggcaggagacucacuugaacccgggaggcagagguugcagugagcugagaucgugccaaugcgcuccagccugggggacaagaaugaaacuuugucucgaaaaaaaaaaaaagaccaccggaagugccuuuguuuuuucuguugucaacucagcccuagacaaagucuggacuagaaucuuuaaggccuuagcuucauacauugaacuguuucccccaaacucucuaaauagaaguaggacucugaguccucugaacaguaagaacacuugcaguucagaccuauggaacuggggccugcccguuaaccuaccuguauagggauagcaaagacuucuggagcuuuuguaagauccaaaauuuguucagaauuaagaacuucuugauaucccguggcuguugcuguagcacuuuuaguaacagcaugucguacuacaaauaugccucuuggcauuuuggaugggaagguguacuauuagaugcuuugguuucaggaaauaaagagcaagcucugaagagcccuaagcaaagcugggaauugcaugccuuucuguuggcugccccaccuccuucucaauauccaucuguucucuuagaauugauuacuaaucuuccuccuagcugccauuuuuugagcauuaccaagugcuggggaggacacuaugcacuucguuuucccccugccagaguucuguucuccucauuucacaugagaggagagagggcacugaggcuuacauggcgaaggaaacuguggguggucauggagccagggaaaggcagagcuccuggcuguaugcagugggaaauggaucucucucuuggcuuauccuuuccgguuccugcuuugacagcccuuugaagguaaaaguaagccaaugccuacccccagccaaaaugucagaugauucuuaagguuuuuaaugugacaacugcuuauauugacuauaagcacuuugccuuugucucugcaaacauuuguauuuuaaauaagacucaaagaccaaaaaacagagaugaaaccaugggauagggcugccaugagggcagggacuaccaaagaguccucaaaucauuccaaguuaguggcucugcgcucauaagcuaagcauuucacagcacagcucuugcacauaacagacacauaaucagcugauuaaaacucaguucauguucuccguaaguguaagaaaagcacaaggaaagcuguuuugguuaacuucaguuucucuuagugagaaagcaucagcuuuauccagcaacuucacauauguaucuuuaaguuugaaaugcccacuguucauaggucagguuuuuauucuagguugcagauaacacuuggauuuguacauuaagaaaaaugaaagaauguucuccaguucauggaaauuuguuuggcuuuauuuugacaguguuucgaauuaaccagauaugaagaaggugaguuuauaguauguuuguuuacacugaagugccuuuaugauauuuugucuuguuugucccugaucacaauuuuagugcaaacauccuuuuggaugaucaguuucaacccaaacuaacugauuuugccauggcacacuuccggucccaccuagaacaucagaguuguaccauaaauaugaccagcagcagcaguaaacaucugugguacaugccagaagaguacaucagacaggggaaacuuuccauuaaaacagaugucuacagcuuuggaauugugaguaccaacugccaguuaacaaaggagaguuuauugccaagaauguucuagauucuaagaauuuuuuaaagaguuuuaacuuuugacucauugauuuccuguuagcucaucuuauauauuaauuuuguguaaucaagcaauuaauaaaauauaaaaucauuaaucagaaugaacuauauucauagucaugguuaauaguugcaacaaauuguguguauauuuuuaagauauauagcugacuuucuauauauuccuuguagguaauaauggaaguucuaacaggauguagaguaguguuagaugauccaaaacauauccagcugguaagaauuguuuucauccuggcaccuaucucuuggucauuuuuugaucaaguucucugugauaaaauugucucccucucuuccaagcgggaucuccuuagagaauugauggagaagagaggccuggauucaugucucucauuucuagauaagaaagugccucccugcccucggaauuucucugccaagcucuucuguuuggcaggccggugugcugcaacgcgggcaaaguuaagaccaucaauggaugaagugaguauauacaugguuuuauucaaaacugagcccacagaaccauggaaaaucuaaacuagauaaauuguguaucuaagugaauuauuuguuaaugagacaaauccagccuccaacagagaauuccaacauaauaguguuuccaggucaaaaagccacaucauuugguacucuguuagaggucauuucuagguggaaccaagacuccacaaaaaauuuaauguaaagacauaaaugagcaguuugcagggaauauuuuauucaaucuuuuuuuuuuuuuuuuuuuuuuuuuggagacagagucucacucugcugcccaggcuggagugcaguggcacggcccacugcaaccuccaccuccccaguucaagugauucuacugccucagccucccaaguagcugggauuauuaggcacgagccaccacgccuggcuaauuuuuguauuuuuaauagaggcgggguuucacauguuggccaggcuggucucgaacuccugaccucaagugauccacccgccuuggccucccaaaguguucagucuucauuaagagaucuggcucauuauaaaugcagcauauauuuuccuuauccauuuuuuuaaauuuauuaaucuauccauagacuuaaucacccauucauuuauuuguuuauuugcacaaauaaacaaauaaugccuacucugugugugccagacuuuguauugggugcugggaauauaucagugaucaagaugcaaugacuacccucaagcucacuguuaagaggagucagaucaguaaacauagaauguugguccagcaagagaaacaugaugauagacagaaggccagguugccguggagcaugaauucagaauacacaccagcccauggaaguuaaggaagcuuuuugauagauaugacgguuuagcuaagaucugaaaaacagguuggauuuaggcagcaguaaggauggaaagacaucccaagcagagagaaugaauaccugcaaaggcuccaaggugauggagcccauggugcuaagaccacagauaauucagcaucauggagggggagcagugagggaaagccuggagugguuaaaauaauagaagcuuccaugacagagggacaugaauuccauucuaggaguuuggauuuuauccugagucuaucauagagccaugcaaggguuuuaaacaaggaguugacauaaucagaauauaaacagcacuggccuucgaggcaggagagcuguauuccaggccugacaccacccgugagaguuguguggagccaagggcucaggaaggagcuaugacauauaucgugcagggacagagaauuggaagcccggagauccggugucaaacagcaggucuguaccuuacugacuaaugauacugcuucccuuuucugagccucaggcuuuaucaucuauaaaaugagaaugauuaauguuguuuguacagguuaaaugagauaauauaugugaaagcacuuuguaaacuguaaagcucucuauauguauuuuuuuaauuacguguguguguguauaugaagguauguuguaugguguauuaauuacaucaaggguucucacaucuagcuguacauccaaaucauccgaagcuucuaacauacagauuccuggaccuucaacaccuuauguuuugaaugacaaucucuauguugggaccaagggauaugcacuuuaaaagagcucccuaaaacuucuggcauuuagucaggggcccuggcucacgacuguaaucccagcacuuugagagucugagguggguggaucagcugaggucaggaguuugaaaccagccuggccaacauggcgaaaccccaucucuacuaaaaauacaaaaauuagcugggcaugguggcacgugccuguaauaccagcuacuugggaggcuaaggcaggaggauugccugaaccugggaggcguagguugcaguuagccgagauuaucccacugcgccacagccugggcaacagagugagacuccaucucaaaaaaaaacaaaacaaacaaacaaacaaaacaagaacaacaacaaaaaacuggcauuuaagaauuacagguugggcccaccauuuccuuauucccuuccaaucuuccacauauuaugguugaaguaaaaaauguagagacuugcccaaguucacaaagcuaguugguggcaaaucugaggcuuaagucaggucucuugguauuuacuuuaguguaguuucuuuuauaccugguuuuaagucacuuaauuuacuccucaaaauaaagggcguuagcuaaucuuuaagaucccuucuaauucaaaauucuauagcugaacuaauuucaugaaaaugaaagaauauucuuuauagguagagugauaaaagguaaaaggaaagauuauucaaacuuaauuuaaugucuguuugcuucuuuguuauuagguuuuaaauacucuugaaaguacucaagccagcuuguauuuugcugaagauccucccacaucacuaaaguccuucagguguccuucuccucuauuccuggagaauguaccaaguauuccaguggaagaugaugaaagccagaauaacaauuuacuaccuucugaugaaggccugaggauagacagaaugacucagaaaacuccuuuugaaugcagccagucugagguuauguuucugagcuuggacaaaaagccagagagcaagagaaaugaggaagcuugcaacaugcccaguucuucuugugaagaaaguugguucccaaaguauauaguuccaucccaggacuuaaggcccuauaagguaaauauagauccuucuucagaagcuccagggcauucuugcaggagcaggccaguggagagcagcuguuccuccaaauuuuccugggaugaauaugaacaguacaaaaaagaauaaauucuaccagaagauaaagaaaaaagcaaguauugcauaggcaccugagcauagguaugaccuugggaagacauuggcuccauaagcaaugccaagagaaugaucaauagugaguuugggugaugcagauaaacaaucuggauaauuccauuucuuuuuucccaaacccucaaacagagugccuuaaaaaauuguuuuaucaggauaauugucucaugaccaaauccacgcucaauuagagccauucaaaauuccuuaagaucauggguucugacuucagccaaacaaaacaaucaaaaccuaccaaaaagggacuggauuguaauguccucuccaucauccucagugugaguccucagagccuccaucugccaagaacauucaguuggauuccaucguuugguuuagcuugcuugcacggguuguaggaaaugucuaauuuguaaauguuaauagauaccuuuggaaagaaucaccuuguuauucugauugaccccucuuguuuuuugguuaaucccugacuagccugcuugucugaaaaugagccagguucacccuuagcuacggcaugcucuggguugaaaggggauuucuucccaagaucuauccuaaacucuuaggacaguuuauccuguauugacuauuauuacagcuuuuuaaaaaca

SEQ ID NO: 16409 - RNA, 25768 nt, Homo sapiens
ccuuugguccacaaaucuggauuugccagaggaaaauuccaaacagaccaggaaagcaaaaaccacugacaccaucuccauaauaacuguaaaacugaaacauacacguucuacaaagagggcuguucuucuaccuccucaggaacaauuugacaaaggcaaacacuuuaugcacuagcccuggacaaacaaugcaaagaaaaaucuugugcagcugauuucagggucaagagggcgcuucuuaccaacccucaaagacaaaccagcacagagaauaguaaaaugugcaaagccaaaccaguugcuacucucuauccauuccccaauuuccuuuguucacagaaagugacccucuccauggcccugggguaaaucugauuuguucaugguggugaugcuggucccauuccccuugcaaagcaggucuggccuguuaaaaagggccaugaaaucugcagggacugucggaagagacucuccugcuggaccuugacauuucuggaagugccacuaugaauggacacugcaaauggcuguacccauuuuuugacucugaaggaaauagacugagaauaaaugucaacuggaagagcagaaagaaagaaucugaagcuccgacauuucuugaccuacugaauuuaccaacuuuaaaugugcaucaucuccaggcuuuuuguuauguuaaguaaauaauauccuuauuauuaaaucaguuugaguugggguucacuguuauacccaaaagcauacaguaggaauuaucuuuggugggcuauuugagacucaucagaauucuuuaucuacagucuuacaaauugguuggauuuccauuaccuccuuacauacacugaucagcaggaaauacagggagaucaaauuauauuuaauaugucuuuuaaaauacacucauuuucuucuauccacuuuuggaacuccaaaaaaguaacucucucaugcuaacaacucccuuauuagagaaaagaauuguagguguguaagcauuguuuucccaugacaacguuuuuuuuuaauuauuuauuuauuuagagacagggucucacuuugucacccaggcuggagugcaguggcacgauuacagcucauggcagccucgaccuccccaggcucaggugauccuacuaccucagccuccugaguaguugagacuacuacuaucaaauggguagcauguaccaucacacccggcugauuuuuguacuuuuuuuuagagauagaguuugccauguugcccaugccggccucgaacuccuagguucaagccauccucucaccucauccucccaagcaagucacugggccccccaaaucuaagagucauguccaggaaucagcauuucuaacaagcacucuuuuaugagauauauggaagguaugacucagcgcuugaggaagaagagcuacaagaggaagaggacuucuuccaggcaaugagaggcuuagaaauuaguuggaaaccuuuuuugaauauuuacuucuuccagaagacuagaaacauaguagggacugagugagucagguagauggccaauuucccugcuuugggaagauucucccugaaauuuuccauugguguuaugcucugcucaauguuuguaaacacagcuucucugauacuggagcaugaagcagugugucgguagcuuugacuaguaaugugucuuaauguaaauauguauaaauauuauauguacacacacacaugcacacauacaagcuuuuuuuuuuucuuuuugagaccgagucucgcucugucacccaggcuagagcacaguggcgugaucucggcucacugcaaccuccacuucccagagucaagcuauucuuuugccucagccuccugagcagcugugaauacaggcacccaccaccacaccuggcuaauuuuuguacuuuuaguagagaugggguuucaccauguuggccaggcuggucuugaacuccugaccucaggugaucccccugccuuggccucccaaagugcugggauuauaggugugagacaccacgcccggccacauacaagcuuuaaaugaagucuuuuaaaugacuuccucuguauuuauguaucauaaguaaaaaauaaugucauggaugguaacauucuacagaaaugaacacaugcacgggagcaccagccagggaacacagagaccauacuggacaagggauuaaaggcaagagacguggagauuucuucaguagaaagccauguggaugggaaggggagagaugugauuauguagaugggccuacaucauuaugggaaagacucguauggcaucuguauggggaacaagcauuuuuauucuucuccauauuuuggucacagacaauaacacauaauacaugagauuguaaaguccagagguacaggaacugugccuguauauuuucuauaucauagauaccacagaauuuauagcuaacauuuguaacauaaucaaauauuauagcaggugauaaacaagagagaaaaaaaaacaaaaauaagucauuaacauuuaucacggauauuuuagccuucauagccuuaacugaauuucuuuucuauagaguuuucaagaggaauaauagaaauaaaagauuaaagaaaguauagauagauagauauagcuauaaauaagaauagcaggauaggauuucuacuuuuauagaaaucuagugagaaacaagaugcucuuuauauuucuaaaacaucuugaacuuuuugaugagaaaacuuuuuucagagcaaagcuguuacuauaaaaauaguauucuagugcugauuuguccuuuaaauauauuagaaacauucuuuugaacuaagaucuuuuaaauuguuauauuaaaaugcaguuuuucuccuuauuuggucauuuuucuucuuagugaaaucauaguccaaggaagcuagauuuuuauuauguuuuuaaaaacagaugcuauuuuuauagauaaaagaggaugguugccuauaacacugauuuucuucguaaaaaaaauaagaagcacagaauaugcugaauaauugcccaaaauacuuuucuggggcaguguagaauagugagaagggaaaaagauguggagcuauacaaccuggguggguguuauaguuucauuauaugcuggccuugcaauguuuugcaagucaauuacugucuuuuggauuuagcuucugcaugcaugaaucugaauggcuauacuucuguacaugguuguuguaaggguuaaaaucagucagugcacuuuuaaaucacguuacaaacuaugugucacuguuaugugacacauacaaauuaugcauuaucaucauaugaucgauaucaacaaaaugaaaacucgugucaucucaucuugaaaugaaagaauguuugauuccaugaaugugaucgugaagccgaguucagagagacauuucuggaauauucuauacaaugcuaaacaaagauaagcaguuuuuaaguuaacggaaugcugaacccagaaucauccauuuuagggaaguugagcugaguaagguaguucaagacaguugccugaagcuccacuuagguuugagauggaguagauucggaagacaagacgaaugaaguauuugauuuucuaaaaaagggaauggagacauuuuaauuuacagcuucugaggaaaggucaucaauccagagaagaccgugaaggaagguccaggaagaagguauccucuggaaaggccagggugucagggccacuguggaagugugggcauguagcagaaagaacucacuucacaacuguuuaaaaacguuaaggauauaagcuaauguucgggaauaguuaauguuucucggagugaauauuaagcuuccuccaagaaaaacaacucaacuccuaaagucagcccuaaacuagugccaagaaaauagugcuaaauuaggcuucuaggagagauaugacucaguuaaguaucauagagcacucaacccauaaacuauccauuuguaguccuugagaacauaagagauuacaaauaaauguacugacucuuuccuuaaggaaaagaaaugccuaaaaucaugauucagcuuuuuaaauucaguuuccauguguaacuguuauagcugcugggaaauacuugauagucaaaucauuuuguaaaaccauuuccaaauguuuagucuaagauugggcaaauguucuuggaaccaaauaaauuuucugaguauugauucuaaaucucuuuagucagaaugaaaguacuaagaacuguuuuaaaaaucauauuuuucuguaagcuuaugggcaagcauacaagaaaagauauacauguuacaugucaaauuguguguaucuaguucaaguccugauccgauuucauauaaucucuaucugaauaauuggccaaaugucaagaagaugcauaucuuaaagggacuuucaaguauauugccaacgugauuggaguauuaacaacaaauuuggauauuaauucuugguaaucuccaauagcaucuaauuucauuuccauuauuucauagaugccuccuuuucaucuaauauugagcauuaauuagucuuuauuuggcuggaguuaacauuagcuaaaguuugaacuuaggcuauagcaucugugcauacauguuugauuugugaaaacccagcagcauggcaguucaaauauuuauucauuuuccugugcuggcucuuaagcacaugugcauaugcaaagugaccuagcuuugugaauggucauacacagagaaaaagaaauacauauagaauaaauaauuugggccuuaaaaaauauguauauauguguguguguguauacauauauauguauagcguuccuuuuuugaaaacuuguagcauaaggaaauaggacugaaacauucauuauuuucuaugaaguaacauuaaucucacaauuuucacuccacuuuuugacuaaggguggauuuuuccccuaaaaucuuagagaaucauaaaaaaugagaugaaaagucaacuucugagacuguguauuccuuuaccccaccugugugcgacuguuuacuucagacugcuuuauguuccucagagcacaaccaucuccuguaaaacaaaaaugccuauuaaacugcuauaacucgggagcacaccggagcauccccuuaacacuaaccaugguuugacaacacuauccccaaaccacaucuuuugcuuucuaauuuguuaagcuuaacuguaaucuuuaacuuuccaaagugaaggcaaagaaauuuucuuaauguauuucuuugugauagggaaaaagugauacuuuucuucuacuucgucuucaaauuucuucuggaauuuuuuuucagugaccuuaucucuacuuuuucauuuucccuauuauaaagaaaauagucaucucuucuuucauacauuuaucuuuuccauauuugaugagcacgccuccccgcacuuaagaaaacauuguaggaaaaaaauauuaaucuaaaauuguacauuguacucuaauaucuguuuuucauuugucucccccauuagacucuaggcuucuugaaagauuucuucuuuguuuucuacacccaguuccugccugucauauaguucaaauaucaauuaguauucgaugagccaaugaaccacuucaucaggucagaauccagaaggauacauuuugaaacuaaucaugacacugugauuuuuaaagggcuucccauugaucuuuucacuccauuccaaaggugucugaaaggcaccagagggaaggcaaaaacuccaaaguaucagccccccagucuguucucaugagagcugcuauggcucauugccacacauacgcagucugauguuaaucaacacuaacuagagcagcuuguggcuauucucauccuugagcagaugaaacaaggccagcagcagugagggcacuuugcuauaauaauccaauaaauacuuuugaaaugaugcuuacuuuugucuuuugcauuaaagucuaagcgcaaagccaaguagaauagaaaauaaagaacacuuccccucuuccacaauaccaagcagaaauuccagagauuuugccaaaacucccccauagauuuaucgcuucuuaggagacuuuguacagagaacuacaaaaucuccuuugcaccauaagggccagauguuacuguugaauuguaaccacccauagcuacauguguacacacauuucacagucaucucuaaaugcacacaggaggcacaaugaauggaaguuaagaccuaaccuaggcuuuuucuagguucagagaaaacccugacuagcuacuccugguagaugguuucuccucuuuaccaaagccucccaucacuagggggcagguucauucccaacuuaggaagcacuaaaacagaaaagcuuucaaccccagaaaagugguaccuagaggugugauuuguauagcuagcuguagcugagucucauccucacaauguugcaucaacauuugaucugaaauaaauccuucaaacuucagauauaucauauuccuaucuaauuaucaaaauacauuccuuagguacauuaaaacuuuuugaucacuuacuauuguagaauaccucaaacugaacuccccuauaucugaucaauaccugaguugaccauuaauuuuaaauuuaauucaaagugacaguuuucauucuagaccuuccuuggauagccacagagauguguuauguacaaauuauuucagucauccaguuucaaugaagagguagaguucagguggauuuggaguggguaugagaaucuagccagauggccacaaagacaguccuggugcucuggaagaacaaccacagcauaagcaagaaacuggaacaccacaccugguauaggccaaucccucuuuucaccacaaucuggcagucuuugguaaaauaaguguaaggggaaggauccaggcuggagaggagugagcagaaaaauugaguacaggaucucagaagguacaaaaagcuacgcagaagguacaaaaaucuguugccuaauacagccuaaugacaagucacaaaaauuaccuuacugaauuagaaagaccuuaucuugauuguaugggauuaaaccauaugaaauugcugauaauugauugguucugaccuacaaaaaugccaguucagcuagcucaaccugauaguaugagucacacggggugaaugcuaugaagacgcucugccuccaccuauccuggugauacaggucugcaggaggguuugcaucuagaaaucagagauuuuuguuuuuuaagagucagagucuugcuauguugcccauauuggaaugcagugacuacucacaggugcgaucauagcacacugcagccucgaacuucuggacucgaguccucuugccucagucucccaaguagcugggacuaaaagcaugugccaacaugcuuagcccuaagauuuuuuuuuuuuuacuuaaccuccccuggagcuccaguuuuucguugaggggccucaggggcauccugggagggcagagauggauuggaguggaggccacgugaaugagucucagaaauaccauuuugucugcuuucuguuguaggguuccacauaagaucuaacauaaaaggugugggggagguucuuaugcuuuaaaaaaaaaaaaaaugauucaaagccuccaaagccugaaguucauuuuuugaaaagugacccaaacacaaaucuugacauucuggaauauugaaguuuuaaaacuaaauccggagggccaugaacaaguaugucgaucacauaauuucgugaaaggcaaauucuugauaauggucauccuccuucagccagguaaaugucaaauucaaagaaaauauauucaggacagcacugugaaauuucugaggauaagagcauauuucacagcacauaaaugaaaguggaucucggugaauguucuauacagagagaaagguuguguuuugaaccuuuaaauaacuuuggacaaagggugaagaaggauauuguucacaccacaagucaaaagccacucccaucaaugugcccaaccacacaagucgaggcugcugcuggccuugaugguucauggccauuuggaguguuugcagagagauuggaugauuacuugucuagaauuugagcugugucuacuuauucaauauuuuggaacauuuuuucuauaaauaaccggucaauuuugucuagaaaucagugaagugauuaaguaauaggucuauguauuuauugaaauguugucuauaugguagggauauauucaucugucaguucaggcagauaaaacuggcuacacuuguguggauacaaacaugaucauaaaccucacuaguucaaugagcuggcuuacaucuaaaggacucuuuuggaaguugaaaaacaaauaucuuuugcguaaacauuuuuaauaugacaccauauuuaacuuaaaauuuuaaauaacagaugauccugugagaugcuauuuugugaggugugaaaggcccccaaaauguaacucucauugaggaauuuuuauagaaauuaggguuuuuacauucuuuauuaguaaauagcuagaagaucugucuuauacuauauugcuaugagaauggaaaacaaucuacaugaaaaaagauuaugcuauggcacagaaguaccuauugguugaacaauggucauaugauuuuaaaacaaaaucauaugauuuuaaaacaaagugggcaaaaucaccuacuacugccuggcaagaagcaaaggaucuaauuauauuaaaauucugcugcuuacauuaaacccagagacucaucugcacagacagccaugugaagggcuucuuucuuucuaaggucaacuugagacccuuuacauaauaaucauguuugcuuuaccauacauugugccuaauuuuuuuuuaaaaauuaaguuuguaagcucaauucaagccucuuuuuauuuaauguuuagauuaguacuaaaaugaacuacuaaugucuggguccuuuguuagcaaggauuuucuuucaauaccuaccagaaggaguggcuuagcugucugaguaucagcuuuaaaauaccuagacuuccuggaaccauagauuguauucuuaggagggcugaggaacuucuuaauuauucugaaauagguggaauggcagaccauuuccuacacaagugucucucuacaaaaucuuaaaaauccaaauacucuguggauuuuaaaaauucaguaacuuuuuuucuuccauuuggagaaauguucauuugcuguaugaccucagaaauccaaaaauauguccuuuccuuuugcuuaucuucuacaguuucuuagcauguuguacccuaagcuauuuguauauacuuuaacaaugauauuuauuugcuuaagcauuauacuuucaauuguggcugagcuaguccauucuaagggcuagacugcagagaacuacucacugaaauccaugugguuagaaagagcccuuuuaagcuucacgugguauguucaacucauggggucuuugaauucucaccacuuuuuuuuuuuuuugaggcagagucuugcuccgucacccaggcgggagugcaauggugugaucauagcuuacugcagccauaaccuccuaggcucaagcaauccucccaccucagucucccgaguagcugggaguacaggcaugcgccacuauaccuggcuaauuauuuuuaauagagaugaagucuugcuagguugcccaagcuggucucgaacucgugagcucaaacaauccucucaaagugcugagauuaccggcaugagccaccacacccggccacaguuucguuuuaacaucuguuaauccaaaaaauuucuucaaaguccuuuggugauuuugucaaugcugcuauugauguuuuguucugggaggaagcucucuuucaccccauuguauuuuagaaguuucaaugcaaccauggaaugaggauuuucauuacaagcuuuuugaaaggugcaauagucucaacauaaugaacucaaaaucucagugcauugaaggguuugcaugccaaguugaccaagugccuaaacuguauaaacucccuaugugcacacuuagaauuggaucaucagauuugucuaaacaacuugaaaggcuuugcuaucuguucacugaacagucauuaugauguacacaccuuuaagagggacucagccccuccacaacugauaaugaaggaagaaucuccaagugaggugaggcagcuggacuuugcaggucugacucuuguccccugcgauucacuuuucaucagcaaccuggaggaaucagaacuaggcccugcugaacaaucuggagaugaaaaucaaagccgggaaguacagcuucuccuggauuggaucucgauuugacuuuuuucuuuuuucuuuuuuucaaggaacagacuggguuucuucagagcauuauaucagggauuaagagaaucaguagacucggguuguuuugguuuuagaaaaagaucucagacgauuauuuaaauucccuaugccuugguuucccugugagaaaaugaaaacaguaaggccuggacccucccaguaacaaaggggcagauguuaaaaauauaaaggauucuagcuuucauauaggaaaugcaugugcaaaauauuacucauuuauuaaggugcaugaaaauuuacuguuaacaacacagaagacuaauauguaucauugauguuauucaggucuuauaaaacucuaguggccagucguguuuuuaaugccaagaaccccgaggagcaacugguuucuaagaaucaacacuuaguucugagccgagagaugccccaaggaagauaagagacuuacaguuuguuuggcguccaaaaagcuuuccagacagcaguuuguuuccuuucccuuuuuaugaauggugguaguauuaugcuucagucugcguuuucuaccaaagccauucauaaaaauaaaaacaaaacaaaauaacaacaacaaaaacuuucucggcacagucuggagccauugggugccagaggcugggaaaacauccuggcagccauaaccccaaccaacauugaaaguauucaagggucuguuuguuugguggucugaaaaguaugaagugcugugucugaggguagcugguagaaguuccgugacacggacuaggccgggagccagggcuggcagagauucagacauugucuuuccccucauugaagugucaggaccuaauucauggaaaauugggugagcuggcagcucuuucagaggauuucauugagcugcagugugcaggagucacaugaaugcgggagccucugccaaaaaaggagggggauuucugagcaguaggaaccagucagccugcaagaauguauguggauuugaaacgguuugggaguaaacauguguacagguguaaucaacagggaaaaaugggaggaagaugagugcucucuucuuccaaaugacccuuuggaaaugaauccucuauuagcccacgcuuuuguguccuaagaggcaagaaguccucaucguucuugguucgauuuucccuggagaaaacaucaucucaaaacuugggcuuuugugaugacgucaucuuuacugugauuuaaagucaaauggaagaacgucuuuuccuuugagcaaaaguaccuugccauuuauuuuauuuuuauucuguccaucuaaaaaaaaaaagcucuaaugauuuuuauauggaauuuuuaauguaccagcaauaaaccacuguaccacugagaggaacucugagaggaaggggcucucagaaugaaugaacaggggcuagugaauagugaacguauccuaagugcuguuauuugggagaacuggugcaagaaagcaugucgcuauccacaucagaguaccucagguguacucacaaaucucagcgauguguagauagaauaauacaugccuauauucagacaugagagugaggacuggaagcaaauaauccaucgaaaagcucaggcuucaaauccaucuuuuauaaugccaaagaaauaagaaguauucucuaauacucgauuggaaaguuaggcaggcagaaaaacauucccucggauguuucacucaaaagaggagaguuuugcucuacacauacaauagauacagauauaacacaauauaacacaauauucuucccaugauaccacgaagaaacugaacaaacucacagaauuauuugcaaaucauaagggacuugaaugcaaaacauuaaaagaacucuuacaacuuuguuaugaagagauagcaaauuuuuuuuaaaugggcaaaggauuuaaauaaacauuucuucccaggagacauauaaauggccaauaagcacaugaaaagaugcucaacaucauuaguugugagagaaguucaaauugaaacagcaaugauguuuaacuucacauccacuuggaugucuacaagcaaaaagacaggcaauaacaagcauuggcauguauacggagcaauuggaacuccagauucauugcuggugggacggacugcaaaaugguacagcugcuuuagaaagcugucuggcagcuccucaaaaagugaaacaaagaauuacaauaugaaccagcgauuccacucccagguacauacccaagaaugaaaacauguucgcacgaaaacguguauauaaauguucauaguagcauuauucauaauagccaaaggguggaaacaccccagauguccaccaacuaaugaauggauagguaaaaugugguauacccauacaagggaaaauuauuuagcaugaaaaggaaugaacugcugaugcuaccacauggaugacccuagaaaacccuaggccagugaaagaagccacacacaaaagacucuacauauauaguaugauuccacuuacaugaaaugucaggauagguaaauucauagagacagaaaguagauucauggucacuuaggcaugggagguggcuagggacguggaggguaguggggaguaaccacuaauggguacaagauuucuuuuagaggagaugaaaguguucuaaauuagacuguggugaugguugcacaacccucugaauauacuaaaauauacuuuaaaugagugaauuaugugguauguaaauuaugucucagugaagguguuuuaaaaaaauaaaauauuaacaaauuagguaccuucacuccucaguuuugugauauauaggcuaaaaacaaagugaaucaaacaguuaaguuucuuucaagcuaguuggcuuguaugccagaauuuaauugggaauuggaauuguuuucacugagauaaccuauguuguauuuccuuaauauagagagaucaugaauagacauuuuuguuuuuuuugagauaggguguugcucugucacccaggcuggagugcaguggcaugaucacggcucacugcagccuugaccuuucuuggcccaggugauccuuccauuuaggccucugaguagcugggacuacaguugcaacgccaccacacccuguuaauuuuuguauguuuguagagagaggguuucaccauguugcccagccuggucuacaacuccugggcucaagccauccguccgccucugccucccaaagcgcugggauuauaagcgugagccaccaugccuggccaaguauaaacacuuuuaacauuggauauaccaguugaacuuuauacuuuccucuuuccuuugcagacaaguaucuguauuuaaaauauguacaccuaauuuuuucuauaauguauauuuucuuuuaaaauauaucuuuuucuuuuccuccuuagccacaacaaguuguucagaagaagccugcucagguaagacauagucauuaauuuuuuucucccaauuaauauaaaaagugaaauauguacugaaaaauguccccaaacuaaaccuuauuucgcauuuucuuacuuuugguuaucguccugcaguauuccugaaaauguguuguagccuucaaaguuaggaauauauagucugcaaucguaccaugaaaaccucccaaaauguaaggucuuaaguguacaaagcaaauauaaauucuuuuaaaaauaaaacuauuuuauuacauugccucauauguaaaacaaauauuuaaucuuauccuauauuuuaccaauucuuaaacaucaaauuuuguccuuccaacugacugucuauauucuguugacaccagacuuauauuuaaugauucaugacuggaaacauauuucuucauugaacaauuucauaauauuugaugaucccaaaacacuccaaagaaugcuagaauacuuggaaauuaaguuauacuaacgugcagacugaugcauucuuagaucuuauuuaaauaacugaaucacagucucugaaguuuuuggcaacaucaaauuggaaaauagcucuacgucucuugccccauauuccuggagcaccuuguccucacuauaaucuguacauagaaacauuaaaaaaacauauuuauugaggaagcauaucuugaagaaaacaaaacugaaguauaaauuaaccaggauugcuaauaaugugagccaguauuaaaguauaagaacguccugcuguucucuucccuucuguauguaaauagucauuggagauccaggugguaucaugcugaaccugcuaaaauaaguaguaagcagugucaugagcuaucaaauuaaguagaacucuuucauguaauuuuaaguauccaugaaauuuuuuucccuagaagucuuuacaaaucuaccuugcauccuguuuucuuaggucaauguugccuugccugggaaggaccacccgggcaaucuuauauaucuacuguucucuaaaaaugccacuuagaagagaauugaaacuuccaaacacaugaaaggauccaaggaaagugucuucaaacaauuacauaugagcuuuaaguggaauaaaaacagaguuaccaugaaaaaaaucauuuucauugcugcucccauaccuaaaagcuaagagugggagaggggugcuaaaaaaaacccaguguuugugcgucuuuaagcaauauuuaaaaauauauacauauaaacaaaaacuugacauuuucauuaggagaacccaaauauauuuagccucucauccuuuaacuguacaaaaaucaagagaaaguaaauugauaauucugugcauuugagucaaaggaugaggcagaguucacauuugcaucacaggcugugaacuauagauuaaucacuuuaugugguuuguuaauauugauucagcccuugugcuuagugucauagggaagaugagucaaacaaagaaaaacagucacugcaucugagaaauguauuuauauguauaugccuguguccuauccagugguaugcuggaaccagcccuugugagcaaauagugaacaucucuucugaauucuguguucagugaugucaaguagguagcuugaaauccacuauggugggaguauuuacaccauggaaagugacaaauacuacaaaucaggacuuuuuuuuuuccugaggagcaaguaguuaaacauuuaccuccccagcauggccccacccuucagcgauucuguuuauuuggucuggagauccaucauauuuuuuaugaacucccuaagugaguuuaauaugcaacuagagaugaagacacuccaugaaaacacaugagaagaugucugaacauuuguugagcaaaugaccacagaaugucaauguguaugggacacacgggggauacagaugaaugaguggaaugccucagguuaucaaggggaugauaagacuggaauuuucuuguuuuguuugauuuuguuguuguugaguugcagaagggaaaacugaaacauaaauuaagggaaagaaauuacagaugagaugaauggcauauagaaagguagagaggcaagaacaaauacaucauagguggagauuauuaauauggcuagaacugauugcaaguuggacauuaauacaucaagaaauaauauaagugaaaucacaguuguuuuucccaagagaauucagaaucucaaagaagccacaaguggauugaguugaucuucaaggaucaaucuggcuaucuuacagacccuguuccagauuugcccuuuauaggagaguucagacucagaauuauaaaaaagaacaugagcucauugggcuaccuaauuuauauuguguaaugacacagugaugaauuauauaaacaugaaaacuacgugaaaguucguggaggauaauguaaauuuuacacuacauucaaaagaaucucuuccuuuuccaucuguuucuuucaaaauacccucccagauggcuuucccaugaggcaaucuggauuaacucagccucauauccuuccuucaacagcacuuugagggguuacauucagaaucgcuuuugaggugguaaaaauuuuagcacaacuaaauauuuuacaucuaaagaaaagggcucagcaguguguaaacagaccuacguuuuucuuucuggccccaucacugggcuaauuaauuucucuuugcucuauuuauccaucuaggaaaugggauaauaauaaugccuuuucccuuacucccaagaacauuacaagagaugcauaauuauauaaauuccagguagcauuauuacauucugacuuauuuuugacuguuaaguuuuucauuuccagagauuuauagucucaaaaauucuagaauccugauuuauuccaaaguacuuccucuuugacgucaaguguuuucauugaauguuuuuuaaggcaggaauuuuuuagcuggaggaaauuuucuaguaauugcuccauccuacuguuagggcuaaagcauucagaaucaucuuccuagcauuuaugucacacguauacagaauuacaaaggcucuguggugaaguauccucauacugcccaaugcugaagucuccucagaacuucaagaauggcccuuguugaaccugggguacaaagcagcagaguuuauucugaggagacaaauucagaauuaugauaaaucucagcaccugcauacgcacuuguguuuguguauacaaguacaugcaucuagagagaaaugaaaagugaaggaccacccuguugcagggguuuguguuugcgaaauccaccaggugucaucagcugcaaacaucaagugugucccauaauccuaaugggagaguuaauagucucuuaaaaaucuaaaggggaaaaucuguaauauguacguuaacuuuuuucuaaaauuccaaaaccaaugaaaacagcuuacaaaauaacucuacuauauuuccacuucaagugauaaacaauaaauugaaaucagcuaauuacaaauaaauagaaaugaggcugggugcaguggcucacaccuguaaucccaacacuuugggaggucaggaguucgagaccagccuggccaacauggugaagccccaucucuacuaaauacacaaaaauuagccgggcguggcggcggccaucuauaaucccagcuacucgggaggcugaggcaggagaaucacuugaaccugguuggcgggggaggguugccgugagcagagauugugccacugcaccccagccugggugacagcgagacuccaucucaaaagaaagaaagaaagaaauagaaagcagcucguuuuuuagcaauuugagcaguugaauucucagucauaugaauuacauucuucaguaggaaauggugguagguuuuucuuuuucuuuuuuuaaaaaaagaaacaccauaaaaguaccagauuauuauuauuauuagagggugcuuuguuacucaaguuuuuacuuugauaaaaauaagugucucuccaacugagaugucuaaaaaaguuucgcuaguuuaucagguauuugaucguuuauugcuauuucccuuuuaaggcuuuaaucugagacuugaagggacucccuaaauguaauucagacauuuuucucucaccuuucuucuacccaaagggaaaacagguuuuuaaaauccuaacagcucuccacccuuucaauccacuuuccccauuguuguacagcccuggcaaacgaugccucuggcaauuaggacagguauaaaccugcuccuuuucaauuucccaaugagagaauugcaaaguuuucaguuucuaaaagacuggaaacaaagcuuucuguuucaaaaaaagaguuuuuacuugcaaguaacaucuucuguggguggugugcacccgggcaaagaaaucucaguaagccuugauuaucacgggauuucuucccccucaaaauaaaauguugaauguuuuuacagagacuucaagggcaguuuuaaggauguuuauauuucagacaaccuaaacauuguuuggagcaaaaugagagauuucauuuugggacaagcaaguugaugaauugcagucagcaucucguucucaaagaaggcauuuuuacugggggcuuuuagucuagacauacaaagagggaaggaggaaaggggaaagcauucucacucuaacacucgucuuuuacaugguaccuuggccagugcaguaaauaguucauaauaaaucagacuuacaaauacucacucgucuacucacucaaggagcauaaugauuuauacugccuaagucacaaagauuaccgauguauuuauuuucuugcuuaugcacuuucaagcuaguaaaacaucuugugggccaguaaauguuuaguaccaacuggcaaaacaugaagaaucauaucaaagguugcccuaaguugcacgguuuuguuguauaggaaauacuuuuugacuuaaccucugaccucugacaucaccaaggucaagggaaaaggagagagcaaaguagaaaccaagguuuaacccuuaauaaaguagcucaaggacauagaagcacagggaaauuggagggcagaggaagcguaucaaaaugauuauuaacuguaaacagaugaaguaauuagcuuagcuaacaguuguaauacaggaauauuggcaggaugaagucagcgguucuuggcaggaaauguuuuauagagaugacaacuucuaacagaagugaaagaacaucaaucaauuuagggcaacuuauaaaacuccaaaaagcaaaauuuaguguuucuggacuugacaaauuugcugugagaguuuuuuuuuuaaguaugacuguuucuguguggggaagucuguggauuaggcucaaaacaaaauggcaguggcugccugcauuuccucuucauauugcagaauuuuccucuacauuuugauguguacuggauaaaaaccaauuguuuacucaauauauaaucuuucuucuuacucuccaaacuugcugacccaaauuaauguggaacaaauagcaacuggcuuuaaaaccuggucuuucuaagaaaauccuuaaugguugcauagaaauauguugcauugccucagacacuuacauucaggaaauguuugcuggacacucagaugucuacagagaaauuguuaacuuacuguuauugauauuuuuauaaucuuacucaaaagucauaacucaggauaaugaaaaauguuuggugcaauaaugauuaaaauccacaaauauucuguucccuggccgcaaauacaacaccuaugcaaaauuuuacacaucuacaaaacaaagggaaaagguuuuuccuagucuaugccauuaauaagcacaucuggaauauaacccuuaagcagucuuuaaucauaauuuaaagcuacuuugcauaaaaauaagaacauuccacaacagcuguggaaacauugaaauaaauuuucuucuucugggccgggcacgguggcucaugccuguuaucccagcacuuugggaggcccaggcagaaguauuccuugagcccaggaguuugagaccagccugagcaacauagugagaccccaucucuauuuaaaaaaaaaaaaaauuaccuucuuuugaauacuuuguuuaugcaaaaauccuuuugcuuucuuuagcuauuuuuuuaaaugcaguguuccugcaguaagaauugaaccuggcauggaaaacugaucaaaccgguaguccucagaaaucaucacuccugaaacuugcaauuaguuuauaccuaaaaugauuucccuauuugaaaaaugugccuaccauuuccagauuuuaaaaaaauggcccuuuaucccagaaaggagaaauucauuguaucccagagaccagcauuacuucuguugcaguauuuucagugauggaacucuguugaggcuacagacaagaaaagcaggagagcauuuuaggaaucuaagauuuuuuauuuuacuuuccucuggggaccuucuuuaauaguuuuuuucuuucuuaagaaccuauccuugaaucauagguaaagaaauaaucacagaaugaguaacugacauuaauaaucacagcuucacacuauagucuuacuggauuuuuacguuuuucaggguuuccccaagugguggucacauuucuuacacaacucugcaguguagauagacauguauagucauuacugggcugacacggugggacugagaccugcuagugccgugguuggcaucuaugauuagugagguccaagaucaaccuucuuuacauuaaacaugcccuagcaagaccuucaacccaacuuuauuaagcugaugcuaacgcacacaaagaaguccuaacaauucuauguuuuuauauacauaaugcaaaaauaaagacaagaucagguacaauugcugucaauaucucaacuuauugucuccuuuugaaaaacauaauucccgccuagcauuuccaccagaaucccuugcucuugccagguuauauuguuuauauauguuccauuuaacauguuuuuuaaaaaucugcuguagaguuuuccuaguuggaggaaauaaucacuuuccauuaaguuaaacagucccgauaaauuuuaaaugaaaauaucugacagagaaauagaaaaacucagccuuguggucuugccggucacuuagcuacagauggaacuugaaaaacugguuccuggucauugcugcugaagagagcccuuuauuucuguugugacaggacugacucaagauacucaugaacguggaaaacuccuaaaugugucauucugaguuccugagaaguugaacauacacagaugacaaaaaagaaugccauuuagccauaacuacccuuucuagauuaccaaguauuuguagguuuauuggcaagauagcuuaaauuacguauguauuucuggccugcaacaucauguaauagaagaguugcagaauucuuugcaguuaagaaaaaaaaaaaaagauaaggacuuauuaaagcugacauggacugugauuuuugcacuccguaccacacacaaaggagggcaucguggugacaccaccccuguguuuguauuucuugguuccauuuagaauucacuggccucuucuacugcagaccugcuguuuagucugcaucuggaaauuaaacccagagcuucagcucuuagcauuaaauauugaacuuucuuccagcacacacccucauccaugccuguauaguaagucugauuaaacucaagacauuuuaaaauuccaucagccuuaggaguuaaguuuggauauugggcugucuuccuccuccuuuuuaaucuauuagaagaaguguacccaaagguauauauaccacaugcaucauguugaaccaaauuaaaagaacagugauaugugcaaacuauauuucuggguuuuaguggaguuuuuuuccaaacuuagcuaaaacaaugaguuacauuuaucaaauuccuuuuuucaugaacaaaagaaaaacuaaggcaaaguaagugcacuuuuccaguaguuauaauaaaaauauaguuuuccaacucugcccaccccuguuccccacucaucaguuuucugccaagaaaccucacauguuucggcccgguaccucacuugucuuuguaaaguagcugcaugauggcugggagcuuuucgguguuuagaggccuuaguggcuggugcucauaaaaaugucaccgugcacuugcacuuugaaaaguccuuucaucugaacauuccugaagccccauuccaacagguaagccuucuugaccaaagaguggcuguuuagccuucccacccugccacuagacccuaaugagaugugugcaacucuuggcuacaguuuucaucuccuuauuacuucaaggcuccucuugggagcuacacaagcucaaagguccuuugaccauuaggugacaaaugagaagcaauuuuuuaaaaacaugucaagguaaaagcuauugucuauaacacacggccaugucuuuuuuucuuuuuuuuucuuuuuauuugagacggagucuugcucugucgcccaggcuggagugcaguggcaccaucucggcucacugcaagcucugcuuccuggguucacagcauucuccugccgcagccucccaaguagcugggacuucaggugcccgccaccacgccuggcuaauuuuuuguauuuuuaguagagaugggguuucaccguguuagccaggauggucucgaucuccugaccucgugauccgccugccuaggccucccaaagugcugggauuacaggcguaagccaccauaccuggccccauccaugucuuuuaaguuauuaaagaugaucgaagcucaggggucccuaccaacuccucaguuacagaaacaggacucuuuggggaugucggagccagcugcuuauucuccaugucaccuguuucuguucccucuuugcaccacagaagcacccuguguuaagucuggccgaaccaugacacuuaggagagcugagaauggguuuuccaaccucauuccugacagggaggauuuuucuucucuucauugaaugcacacuugucguacagaauccgcacauguaaccaaagaccaagucacugggaaggugagagcugagguuugcagaggugggaaaagccaccugccccaccacaucaacccuuugggaaccauuccuuccuuugaaggguggccagccagggcuaugccaagaagagagagcucuccacuaacuagacauuugagaaaaccaucauucugagcaugugagagccacauugccuccaaaccuuuaaugaagugagacuuccacccucugacauccuagucauguucccaguacuaacugauaguuacuaguagaauucuaaggucagcagaaagauacauuaauaaaacaacuauccacauugucuuauccacauugucuuaaggacaguuaaggaaacaauaugaccuaccaccauuuucaucugaauugugucuaaaggguuggaauucaggaguuucagcagcucacaucaagcaaaguuucugggaauguuuugaaaagcugaucacauuccaucuaguacaaggucuuuguuaaguucauggccugaaaauucuguuuccuuccggauuugaaaguaccuugguuuccggauaguauagaaaaaucaaacaguuagaaauugaauaauuacagcacaauccaggagguuugccagcuugacugaguucuaucaauuuuuuaaccguaagaaggaauaaaauauacuugcuggcuuuuaugccguggucuguuucagaguagucaccuaaguccacaccucaugucagaaugagaagugaaucaucuggggacaaacgagguguguaucugccuaacagcuuagugacuuucuggaauuuaaauauuaagugaaaggacagggucacagggcagcugaucuuuggcucgucucucuuucgucugcccauggcuuugaucaugcuacauccuccuuuguggccagggcuccacagagaaucucagggucauggccuguugccuagucaagagguauaaaccugcugcuuaaauaugugaagcccacaguuuggggguugggaguuaaaggggagguagccucauacguuccacuuuucccacaaaacccaaagcagacuaaacaaaaccggugugaaaucucaugacuugaugcugccgugguuauauuuuucaagcuguaauccauucauuuguauguguguuuauucccaggauuuacagcucgcucagucuucggggggaaagagaauauuugaaaccuuuugcaaaggguuugaaguaugcaguggccugugauuaaagcccaggauagaguguguguguguguguguguaugugugugugugugcauucaugugaaugugugagugcccauucuugugggguuuuuuucucccauuugcugcuuuuacgcaaaagcaucacacaugguagcauuuaggagccccuucacagcugaaguguuucaaacacuaaugaauggaaguuuggucauauaaugcagacaagcuuuaaggcaugcuuuacugaaugguguacuguagugaccugggaaaggaagagagguauaaauugugucgguuagccacccagacaaaaugaagccauguggaaaaucaaaucuauuaaaguaugaagacuguuauaagcuguuuuaagcuggccauucuuaaaggggcucggucugcugcaggaguaaauguuuaccucuucccccagaucuuuuucacaugccgucuuaugagacaaugugcagcauuugauaaaaaucauccucucacuaacgacgcuuuuaucggaaauguuuauugucuccgcuuuaccacccauguccugaaagguacugcacauuuguuaaauaagcaaaaggaaagagaacuuugcggcucaagccggcucgcagaaaccccaacaaauuccagagccauaaggaaucagaaaaaggaaaagggaaggaggaguuagauuuauaugaagagggggccuugcaaaaacauauauauuagauuuucucugcuuggcuagcccaccaucaaauguuuggucgaugcggauuaguauugagauugagcaguuaacgccgaacuugggucacugucucaaaaugugcuuuaauaaauacaagggggaggaaauggauuugggaaggcucguugucagcucugccccugcucucacacugccucugcacagugguguaggggucacacacagguguuggcaccaguaccaacccgacccaaauccuggucccacacacccuguaauuuugggcacauuacuugucugugccuugguuuucucagauguaaaacaggaauauuaacagaaggugccuaagcaucugguaagcacucuaaaaauaccagcuauuauuaccaguaucuggaggguggguucauuuauaccuuaagaaaggaucccccuaacucuauuuuucuugugugccgguuuuuaaaacugaugaauggcaugcugucgggaaaaauuuauccauuccuacuuuuuuucuaauuggugaguaagcgugcauugcccugacauucucuggacagcaaacaauugaauuugcugaccagccgccaugaugucaagccuuaagucaacaguggcuaaugaccgcucugggaaaaaacaacaccuugauuccucaauuacgguuuaagaagcccugggaaugagggcucgccagucaucgucauccucuuuugaggcaagcauaaugugcuguggaaacagguuaccucugcacuguuggcaagagcagcccacacaguauaacgauugagcgucauggcugugcccuuuguguguuccaggaggaaacugaagagacauccucacaagagucugccgaagaggacuagggggcgccaacguucgauuucuaccucagcagcaguuggaucuuuugaagggagaagacacugcagugaccacuuauucuguauugccauggucuu

SEQ ID NO: 16410 - RNA, 2688 nt, Homo sapiens
cuccugcuccucuccucccccucguccuccucugccccagggcugccggccgccuucugccugggggcaucccuuuccaacucgggaccccagaacacagccaagcgcccaccuggcguguuccaccugagaccgcugaaggagugggaaacggacaaaccaacacgaagagaccggacagcgagccagggaccugugggaagacgugucagggguuguugagagcguugguggugaggggauaaaaaguugugggagagugaggcaggagcagggcugccaguuaguuacuuggccauccuauacauacagaacgagcacucacuguaauacggagaaccagccgccugcguuccaggugagcgggcccucucuagcagaggagggugaguguguguguguucuuggccaaaauugcaaaggugcucgucccaaacuuauauuugaacaccauauauggagcccaggcaggcuggcugaacaguaguuuuucacaacaaaaugcuuaaguuuacaccggucuuucucuccaccuccaaucucuauucauguccaccccccaacccccuccacacacuuguuuuguauguaccguagcuugucuaaaaugaaaugguguaauucauucagaaggugccaccucugaugaacaaaaugucaguccuagauguuuaauuacaggcccaagccuguaguugccuaauuuuccuuggcacugauaacuccuuggguaaucaaguccaaaugacccuuagcuuuucaagacaacauaauuaugucuuaauuacuauaauauauuuuuucccucaaacuaaugggacaggaccuggauauguaggguauuaaguaguuacuuacgaacauuuuaagaugcuagaugauacagaaaugauuuauugauccaaaauacuuaagggguaaaugucaaacagauuuagaguguggauuauuucaacgugaacuaaagugaugguaauuuguacaucacacuauuuguuugaaaaugcuguauuugaaaaucaagaacguuguuucaaaucaaacucaguucuggcaaacuauuaaaacacauacaccaaaaaacaguccauugcaaguggcuccccucaaaacaucugguacugaaaaacaccacauccugugaauuacauauagcaaaugggcaaaugucacccuuaaugcauuggcaauuauaaugggacuaaggguagaugacccagauaaaguaauggugaauaaauuguaaugcaaugaauaaaggauuuaaaugacacauaacaugacuauuuaauuagguaccuagaaccuagguaguuggaaauacugaagaagcucuucaguauucccuccguuuccucuuuuuuuauagccuuguguuacauaagugucuguuuuucuacuucccccacaacacuuugcaaaguucuuugcccauaguccaaauguuuguuuaaaaacaaaaauaaaaugggcacagccauuuguagaaaggaauuuagaagcucccuaaguguaaagcauguuucaaaggauugcaauaauuaugccuauauuuaaaauauuuuagugaagaaccuuacauacaaaaauauagaauuauaaaaaaugcaauaucauuacaacccaauucauguuaguaaaaauagagaguucauuguaucaacauagcugacaucacugucagcaaugccaaccacuauucuaaaggcuugaauaaauaugcuaagaguggcagaaaagaacuaaaguuacuaagugcaugauaagugccagacacugugcuagauguuuuuuauaacugauaucucauuuaauucuuacaaauaucucugagauuauuuuuaucccuauuuuacagcuaaggagacugaggcauagguaaguaauaugcuaccaggaagaagugaaguaguauuagaauuaaauccucauucuaaagugcauauauacuuuuaccauacuaaucugucuuauuuucucuacauuaaaaaaaaguggcauucaaaaacuguauucauugggcgcuuuugguuuuaaguaacugguaugcacucagguuaccucaaguaaccaagguaaagaauacauguggaaauaagaccagaggcuuaccuggcuugucagaucauccuuuguaggcauggugggcggggccugugccuuugaaagcuaggggaaugggaaagguacuacccccuugaccacauuccuauaaguuuuguaguuuaaccauugauauuuuaaucauguauuuuacaaugcuuuuuaaaugucuucuuuauuauagccuuaauaacaaucauguuaccauauuccauucaacauugauuuuaaggguaaagacccagaggagguagcugcuucugccugcuuccuacaccaucccucccccaacccaguggugugcugguaaacauuuaacaaccagaucuggaugaaagggcuaggggcccugaucuacaguauuaaccaauucacaugguacaaauacucccaccaaccagaugucucugaaggcaggguugggaagggauccacacaaccaguuuuuggggccguagagccagcucuggcauaccacagcugcaacucaugaaaugucuucagaacacacaauaauucaaguuguguaaccacagcucuuugucucucugccuguauuuccacuucuguucccacaaccaggug

SEQ ID NO: 16411 - RNA, 78744 nt, Homo sapiens
agagaaaauggcggcggcagcagcuucggcgccucagcagcucucggaugaggagcuuuucucucagcuccgccguuacggccugucucccggaccagugacggagagcacccgcccggucuaccucaagaagcugaagaagcuucgagaggaagagcagcaacagcaccggucagggggccgcggcaacaagacgcggaacaguaauaacaauaacacggcagccgccacggucgcagccgcgggaccagcggcggcggcggccgcggggauggggguccggccggucucgggcgaccucuccuacuuacggacuccugggggccugugccgaaucucggccucuggcccagagagccuccugggagggcccgggggcgccuccgccgcccccgcggcuggcagcaaagugcugcugggcuucagcucggacgagucggacguggaggccaguccccgggaccaggccggcggcggcgggaggaaagaccgggcuucgcuccaguaccgcgggcucaaagcgccgccggcgccccuggccgccagcgaggugacuaacagcaacucugcagagcgaaggaagccccacucgugguggggggccaggaggccggcgggccccgagcugcagaccccgccggggaaagauggagcaguggaggacgaggaaggggagggagaggacggugaggagagggacccggagaccgaggagccgcucugggcgagccggaccgugaauggcagccggcuuguccccuacagcugccgggaaaacuauucggacucagaggaagaggacgacgacgacguggccuccagcagacagguauuaaaggacgacucccuuucccggcaucggcccagacgaacccauaguaagccucuccccccgcugacugcuaaaucggccggcggcaggcuggagacuucaguucagggagggggaggacucgcgaugaaugacagggcggcggcugccgggagucuagacaggagccgaaaccucgaagaggcggcggccgcggagcagggaggagggugugaucaaguggacuccagccccguuccuagauaccguguuaacgcuaagaaacugaccccucuccugcccccgccacuuacugacauggacucaaccuuggauucgucaacaggcucccuucugaaaaccaauaaucauauuggcgguggggccuucaguguggacucccccaggauuuauucuaacagucucccucccagugcggcgguggccgccucuaguucacucaggaucaaucacgccaaucauacgggcuccaaucauaccuaccugaaaaacacauacaacaaaccgaagcuuuccgaacccgaagaggaacuucuccagcaauuuaaacgggaggagguguccccaacagggaguuucagugcccacuacuugucgauguuucucuuaacugcugccugcuuauuuuuccuaauacugggacugacuuaccuaggaaugagagggacaggaguaucugaggauggagaacucagcaguaaguauuaaauccuguggguaagguaacaaagagaauguuguuagugguccgcuuuagccgcgcuuagcguuuuacaugaagugacuuaccugcaagaauaugguuuaacagcaaaaacgcaacagugcgugcaugugucaucuuucuuaaagaacaccauuaucgaaaugaugucauauggcugguuuuaaaaguuuucugcaugauguauugugaaauucaaaacaauuuuuaaaagaauauuauaagcuuguuaguaaaacucauuuguauaugugacaauucucuuuuagcccugaaagacuauuugcgcagaugccaguuacuuaacaaauuugaaguauuaggauaaggcacauuauaaauguaguguuuuuccaaauugaguugugauucuaauaggcaauguaauagcucuugaaauucgaauuauuuuauaauauuaacuguaugcauaaauucggauuaaauauuuugugguauuaacuguauguauaauuucuuuauagugaaugaauauaaaaaagcagcaaggcacaccucuuaauuuauuucccagcccaaagcacuuucccuaucaucuguacaaaaaguagugguagggcagugcaggagcuugcagucagauuuccuuggauugguuuccagguccuacuauuuacuugcuaaaugacuguaggcagguguguucauugucauaaucaaaguaucucugcccuuaaacacaaaaagaagaugaauacagaccauuuuguguucucugaaggaaauaaagaugaguaauuggcguacacaacuuuauuuuuuuuccuuuuuuaaaaaaauuuaccagacuacacugacguagguguacacuacuuuagauugaacggaggagguacuauuugaggugagaccugaagcagaaggagacagccuuguggagaaacaguagaccauucugagcagagauuaaggccuugaguugagcaagagccuucuuguagguuagagugguuaagcaccuugagcaaaggggagagagucagaguuaaagcuucugaacuuuccuaaucuauaagaugaggccucuauugacuagaauguuugugaagauuaaaagagaaaguaaauuaggacaaaauggacuucugaauacauaauuucucaguguuaggucccucucugcauucucccugaaggcuuccuacucuuuucacccaagaugaauucacuguauuuuuauuuguauuuauaaaauuggcuuauuaguuuuauuucaaaauagagugaaagaugcaguuagccaacucagauaaagaguaggagucaaaauaauguaagcuuagauuuagauauagccaauuccgagacagucaaauaauagauuuuuacucuguugcuuaauuacagggguugaaacaagaaugaaauucagcucucacuuuaguuuauucccugggagcaugaguguauuguguccugccccaaauauuugggagaaaaaaaauaagggcacacuagaaguuaaacaaguaaaaguucacauaaauuaaaugacauuaccuaucagcaguagcuaucugcaucugugucucuaacaacuauaagaucuggccuuuuucuuuucuuuuuuuuuuuuuuuagacagagucuagcucugucgcuaggcuggagugcaguggcacaaucucuggucacugcaaccuccgccuccuggguucaagugauucuccugccucagccucccaaguagcugggacuacaugcgcgugccgccacaccuggcuaaauuuuuuuuguauuuuuaguagagacaggguuucaccauguuagcagaucuggccauuuucuaagagcuaauugcuuuacaccuauuguaccaucuaaucuucccagcaacucacagaagcagguggugguauccucauuuuuggaugaggaugauacuaaguuaagaaaugcacugaguguugaacaguuaguaguagggcuaagauuugguuucagauuuuauuuccaacuagaaagaccauuuuaacacuguuuugguuauuguuuguagagagcuuucuaaauaaguggguaccuuuauuaugauuaagaaaguaauugacuauuugguaggauuucauacagaauuauugauaagcacaauucucaguuaaggugacuuucacaucuuucucaucaguguuaagaugaaugacuaaugugguguacuaaaaguucagguagaauaggauaggaaugcuaggauuuugguacucuucaccuucacugauaaggaaggaaggaaauuauauuuacauuuuaguaaaugguaaaugugaaguaaucugggcguuggaaagaacaauggcuaagaaguagaggaucuagguucuaggacuugucugaaugacuguggucaagcuccuuaaucucugagccucauuuuuauauacuaaauggaaguaauaauaucugcugucucuggguuuguuugugagggucaggugagacaguguguuaaacauaaggugguauuauucagaaauuuggacaaaauuuguuguauuccugguaaacuacaguauaucuagagagauaaauaguuaagacauuucuauaaaugacauaguauagugcauuucuuaaccuaacauuugauuuuuaucccauuaaauauacauuauagaaauuaauacagaaauuugaaucaaaguauaaugaauccuuaaauguaugauacacuugauguauuguaugucuacccuguggaaagaagugccugcuaacuucaguuagucugcacaccuaacaguguuaggguaucaagagugaauaauauuuucacuccauauauauauacacacacauacauacacguauuccauauccuuuguuauauuaugaugcuuuaacuguagaguucauuggucaaauaguaugcuuagggaaauacguuuacuuugaguaauaguuuucaccagaagauuguagguuauaugugagaguaacuuuuaggaggcuuuuauuauuuaaauuacauauaacauauaguagauuagucuuuuaaauuguucuuaaucauauagucuuugaaacuuuuucaucaaugcccuauuuuuuuauuaauuaaauugcuauaagucucuucuuccucaucuauaaaacuaggggguuggauuagaugaucccuaagcucuuuccagcuccaagauuuaagauuuuaacuuugaacugccauaccaaaacaacucaaggaucaaccugcaaucagaguagucgcuuguuccacaggugauuagaucauuauagcccaccaaacgaaaauagagaagcagaauagauugacuguccuaggcucguaugaucauuauuaauuuuuuuuucaauuacaaaagacaugacuucugcagaaaguuugaauagagaugaaggaaacagugaaugguuauuguaugccucucuuccuagccucaugcugcccccauauaaauaaguucaaguauuagauccuuucugaccuuucuuaguauuuuucauguaaauacaucucuguguguguguguguauguguguguguacagauuuucauucaacagcagagugucuacuaugugcccgguauuauuuuaagcagcagggauauguggugaacaauauguugcauauguggaagaugaaaucucuguuacagagcuuacauuucuaggaggggaauggacaaguaaauaagaauuucacauaaugguaguugcuaacacaagguauugcugguaacuuuugggggcugaggugaagagauaugcaauauuacauaaagguaggcagaccucucugaggaaggauguuugaacugagauaugaaugacuugagggaacuagccuuugaucaggagaagagcauucuggcagaaguaucagcaagugcagaauuccugaggcaaaaacaggcuuguguguugaaggaccaaaaagaauggccaguguugcugggacauaaugaaugaaggggaaaauggcauaccaugaaguuaaagguagguaugggccagaucauaaagaccuaaacgccuugagggccguugaaaggagucagaauuuuaagugauauuauagcauacauauucugcaacuuguuuuuuguaucauggguaacuuuuccauauacuaauuuuaaguacagagguauaauuuuaaaaucucauuuuccacuagucccuuucucauccuauaaaaauacuaaaaucucuaccauucuaaaaauguugcucuucugugcucuuuucuucucuaguuguuacucuucucaaacuuucugccucuauuuucuucccugccauucacucaacccugucuaguuuagcuuucuuuaccagccauuccucugcuaccucucuucuucaagucaccaguuacucaauuuucaaauccucaucucuuugguacauuuagugcauugacaacucccuucuucaugaaacuuucuccuuucuaagcuucuguaucacuacucucuccuaguuuucauacuucugucugccuguuuuaaauauugguggucuccacaacuugaucuuuggcugucuccuuuugcacacauuucucuaggaaguuucauucacucuccuugucauuaucuuccaguuuuguauuuuuaccuuggauuucuccugagaucuagguauaccuauuuguuuacuagacaucuuuuggguauacuagaaguauguaccaauaccaucugacauuuucuuuauauuuaccuuguuuuugcuccuccucccuguuuaguuaauggugcuuccauccacccagacagagcucaagagagaaaccuuggauuuaccuagauucuuuccuuucccucaccuuccuacaaacccccaaccuaauuggauaccaaguccuguaguucuguuuccucuauaucuuuugaaucaaucuuuuucugucccucgccacuguucuagguuagucucuugccugaacucuuucaguaaccuaaaauggugucccugcuucuaggcuguagcucuuccaguccauuugucaguacagagcagcguuucuaaagcacaaaugugaucauucccucuugcuuaaaauuacacaauggcuuucucuuaguuauuggccaaaaucuaaacucguuggcuaaacuguucaugaucugacuaugcuugcccuuucuaccagucucccuuaucacacuuacuuucuagaaaacugaacuguuugcuguuuucugaguaagucaugaaauuugugcuuuucuaccuuugcacagguuauccccuuuuuugggaauguuucuuuauuuuguaacugugauucauucuuaaacaugucaucuccagauaucucugacucuccaucuuuuuacccuagaguuuggcccaucauuuugugcucaaauaagacauuaauugcauccuucauaguauuuaggacaaaguauuauauuuguguguccaccaugccaaauagaugacagcuccuuucuuuagaguaauauuucuauaggaguagaauacaguguuaaagaguacaaacuuuuuacucaguucugauuuuggcucuacuuuuuaaaguagacuauacuagagauauaauugccucauacuaaaaaugagauugauaauacuaucugaggaugacuuguauuaagugagauaaugcaucuaaacuaguguugucuggcacauggaaaucucuuaguagauggaagucacauuaguaucuucagcacagauucauuauucagcaaauaucuguugaauaaaugaucacauaucagguacucaggauauaugcacuguuaacugguaguaucuaacucgguaauugguuaucuacuuaguaucugguaaggauauauaaaagaaaucuuauuucuguagaagccuccacaccacuaauaacaguaauaggaaauggcuaagaaacauacaggauauuaugugguuacacacuuuuauaaaaggggagaauucacuguaaauucucaaaugaucagucuuacaugaucaaaaguucuaaauucaacauuuggauuuuauucuguagguugaguaauggcaauucauggagguuauaaagcagaggacaagcaugaucgaauugguccuuuaagaaggauaaacaggugaugguuuagacagugauaggguuggagggaaggaguagggugaugacaccugaaggagguggauaagugggaauggaguugggccuaugaaugaaauucauuugaagaaagacauaugguuuugaguauagagaauaagagacagauaggagucaaagauuauucuggccaugagccuggaugacugagagaaugauaauaucauuggaggaauuagagauguggaagagggaucuuguuuggggaaaaguggucuagggaaaaugaguuuacuuggggcuuauuauuugaguuguucaagugaaaaauucuuguaggcucuuguagauacagaauuggaguaaagaugagagacuggugcugaaugugaguacuaguacuguuuacuaagggaauacuuuuaaauguuuguuuuuuuaauguguuguuguuuucuuuaaaaucaagaccaguuguuacaaagaaguaacauguuuuaaugucauugucguuuaaaaaauauuuuuacuucuuaaaguagacuagccaaaaggucccgaacuugguaucuaaaaugaauauggggaauaaggauuuugaaaaauagcuguugcucucauucuuuuuuuuuuuuuuucaauaugagacagggucuugcugugucacccagguuggauugcaguggugugaucauggcuuacugcagccucaaccucccaggacucaagcaauccucacagcucagccuccugaguagcugggacuauagaucugcaucaccacaucuggcaaauuuuuuguauuuuuuguugagacaggaucucacuuuguuguccaggcuggucuugaacuccugggcucaagcgauccugucaccuucgccucccaaagugcugagauuacaggugucagccauagcagccggccuauucucucauucuugaagaaugaaagcuccauguuauguuugaaguuuuacgaguugacugcuuuguaagaaaaaaaaaaaaauccuagaucuaugagaauauucccgugaaugccagggauuugcauauaccaguuugaugauuucagaaauuaaagucuacucuaugaaaauguuuuucauuugaaaauuuucccuagaaugauuuaaauuaaaaauaaugaggaaaaacuugugaaucucuacagauauauccacggagacuaguuugaggauacacuggcauagcuaucagagaaccugggcuucaauauuggcccuuccacuuacuagcuuuuuuucacuaaggcaaguugcuuagccauuguaaaccucaauauccucauaugaaaaauagguuaaaugagaaugaaguaauguguguaaaguaaaacucauacauggcacauaguaauaauaauaacuaacccuuacguagcauuaacuguguuccaggcacugagcuaaacaauuauuauuuaauccuuaugagguagguacuuaucccauuuuauaaguaaauggagacacugagaaguaacucgcccagggucauguagcuaguaagugaagcggcaguauuugaacucagacaguggcucuuaacuguucuucuagauugccuuuuaauauguauaaauaaggacuugauauauguucucuacuauuauugucuuuauuuucagaaaacugugacaaguauagauucauaaaauccuagaaguggcaggaauaaucuaugaaaccuaacaacuuuaggaaaaguuguauucauucaacaauuaugaaucacauggaacuauuuauccuuaagguuuuagauuaauuaagggggagggggcaucugcuaugaagcaaacuauaauauauaauacauagaacaauaauacaauauuaaaacuauuucuaauuuuuaaaauauuugcagucucaaaacugguagggaaagugaucuuuugauuuguauuaccaauuacaacuuguucuuucuguuguucauuuuuaggauauaaagaacuuuucauacauuugaucucccuuuuuugcuccuuuugaauaaacuucauauuuucccuuuauacucauauauguuuuaauggaaaugaugcauuugauaauuucagggacacuaaaauaaucaugaaaaauuauuuucaugauuccuaagaguugggaaguucuuaaagcuugcuucuccuugcucauugauuauucaauauuaacuuucccuaucugaaaaauauguuauauaaauggaaauuuauagccucagugcaaagauaauuauauaguuuguaaguuguuuaaaagagaaggacaccuuaaacuguuggaacucuccaaaauguauuuguuaauaaauaaguacuacuaacuuguuugugaaaauuuuauuacuaaugauauaaucuaaauucgaaugaagauauauucuagggguggggagaauaucaggaaaaauagcuaaugcaugcugggcuuaauaccuaggugauggguugauaggugcagcaaacugccauggcacgcguuuaccuauguaacaaaccugcacauccugcacauguaucccagaacuuaaaauaacauuuuaaaaaagauguauuuuaaucuuguauugauuauacauuaaaaauugcugccauuuaauaugggaacauagcuuaauacuaauuguggaaauuguuauaacaguuauuugcuuauaacuuuggauuuugauuuucauauuuagauuuauuuuuaacauagauuuuauuuauuuuuuauuuuuuuggagacaggaucuuguucucucgcccaggcuggagugcaguggugcaauaucggcucacugcagccuccaucuccuagguucaagugauuuuccugccuccaccucccaaguaucugggauuacaggcacauggcaccacgcccggcuaauuuuuguauuuuuuaguagagaugagguuucaccauguuggccaggcuggucuuaaacuccugaccucagguaauccaccugccucggccucucaaagugcugggguuacaggugugcgccaccgugcccugcccuaacauagauuuuaaagugaaccaguaacaguauaguugagcaguaaccuuuggauuucacuguuuuaauaaucuaugcuuuaaacugcaucaguuuauauauuauauauuauauauauaguuaauaauauucuuuauuaacaauauugccaaaauuuuuuuaaacaagaguuuaccaggaagaaaauaaguuagguuuuaauaauuuauuuugcauguuuaauaucauuauuuaaaaaauauauuucuuaggaaauuagcucuucaaaaagguuauaaaaguuauaguaacagagguaaucucuaaaaauagaauaaugcaucuaucauauggaagccaucaugaauuacuuuucauaugucuucauuuucuuuuaugucaagguauaguuuaaaauuauaccacugaauuuuuccugggugcuagauuuauugcucugugcuuuugcacagcuuuuuacuuaaaaugcuuuugcaagaugacuucugaauucaucuuuacagcuauguuacuaucaaauggcaagcuaaaguuuaaaaacaaggcuugguuguaaaacuaugcaagaguguaguucagcucuccugaacuaauuggguaguaaguaugcaccaauugcuguucugcccugaauaugacaugaauagaaaaaacccuuuaguagcaaauggauauuuuagcacauagcagaaaauuaauuuuguuucucaguuagcucauauauaucugaguauguacacaaacacacacacacacacacacaauuuucugacuauggcuaauuccugaaagcaugcuguacuuacaaaggaugcuuuugcucuguaggaauucaccaagguaaaauuuucaaagcauaugaagaggauuguugaaauuaauuaggaggugaggggaaucuugggauaucuacuucuucuagccucugagcuauggcuuggaaccuuggucagccuuauuaaggacuuccuuaguuuauaaguguaucucccaugggaucacaaaugcuuucuuguuugauuuaguucauuugaagaaacauuaaguuucuccuacucauuuauucauucagucacgcauucacccagauuauuuauugagcaccuauacuauguaccagguaauggcagaagauaaguauauaucauaccuuuuagaacuauaggagugacacucuccccacgcuuuggcuggcauucucuucuuuuuccuaaauauuucugcacuagcuagccuucagaauugggauuuuguuaccaugcaacaguguaucagauuuauauauugugacuugggaaacauacuuuaaaaauuaguuucuguaaauuugaguauaccaucugguaaagcuuaucacaguguauauauacacaaaagaaauaguuggcuaauugaaguaauguguguugaucauuccuuucaccuuuucuguauuaccauuuucucaauugggaauucuaccuuuaaaaaccacacaauuuuaauaaauguagguuuuauuuuuugcagguuuuuaggaguaauuuuuaaaaaaggaagagacaugaagaaugaauuugccaaaaaugaaaauguuauaaaaucugaacauuuaugauuaugguucaagauguucuagaaauauucuuauccuuuugacagaaguguuuuguuuuuuuuuuuuaauuucaucucuaaaugucccgucuuucagauuuuaaagccuuaggugagaagagcaaacauuuauugagaauuuucaaugugugugagcauuuuauuuuaauuuucaugaggguaacuacucauacuaugucugugagaaaacggaaagauagagggaauaagguuacaagugauuuguccaaggucccacagcuacuagguguuggagccagcauuugaacccaagaucuaacuuuagaguucacaguauuaacuaccaggcagcaguagaauuuuuuuauacuuuaucuuaucguuagcuacaggcuuuauuugggcaagcaagauaaacacaaccucugggccuugcuuuuugugucuguuaaaugaggguauaguaaaaucaacuuuacuuccagccagugauuuuuguagggaacugcugugauaaugucuguagaaaugcuuuggagaaauuuggagugauauauaacuguaauuuuaauauuauaagauaggacuuaacagcuauaguaguuuaagcaacacauguucagcauuaugacauguccugucaguaauguuaauaaguaauagaguuggcuaaauuuauaguccuuaucaguauuuaaaccuuucaagcugucugagcagauaaaagggaguuaucuuuucacguuacauaauuagugccuuccuuaucuccaggacugaaaaauaaugugguuuuuuuuugcagcuauauuaaacaggugaugacacaacuugaaacuggauuguagccuugcugaucacuaaaagguagauuugcugauaggaaagucaguguaaauggguuacauugcuuuaauccaaaauguaguacugaauuugagacggaaaaacauuuuuuaagaaugaggaugggucuuggaguaagcuucuguuaauacugugugaagaacagacaaugcauacaguugauacagaaagguggcuugucacaugccguucuucagcuaguuuguaagauaccaugaguacuguuauuaucaaagugggaagaugacauguguccccaugaauaggcaauaggugaauauuaauaguacuuaaauuagaagguauuuaaaguacauuaggaucuucagucucuuagauaagucauacgaagcacauaaugaaauuuccaucccauuuugcauuugaaacuguuaccagugaugguuuagaccagaaccguccaguagaaauauaagccacacaguagccacguuaaaacauaaaaaaguugagauuaauuuuaauaauugauuuuauuuaaucugguauaccuagaauauuauuuugacauauaaucaauauaaaaguuuuugaugagauagauauuuuaugcucuuuuuugaauuaaggcuuuagaauccgauauguauuuugcauucaugguguaucucaauucagacuagccauauuucaagugcucaguagccacauuuggcuaguugacuacccuguuggguagugcaagucuggaccgcucugaguuauggaguuauauuauugguuuaaugagaccuaaugacagucaagcauuacaaugccuguaaugugccauguauaguguucucuauaauauuuucagaagaucuuuguaauaacucuaugaugucaguuuuguuaucauuuuagacauagacagugagguauggagauauuaauuugucuaagauuaaacagguagucuguagaggagcaggauuuaaagcuaaaucugacccuaaaaccgcuguccuguuuuuuguuucuguugcacuguuuuaaagcacugccacuagcguuugggcagguaggugggugagguguaguuuuggcacugcucagccagugacuugugauuuaauuuuuccuuauuuuuaggcacaaaggacuucuuagcuuagaguggaagugguaucuucuaaguccuugcucauauuccugauugggaauguuccuuuauacuuguuccucauuucccauucauuaaacugcuuucuacaauucuuuaaacauguagaauggagagauggcucuuugagucuguuacaggaccguggcggcagauaagggaaagcucagcuccuauuggcaaaagugaaaacuaaugucuaguaaaacuuuugucuggaugaagaaguuuucuaaggguuucaguacuucauucugagaaagaauugagaaguucuuauucaucaugcucuuugaauuguaaauauuuuuucaguuauuuuacaggauuuuauauuguggauuaauacuuagcagcauguucuauuuaauuugaauaauuucuuugaauuacauuuggauuccuagagaauauuuucucacaaacuuuuucauuucaaaaggaaaaacaggcagucccuaauuuuugaauacguugucuuccagauuguguguaaaacaguuguuugaacuuggagcauguuuuacuacacugguuuuaaguuccugggcuagcccacagaagccuauuuaaaaccacauccuauuuuagcacuaauauacuguugguuuaaguuuagggaaucagagcauuggaucguguucugugggaguuggaggagaaaguaaguuuauuuuuggcuuuuaguguuuucucuuauacuuuuucaucucuuuaauuucuguuuuccaacuuauacuggccuaagcuuucugcucuuuuacuauaaucuuggcucaauaacuuuaaaagauucaauaacuucuaagugcucaauaacuucaaaauuuucuguauggaauagguuuacuuguugagugcuuggcaaauaaacguuuuaugcucauucguaucucauuuaguuuuaagaguuuuaugagguaggggcuaguuuuccaucauuaaugaggaaucugaggauuagguuaaucacuuuguccaaguuuauagggcagggagaggaguuauggaguuaacguuguuggguaaaaaccuuagcaacaugacuugaaagcucauccacuaaccauuggacauacuguuuuccuuuuucacauauccucuucuccuuucucucuuuacuaaguuccaacucccccuauucccucaauucagauacuuuuuuuuucuuuuugaaagagaugugucuugcucuguugcccaggcuagccucaaguaauuacucgggccuugggcucaaguaauccucccaccucaguuuccugagcagcuggucuacaggcacacaccaccaagucuggcagucaucuacuuuaaacuaaauguuaggguaagccauuugauugaaugaauucauaauauaauguuguagagcucuguucauaaaaauuguaugauuuuaugauaaaauuugguaaugugauuaucuuuagugaggauugagccaauauggaaucagaguuuagcccugccucucuaaauuguucuuuauccuuaaauguguaguagcuggauugccuacaauucuacaauuuucuguuagaauuuauggcaguaguuuucaacuguggacugagaacauuuugggaacugugcccauuauaaaguuugucugaagaccuaauaaauaauuugccuuucauacugugcuauuauuuuucaaugguauuucaauacugcugugauuaaaauauaaaauauuauaugcaugguagaauuuggucauauuuucuuaauauaaguggauaucaaaaguacuguuauggggaaucugaauaucuugauauaaaugaaguccuuuugcuuuaagaguggagaaucauuacuuaaagaauguuacaaggaaauuauauauaaauuuuauauauaauauauauagcauuuauuuucaagacauucauacuuaaugucacagaaucaguuguaguguugaaaugacugacugacuuaccagcugguaaccccuuaaucucagaggugauuguacaagaucuugauuaacucagauucuauuaauaucuuugauugguaaaacauuuuuggcaguaagugaaaaauucaggcauuauaaaagacuuggggagccuugccuuggaguuuucuaucucucuaagaacugucauuuuaucccaguagcucuaugguagagacagaugaagguuggaguagcaguauauuguguuauuuuauaaacgugcuauuuuuuauuucaugcugagauugggaaaagauaacuuauuaaucuaucuaagauauauuagguuaucucucuccaugcugcugggcauaguuacaaaacauccuauuuuacaaugaggaacuagagucccacagaggguaacuugccugagauucuaagucauaaacuuuggagcuaguauuucuugccucaagagauuuuuuuuuucuuuuacauuuugcccguugcuuuuuauugugaagagauacuuauucaucuaaaugauauaacuugcggagcaagcauuacuuaaaacaaaauuuguauuuuacuuaaauuuuaacaacuuaaauucuuuaauuuuuaaaaaauuguacaagguugaacuuaauacaaaauagcuauaaauuauauuaaugccaucuuauccaagaaugaaaaaggauaaaaauauuacucauuuacuuugaaaauauucaguaccuuuuaaaaaauucuaauauuuggguuaggaaaugagaaacuaggaugauuuaggagagucuuuuccugaguuuuguuuugggcagaauaucaguccaaaugcauuuaaaaaaauaggaguauacuaugcugcaagguugguuuagauugcuuuuuuuuuuuuuuuuuuucgacaccuguuuucuuuaaaauuccuuuuggcuaauaaauuauuuaaggguuaaaauaauaaaagacacugguauuacaucaguaaguguguagugaugaagaaccauaguacaaacacaggaguuaaguaaguaaaaauauauaagcauaguguauggguuuugauguuuaaaaugcaagauuaaauaggcuauaguaguauguugggaaauuuggggaaaaaaacaacuuaaaguggcaagucaaaauucugcuaagaccauaugcuagcuagaacagacaugauaugaauauaaauaaguuacuuaugcuuuaauuugcaaggacuuuuacauauguucuuacacaaucagcuuuaccaauuuauuacaggguuguugccauacuuuuauuuuuccuaauccuuguucugcaggaagggaggauacacugaaugaauaaaagcagauaaacuuaaaaucaaugguuuugccauauaagaucaucuuaggauuuaaaaggguuuuagaagccauuagcuacuuuaggcaauauuagcuacuuuagcuacuucagggguuugagggagauaauguuuuaguugggcucuuuugguuauaaggauaguuuuaagaaagugaguguuuacuaugaggauauguguagacuucaacuguagagacuuuaacaauucaauucaagggauuccaggucugugcuugugugugugccucugucucucaguacugugcuaaguuuuucuuggguuguuucacuuaauucuuaaaauugaggccuagggagguuaagaaacucauccaaagucaguaaguggcagaaccagauuugagugcagauaaucugacucccacuaugggaucuuugucccuguacuguacuaucugcacaauuuuguauuucauguauuuguuuuuuaaauuuccuuuggaauuauucccacuuccccccuuuaaaaaaaaaaaucucacauucuacuagacuaggaguucuuaaacagugguccaucaaucuuaaggaagagauaaauggacuccagguaagcaguagcuccuugaaauuauauguacauuuuugaauauguaugcauuuuugcagggugaggguucauaaauuuuauuaaauucucaaaaggaucucuguccuucaaaguaguaagagucacuguacuaucagcagcucuagggaagguucugaguucuuaucuuuguauucccuagcaccugguuuuugguuacucaauaaauauuuguugaacagaccuuaacaaauagagaugguauguaggaaaauaaguuugaauuuaguccuaaucuggaauuugaagaugcuuucacuguuuauuuaaaaugguguuaaggaucaaucuuacugacuugguccagaaaacuguuuucuggcagauucaaauuuuaugaaucaaguuuuuugaaguuagguuuuugaaaucagagaauaaagcaaaauucagcauuuagagucuacaguagggugucuaaaaaaggccaguuuuuuuucccccuccaguauaguauaaagacucuuuuaauauuggauaaaggauuagggaacauuauacauuuuaaacauuaaaaucauacugcaggguugaaguacacuauauaagcuacauggaaacugagagcagcugaaggcggggagagauagccuaguaaacuuuaggcagaauaaauuaaacaguuuauuugagcaaaggaugauuuaugaauugggcaauacuuagaaccggaagggauccagagaacuccucuccaaagcagugaugggcagugagcuuuuauaggcugaauguggaaguaagacaaaacauaaguggaaaggcccuaguuagaaguuaguuggugguuucugauuggguaugcuuaaguuuuguuuuacuguuuacacgggauuggguuuugguuugcuuacagaggaguucuguucacagagaaaaucuucaggcuaauggcuuccuccuuacuugcuuuaacaauuuucuccuuuugucagccucuccaucuugagugcuugacuaaaacuuugagcauuguugacacuuucugucaccauuauagugacuuacuuggucucaguauggaauacaaaagucaugaugucaggcucauggaagaaguauuccuuucuuguucaucuuauuuuuguugcucuaauugcagugagaccauuuggcauauugcugauggcugcaaacauucauuuaagacacuagaaagaauacagugcaccagggagaugacaaugggcacuaucaggaggauaauaguaguucuuucuuacccacaggcaguauguuucaagacucccauuacuccugcaguggaugccugaaaauggauacuaucaaacccuauauauacuauguuuuuccuguaauacauacuuaugauaaaguuuaauuuauaaauuaggcacaguuaagagauuaaaacaauaacccaaugauagaauuguagcaauauacuaauaaaaguuaugcgaauauggucucucucaaaauaucuuauuuacuguacucaucuauuuuugguccaugguugaccagggguaacugaaacugcagaaagugaaacugccauaaggagggaggagggacuacugucaucaaaggacugguguaugcucuuuagccaaggccuccaugaacagaaccaaguaaaauaaaaagguugauggcuagaacaaaccauaaacucacucucuguguccggagggcaguuggucaagguuucuagauuugagcucaaagcauauuucccugguuugcaguuugaauguuucugguuauggcaaugggcauuuuggugaacucccugaguggcccauucaucagcagggaugaguguugcccaguacccgccuguagggcgucagaaaccaagcaguuuauagauacaaugucaaggacaaugaacaggacuagaaucugauaugcacaagggugcccuguaguuuucuacugaaacauaauuuuucucucuacagcugcucccauuucuaucaaagauaaucacaauaagacuaauuuguuugcaaaauaggucuagucucauuaaacuuggcuugauaguucacauacgugcagcgagaguagugauggaccauauaggcucucuuuaaaucugcuuugcuggaauuuuuaaaggcaucucagauuagacuuuuaaaagccucucuaggcuaugaagccaugcugaagacuuaccaguagacuuugcccguaauaccuauagauuuggaugaauuccucucuucucaagguccucaaaauauuuuuaaaguuacugggccugccuuacucaacucuuaaggccaggaaacccuuaaagccucguaccacacuaguuuuuuccaaggggcuuucauggcuucauaaaguaaaccuuaguucuuuaaaacuggccauauccagcucuauguacauuuucaaauaugacuuuccggucaaaagccuugguauuauaaccaguguuuccaguuauaacuuguuacaaagagaacagauuuuuauugaacuuaugcaaguaacuuacugcaaaccaaaaauaaaauucgaaggcccccugcaaccaucugaauggacuuccuccuuggcuagggcacccuaacauuuaaccugaaagacugcuucaggccaugaugggaaguggggguugaacaugccucauuuauguugggguuggacacgucucauuuauaccucucuaguauuaaugucaacacagacccuaggucugauaggaaacauauacagucuauucucucuaaagcuugcuacuuggaggcuucaucugcaugauaaaaaccuaggucucugcaaccccuuccuuucuauacaucauaacucuuucaaccaauugccaaucagaauauguuuaaaccuaccuaugaccuggaagccccugcuuugaguuuuccccaucuuccagaucgaaccaguguaaaucuuacauguuucgauugauguauuaugucucccuaaaauguauaaaagcaagcuguaccccaaacaccauaggcacauguugacaggaccuccugaggcugugucauggguggguccuuaaccuuggcgaaauaaacuuucaaaauugauugagacuugucucaguuacuuuuuggucuacauuguauugccauaaaaauagaaauacuugguuacgguuucugaauucuggagggaucagauaguugagaaaagguguuucaucuucauucacaaagguauaguuuaccaaauuguugaaaguuguagagauagcuuaagagaaaagaaaaaaguuuccuuaaaucugcaaagcacaacauugcagaaucagcaguguuuuaaacaaaaaggccauaaaaauaaccuauaauuuuucuucaucagucguucagucucauguaauuccuguucugcuugaugucaguuuaacaauuuuaugaaccaguuucuuuaauaguguuguggaaacucuuagccagagcaaugguauaaucuuaaaguuauaagaaaccuguacuuguucagagucucuuccaugaaucuccuugaagacgaaacacuuuaggauuauaguugcuugcaaaagcuuucaggaaagcaucagaguaaaaauuaucucuggaugacaggacuuaaaauggcuaugauaagaauuuauuaugcaaucgacaaggaaauuuuauuuuuugugacaucaguauuuuaacauaaaaaucaaaauuaugacugguaacaucauaacaggacauaucagauuuguaggaauuucauaccauuucuagaacacucaguaacauacccaggcaaauauaacucaaggaaaguuaaacaucauugcuuauuugacagugcuuaccguguaaauuuaacauacugaauaagguaguuuaacaucucucuuuuuaugaggagagagaacagauucuuuugagauauucuaggaauccccuggaaacuaccgaaguuaguucaaggugagaaagaccuaauggaggcugggcaugguggcucauaccuguaaucccagcauuuugggaggccaaggcaggcagauguuugcugaggcaggaagcagccugaccaacauggugaaacccugucucuacuaaauuaaaaaauuagcuggacgugguggugcaugccuguggucccgguuacucagaaggcugaggcaggaaaaucgcucgaaccugggagauggagguuguagugaaccgaaaucgcaccauugcauucaagccugggcaacagagccagacuccgucucaaaaaaaaaaaaaaaaaaaaaaagacggaauaauggaauagaauuuugggaaaguuugucaaaaauaucagagguuuaaaaauacuugauuaaaguagaucacagaucacuugaaguaauaccuacugauuuaaccagagugguaauuuagagacaaauauagaaaguuacacaguugcuuaaaaaaaaaaaaaagcaccuuagcucuuuuaauaugaagaauucgguuuucuuaagcaaagaccuaauaaagcaagaacagaccaauacuucaagaaaaguuuguuaccacuguacuuuugauauuaagggucaucauuuuuaaaguaacuuuuaaauauaaaauucauucacguccuagccaccuugaccauacauaaaauuccuuuuucacgguugcuuuucuacaugucuacaguuuucucauaugcauucauaugaaugcccuauagggcacggguuuuguccuauaccuguauagguuuugccuguguggguauagguuuugcccuauacccgucuuccuucccauugugcacaaccagucauucuucuuuaggauggaaguuacuuuuucccuuaacaaaaacacaucuuuuauaccuuaauagcuuuuuuuuuaaccaaaaacaugucuuacuuuccuccauacagaguuguuuaccuuauuauuucuaguuuuaauuaccauauaguaauuggaauuuguaaauuuaauuuuuagaagcaugugcuucuucaugguacaguuuuucagugggacacaggacaugauuacuaacagaccugaauaucuuucguucugaaauaagccaaaaguggauaacuuaaguugagcacuuaauguuucaguauuuuaucuauguggaaaugaucuagauauucaaugaauaucugucauuuaauuuaacuuagcaaaacuccaauaguguaaguuaacagauuuuggaaacugguuuuaaguagauguauuauaacauaaaacaaagcuagccauuaucaaguuauuuccuuguuagcuauuuuuacagcaugugcauguuagguagucaucgugaaagcaagaaucuuaaguuaaauacauguuuuuuuuguuuguuuguuuuacugcugugcuguauaauacaugaugcuguuagcagcggaacguaucagagacacggcaccaaaguauguuacugucggcgaauucauacggcucugcagcaaccucaguucuugccuucucagcagaaagaauucgacugagaggcauaaggcagaaggagagauugaggcaaguuuuaaagcaggagugaaagcuuuaaagcaggaaugaaaggaaguaaaguauacuuggaagagggccaagugggugacuugagagauuaagugugcgguuugaccuuuugacuugggguuuuauaugguggcaugcuucuggggucuugcaucccuuuucccaugauucuucccuuggggugggcuguuuguaugugcaguggccugcuagcacuuggaaggggccagccuaugcaguguguuuacuggaguuguaugcaugcucuuuugagguguuuuucccuuaccacucacaugucccuggaaggucauauaucaguuaaaauccuccauguugcuucuuaaugcauaugcuggagcccacucgcccgacuccugacaucuuauuggaaagcugcugaucaccaauuucagguguuucuguuuacugggagacugcggaucccuggcucuggcugcaaccaauuauuagagagacaguuaacaacugccuggccaucuccugauggucgccuaacauaacuggcuguguguguguguguguguguguguguguguguguguguguguugggggagggggccucuccugcccugcuuauaccugacuagcuaccuacuguaacaaggcacuuggaaacuggacguugcacuuucacuugcacauuuguucuuagguugaacccauaguucuauaaucuuaaacaucuaguaaagauaacaaacuuauuugacuaguaaaagcagguaaaauaaaauguuaugcucguauuauacuuaaagcugguaacucagaagacacagcuguuuguauuaaaccaacaauauugagcuagucuuauuuacccaagauuuacccaaguuaugugaacuuuaaaaacauuuuggguuaguuccauugucuuuaagaguuuaaguaauacagucuuccuucugucaagguuccaugacccccuguggaaaccaaaaucugaagaugcucaaguuccacaguuggccuuguacauacaaaaaguuagcccacuguauucuuguaaccauccaguggguucauuuugccuguugcccagauagagcugauuuaucaagagaggggaauugccauagagaaagauuuuaauucauggagagccagcugaaugggagacuggaguuuuauuacuucucguauccaccucccugaaaauuuggaggcuaggguuuuucaaggauaguuugguggacaagggaaugggugcugcuaauugguuguggaugcaaucauagcgguguggaaauggucccugugugcugagucugcuucuagguaggggcuacaaggaccuguugagucaagggucgugggucuggauggggcuguuggugguccgaaacauaaaagcuugaaaagacguaucaaaaggcuagucuuaggcucuacaauacugauguaggaguaauuggggagauuguaaaucuugugaucgccaggauaaugucugguaauugauaucuauaccuuagcagaauuugggcuccucucaucuuccuaauuuuguggucuuucauuaguuuuacauaggcaguuuaguuuuggggaaugguuaguauuuaaacuauuaucuuaauuauacuuuagauuauaauuuauaaauuauaauuuagauuauaauuuauaaauuauaauuuagauuauaauuuauaaaauuaaaauaaaauaauuauuaaauuauuauaaucuaaauuauugaauuguaaucuaaauuucucccaaaguuagcuuggcccaagccccaggaaugacuaaguagacauuuuggagguugaaggcaagaugggaguugguuagaucagaucccuuucaaugucauaauuuucuuacuguuauaguuuuugcaaaggugguuucauucuuggguucugcaaccugcaaauacuguauuuuugacccaugguugguugaaucugcagaugcagaaccugugguuauggugggccagcuauacuuaauuuacauaagcacuuacuuuucuuuaagccgauuaaauggagcucuuuuauaaauugucuuuggcaauaccauccggaugucgaaaaauaucacaaaaauguaacacauguacguaaauauauaggcagauauaaacaucauauagcucucauucuaaaauuuuagucgugugccaggucuaaauacaaaacucacuuguuuauuaaaaaaaaaaauagcuagauucaaguuguguaucuggccagauggcuacgcuucuuauugauguuuaugaaaaagacugaagauuuuuuauuugccaauuuccaaauaguuguaccccuguuuuccucuucugaugagucaucuucccuaaauuugcaugucuaaagggauugcucuuagguuagacuagguagagcauuuauaucucaaaggcacagagcuaaggcuucaggcuucaauacugucauuuacugaaacaaggaaagacgaguguagguaaagccccaguuacaacaagauggccaggaaaagcuucuuaaaugcuuggguaaagcuaguuauauagguuuaagucauugccuucuccauucuaagaauuccuagugauucaguccuucucucucuggugcagagagagagacaaaugauuucuuuuauagauguaaauuucccuuacaaaacagucuaaaaauaacugguuaaaaauaguccuuaugccaguagggcagauuuuggagacuaauuuggcuagaaggaucaagaaguccuggaucuuguccuccaaugagaauucugaauuccucagcaaauuucuggggguuuuccuuugggacagagaaaauuuugcuugaucugagcucaagauuuugaccaaggcauaaaggugguuaaagauacagaccugguugaugugugggccuaacuuuauaaagcauuugucuagcuuuucaucuuuggguugggaagauaacugagcuaaaagcuuaguagauaaagaauaggcagaggaugggguggggugguggggucagaguuaagucagucaacauguaauuaaaaaaaaaaucaacugcuuaagcuuuucauuugccuuuuguagggagucuuugagaggcaauuuuugagucuuuuaggagcuucuucugcacaccaaaaaaaaccccaaacagaacucuuguuucugagguauuuuggauccuguuuuucuaaugugccuugcaaaugaaauuuuaucacuguggccccuguaacucuugaguuaccuuugguaagguucacucauuucucuaaaaaaaucacagguucugagcccuuaguucuuaaacauaaaauuggcugacguuccagaugguuggaguucuagaguccuugucugcagaugaacccaugauucacagccuucucaaacuuaccuaacuuaccuuauauaagacuauauugggccuccugcuagacccaauauagucucugucaugacuuacaggcccaguguggaucggaaaugcucauagucaagagaauucaaaacaaguaguuaagcuuguaccugagagggaccuaccaauggugaccuccaaaugcgcagcaaaaagugaugaacucaaggggcucagugggggcacuuaugccuguuacucauugcuccuguggguuaucauuggugggaucuccuucagacccucauuucuaacacuagaacuauuaaaagaaaaacuuuagacaaaagaaauuuagcagaguuuauuuaagcaaagaaugauuuaugaauugggcagcacucagaaccagaagagguugagagaguucugcucugaagcaugugggcaguguacuuuuauagccugaacacagaaguaagaugaagaaaauauauuugguuagaguggcaagauccuagcuagagguuaguugaugguuucugagugguugagguuaaguuucauuauccuguuuacauugaauuggguuuugauuugcuuaacguaggagcuccauuuuacagagcucaggcuaauggcuucuaucugauuuguuuuaauaguagucauauuucccaucucaagguguggcugaagcacauguuuauugucuguaauagccaaguagaaugguugugggaaauuguagguaucauuguuuuagcauucacucacacauauucguguauauucucucacuccacuacaaguagaaguuguagaaguuagaguagauguuaagugagaaucugauaugacuacaguauaugcugaacauucuguccauuguguucauggggaagcaugguuuuuacucucaagguuccauauauuauaauaaauaaaaaugucuuuagccuacuuuaccacauaauguaacuacuuaaauuguuauuuuaccaaguaguuuuguuuuugacuugaugacauacuuaagugucucuguuuccugaaugacuuuucaucugugucuguuuucuuccagagguaaaaccaaacauauauaucaguuuuaagcacauuucucauaaagucaaugacgggaacuucuuuaaauucaguuuauauguuuguucuggucauucuuccaccucuauauguugucuguauguauaaugcccuuuuccuuuuuuaucagaccucugcucuuuauucccauucagugaauggaggggaaacuacuacuauuuaagucuuacucauuuuauuucucugugcguuugcucucuccaguuuucuuauuugcauacuguuuuuaugccacucaaaacuaaaacuggagauaaucauugaagauguuaaauacauauauuguaauuuugaauguuacaaaguagaagaccuauuguauuuaauuguaugugaaauuuauauuuauugcauugcacaucuccaaaugaugugcacauuugugcacaucacaaaucccuuuuggaucuccaaauucuuguuuagcacuauuccuucagaauugacuuuguuauaauaaaguuuuacuuguaucuuuuaguguaaauuuagaggaacuguuauagucuccaguguguaacaguuaauguuuaaaauuucuuccuacagugagcugucaccauguuuaauaaauuauaguauucauuagcauaaauuacuuugggugccaaguuagcuauugcacagaugcuuuguauuauuuauagauuuguaucuaaccuuuacaaguugacuugcuuuuguuuuucuguucacuugucaccaugcaguaggcaguagcauaauuauuuaaguaauaaaaauuacaaaaauaauuuucaggaagagaucuguugaaacuucuaagaguuagguugcucaaacuuuucuaccuugagcaauauaguaagauaaagcucccauauuuuaaguagacauauugcguugucuuuauuugaaucugauccuuguauauuagugccucgguauccgugggggauuuauuccagaacccccacagauacuaaaauccacagaugcucaagucccucauauaaaauuguguagaauuugcauauaacccaugcacaucuuccuguauaauuuaaaucaucuuuagauuacuuauaauaccuaauaugauguuaaugcuauguaagugguuguuauacuguauuguuuuuaaaauuuguauuauuuuguauuguuauauuguuagcauuuguuuuguuuuuuuccucccacguaucuuugaucugaaguugguugaguucuugaaugcagaacacacggauacagagggcuaucaccacuaccuuucuucccaacauugugguaaacuacaggggugucuuuagcugacaaauuagauagaggcagcaccuuaauuguuucccucuggaguuuugagcugccgggacuuacuuuugucuuugugggacgggugaagcaggcaauucauuauuaacuuuauaguuuaucuuagaguaaauuguugauauuuacuuaacaucuaagagucuucucuuagauuaaacuuuuuuugaaugaggacuucaguuuuaguuacugaucagauucaggaagaauaauucuaucaaacauucuuuuuugaguuguggaugcucuauaaagauaucggaauucaucuuuggaaggaacagacugucauuaaagucuuaaaugucuauuuugguauuuucuggauuugcuaaugaucuaacuuucuaauuuaguaauauuuuauuuagauaaaugaaaccaugcuuaugaaaucauugacagaugaaucaccuccaacucaauagguuaagcauuuuagaaaauuuaugaauauuuucagacacauauuuuaaaaauuucuagacacaagaucuuauauuuuagcuauuuuucgauaugcuauguuucugacaauuuuaggaaaaauaaaaucuuauuucuaauguaaauuauaugaauuucuaaaaauaaggcuauauuaaacaucauucuaaaaccaaaaaaaaauuguuacauuacaaugaaucuucuaggucuuugcaaaagagagggaacuuuucuuuuucaguuuucaauuuauaaagaguuuagauugaauuaugaauaaagcugcuguaaacauccaugugcaaguuuuuuuuauggacauaaaguugucaccuccuuugaguaaauaccaaagagcaugauuaauggaucaugugggaagauuauguuuaguuuuguaagaagccaccaaacugucuuccaaaguuggcuguaccauuuugcauuccuaccaguaaugaaugagaguucugaggcaggagaauagcgucuggaggcagggaaccuaaggcugauugacgcugacuuccuagaacugaaucaaaaggaaaaccccaacuuuccaugcccagguaacaagggaacagagggguugggggugcaaccccugcacccccaaccccucugccaccuucugcauugcagaugagaaauggaaaguaccuuugauugguccgcuccugcaacugaucagacuggucaccggccuagucuucauuugcauaaagauguaacuuugugacuuaagccucugauuggucacuuuccaccaucaaucagacugguugugacccacuacuucauuuacauaggguguaaccagguaaccagugggaaaccuuuaguggguauuuacaccccagaaaauucuguaaccagugcucuugagccacuugcucgagccugcucccauucuguugaguguacuucugguucaauaaaucugugcuuucguugcuucauucuuuuguugcuuuguguguuuuguccaauucuuuguucaaaacaccaagaaccaggaugacucauagucaagaccuuccaccaguaauaguucuacauccucacugcauucgugaugucaguguucugguuuuuagccauucugauagguauguaaugguaucucauuauuuuaauuugcauuucccugauaacguaugauguggaucaucuuuucuguauacuuucuuuggugagaugucuguuaaguucuuuggcccauuuuuuaauaggauuuguuuucuugaauuuuuuucaucuauuuugaauagcaguacuuuaucagauaugucuugcaaauauuuccugacagucuauggcuucucuuuuuauucucuuaacagugucuuuuauggagcagaaauuuuuuaaugugaaugucagcuuaucacuucuuucauggauuauguguuugcuguuguaucuaaaaagucauugccaaacccugggucaucuagauucucuuuuaucuucuaggaguuuuauaguuuuguguuugauauguaggugugugauccauuuugacuuaaguuuugggacggguauaaaaucugugccuagauuaauuuuuuugcaugugaguauccagguguuucagaauuauuuguugaaaaaacuaucuuugcuccauuauauugccuuuguuccuuuaucaaagaucaguugacuguauuuauaugggucuauuucugggcucucuguucuguuucacugaucuuuuugucuguucuuuuaccaauaccacacugucuagauuauuguaacuuuagauaagucuugaagucagacacugucagucucccaccuuuguucuucaauauuguguugguuauucugggucuauugccuuuccauauaaauaaaccuuagaaucaguuuaacaguaucccgaaaauaaucugcugggauuuugauugguauugcauugaaucuauagaucaaguugagaagaacugacaucuagaaaauauugagcuuucuuauccauggacaugaacuaucuuucaguuuaauuaguucuuuuugauaucuuugaucagaguuuuguaguuuugcucauguagauuuuguacauguuuuguuagauuuaccuauuucauuuugggaggaugcuaauguaaaugguauuguguuuuaaauuuuaaauuccacuuguuccuuacuggcauauagcaaaguaguugacuuuugucuauuaaccuugcaucuugcaaccuugcuuauuaguuccaggaguuuuuuuugaucaguucuuuuggauuuucuacauauauugucauauuaucugugaacaaaguuuuauuucuucuuucaaccucuguacuuuuucuuucucuucuuauugcauuagcuaggacuugcaguaugauguugcagugcaguggugagagaagacaagacauccuugcuucauuguucaucuuaaugggaaugcuuugaguuucucaccauuaagcauguguaaacuguagguguuucuauuuuuguuuuguauucuuuauuaaguugaggaaauucccuuguauuccuaguuuauuuuacugagaguuuuuuuugaugcguggguauugaacuuuuuuuuuuuuuuuuugagauggaauuuuguucuuguugcccaggcuggagugcaauggugcaaucucggcucacugcaacuuuuuccuuccagguucaagcaauucuccugcuucgaguaguugggauuacaagcuacccaaccugcuaauuuugccaccacaccuggcuaauuuuguauuuuuaguagagaugggauuucaccauguuggccagacuggucuugaacuccugacaucaggugauccaccugccucagccucccaaagugcugggauuacaggcgugaaccacugcgccuggccuggguauugaccuuuugucagaugcuuuuucugcauuuguugauaagaucaugugauuuuuuuuuucuuuagccuguugauauggacuacauuaauuuauuuucagauugcacaccugcaauaaaucccacuugguuguaauauacuguucuuguuauacuauguuggauggaauuugcuauuugcugaagacuuuugcaucuguauucaugagagauauuggucugaaguuuucguguaaugucuuugucuaguuuugguauuaggguaaugcugaacucauaucuacuucucucuccugaaagauauuguagagaauugguauaaguuuuucuuuaaaucuuuggaagaauucuccaucugggccuggugcuuuauauuuuggaagguuauuacuuacugauuccguuucuuuaauagguauaguccuauucagguugugucuucugugaguuuugacagauugugucuuucgaggaauuggucuguuucaucaagguugucaaauuugugggcauagaguuguucacaguauucuuuuguuauccuuuuaauauccaugggauccauaguaauguccccuuuuauuucugauauuaguaauuuguuuccucucuuucuuagcuagcccaccuaaacgcuuguuaauuucauuaauauuuucaaggaaccagcuucugguuucauugauuuuucucuauagauuuccuguuuuuuaauuucauugauuucugcucuaauucuuacucuuucuuaugcuuacuuuggauuuaauuuauucucuuccuaauuuuccaagguggaagcuuauaaaugauauuaggucuuucuuuucuaauuuaugcauucauuaagucauuuaugccuuaaguugcaauuuuuugaauuucugcaaucaggccuuggcaaugaucuugugcaguaggguaugaauaacucccacaugcuuagcguuccaauaauggaacacuagacauuaauaaauuucccucaaaagcacugcuuuugccacgucccacaaauuuugguacauuuuguuuucauuuaguucaaaauauuuuaaagugucucaagauuucuuuguaaguccauauguuauuuagaaguguuguuuaauccccaaguauuuugggauuuuugcauuuaucuuucuguugauuucuuaauucaguugcagccugagagcagacauuauaugacuucuauuuuaaauuuguuauggcauguuuuauggcccagaauguggucugucuuggugaacauuccauguaagcuugugaagacuguguauucuguuguuguuugaugaaguagucuuuuguucauuauauccaguuaauuaaugauuuguugaguucaacuaugcuuacugacuuucugccugcuggaucugaccauuucugguacagcaguguugaagucucuauauuaguggauucuuccuuuuuuuccuuuuauuucuaucaguuuuugccucacauauuuugauacuuuguuguuagguacauaaacauuagauauuguuaugucuucuuagagaauugaccccuuugucauuauguaaugcuccucuuugucacugauaacuuuucuugcuuucaauuuugcaguaucugaaauuaauacagcuacucuuacuuuguuuuauuaguguuagcaugguauaacuuccuccauguuuuuacuuuuaaucuauaugugucuuuacauuugagguggauuucuuacagacaacuuauacuugggucuuguuuuguuauccacacugauguuuuaauuggugcauuuaaacuguugauguucaaagucagacuuaaugucaucaauagcuucuaagaaacucacuuuuuuuuuucauuuuuuuuuuuuuaaguucagggguacuugugcaggaugcacaguuuuguuacacagauaaacgugugccauggugauuugcugcgcugaucauucugucacccagguauuaaggccagcauccauuagcuguuuuuccugaugcucucccucaccccacccaacccucugacaggucccaguguggguuuuuccccuccaugugccuguguguucucaucauucagcucccacuuauaagugagaacauagaguauuugguuuucuguucucguguuaguuugcugaggauaauggccuccagccccauccacgucccugcaaaggacaugaucuaguuccuuuuuauggcugauaguguugcaugguguauauguaccacauuuucuuuauccagucuaucacugaugggcauuuagguugauuccaugucuuugcuauugcgaauagugcugcagugaauauaugugugcauauaucuuuauaauagaaugauuuauauuccuuuggguauauucaguaauugauuggugggucaaaugguugaacuaacuuacacucccaccaauaguguaaaagcauuccuuuuucuccacaccucgccagaauauacuucauaaggacuuguugaaaaaccugugguuagaagucuuucuuacagcuuuuguuacagauaucucaaacugaggguacaauuauaauguggaauuagugcuugaguaaauauaaguaauuucaguuauagucucuguauuaguccauccucacacugcuauaaagaaauacccaagacuggguaauuuauaaaggaaagagguuuaauugacucacaguucugcaaggcuaggaaggccucaggaaauuugcaaucauggcagaaggagaagcagaagcaaguaccuuuuucacaaggugaggcggccggagagagagaaugcaaauggggaagagccacuuauaaaaccaucagaucucaugagaacucacuaucaugagaacagcaugggggaaacugccuccaugauccaaucaccucccaccaggucccucccucaacacauggggauuacaauuugagauuagauuuagguggggacacagagccuaaccauaucagucugauaacaguuuucugccccccucaagaaucuccauuuuuauggugagcaagugugagacuuucagaugauuacaagguugaaagagaccauaauuuuuuuuuaucauauauaaagaauaagaaccagcuaaguaauaaggauaauggaaaacuugauucugaguuuugaccuuuuacuuccuuagacacauuguuuucaguuuucuuuauagucuuagugcuuugauagccauguuuaaaguuuuuauuuuuuacaaaaucaguauguacuuucuguuauuuuuaaagaauaguuuauuugaaaacagcaugggauuuuugccucucaaacaaggacaggugaaaauugggaguucuguaggagagcagaaguggagaggcuuuuguguucuugcccuuucccuucucuuuaacugauuauccccaucuagguuuguaucucgaaauucagaucaauaggugggauuacaauugaaagguuauuaaugaauacaaggguggugguacaagaguuuaccuuaggcaaguuguauggaagacaguaauagauaauuuuguccauaaaacuuuuccuauuuugauuauguaaucucaauauucauaauuuguuaaguauacaucaagggaacuguuccugucaucuagaaugaccaucuauuuaauaaagccaugaaacaauuagagaacuuucagaaaacaaaugggcauaaugcuauguugcaaaaacauguccugccuuguucacccuguccauuuuuagauuggucuggaugauagugaaaugcagaaguguuugccacacaggugcaguguuuugcagcuguuggaaacauucccccucacccacaaccccuuugcuuucuucacauaaaauuaugcugugcuuagaccauuaauacuagaagaugggauuugagaauuugaaugucuguuuacauaaagauguaauacagagaaauaacugcucauucaggcaucugaauguaacugccuagaugaauuuauuaaaacuguccuuaaggucacacuagccuuaaggucauggaguuuuagauacaagagacugccuuuaaaacuccugucuguagaauugcugcccuccaggacugaacugucuuugaggacagggcuuauauauauuuauuuuuaaaucucuuguaacuaacauaacaccuggacaaguaggcacuuuauauguuugcgaauauuuuauguuggaagaugaagccaaaugaaaauaucuuuuaguaugguacuaaaucagaaauuauaauuuuuuuaaacugaugccaugugguacacucuauaguagucaugaacagagugccauggccugagagagaaggggagagugaauaaucauguccauggaaaucacgggauacuuuauauuuuuauguaucacggaaaauacuucccuagacuacaauuggagaauuuguuuugaagagaauuuuuuuccucaucuaagagaaaauaauguauuuuccaacagcaguguuuucccuccauauccccauuuuugucauuuuugaugcauuauauaauaaccaaauuaaugauucaaaauuggaaaguuuuagagcaugcuuucuuuauauaaaaccaauauuuuauuuucuguaguuauuucuaugaugagaguuauguaugcuuuggagucagacauaaauagguuugaaucucauauuuuuuaaucccaacuuacuaaauuguuuaccucaaggaagcaacuuaaccucaacaugucucaauauuucugucugcaaaaauagggcuaauaccacucuaaacgguaguguuaugaggaugaaaugagguaccucuugaguacauggcagcagcauuauuccuggcgcguauuaggaacucaguaaacauaauuuccuuuuuauucaacggagaggguuguaguaaucaagacuauaguacuuuuucuggcauugaugaagcugcuauucuaggagaccauaguaugcccucaaguuucuauuuguucagcaugugcauaguacacaguaucugcaaaggcauugagauauguggcgauauugcagucuuguugggggugggggugaggaguagaacaccaaauauugaaaucaugauaaaagguaguacauuacugagauucugagaagggggauucugagaaggaggucacgauaaacugcagugauuaggcauccuucauggugguagcauagcugcgaacugaaccuucaaggcaaauuggagaagaaaaacauucaggccuaaagaagaccagaaagagcaagugcucagucuucugagagaauauuuuugugugcuguaauugacagugguuccauguauacagaacaaaaaauugucauauuagacugaagcuggcuguguugauccaaagaaagcguaggaaagcauccugaauauacuauugccuguuuuccugacucauaaauagcauauccuuuauucuccaaaugcuuaggacucuuaaacuagcaaagcauauacuuugaaguuuauaaacguauagauguguuugcaaguuuuuccuuuuuaucugagaauucauaacaugauaaacuuuauuucuguguaagagaauggaaaacaguuuacauuugagaaaagaucaguaaaacuaguaacauuuuuggaauugguggggguagaggaagggagggauuuggaggagaagcauugugugucuuauaagaaauuaucacaagauaauuuguuccuugcaacaaggugugauuaggaaccauuggaaaauuuugaggauucuaaugaaacauuuaaggaauuugauuuuuacaguuaguagaauaguuuaaagggaaaagaagucaaaauauuaaggaccuuuacaaagaaaagcuugguauauuugaggcuugaaauaaucugaacuaaaguauugaagaagaaauguccaaaaaagcaauagugagaggcuguugggaguguaggguuaaaggaggacaacagaucaaaaauggcugcaaggcucugccuuuaggggauggaagaguaaauuuugaaguaccgucuugguauuaucauugcucuaggauaagggauaagagcuguaauucacucucaggucccucccuaguuuucuagugacugaauaaagaaugaaguggcaaauuuuugcugugggaugcuuuugaaacaagguuucuucucuucgguuaccuaauugggagaggguguuauauauuuucacuagggguaacaguauauguuguuuccauuaaagacuagguaauuuggaugugauagaagauauugguguguuuuuagaaauacugaaaugauuuggggaaagaaaaaauguauaaagauacuuugaaaacuuugagggcuuuuaauuuguuagaguugcuguuuuugguugguguuuucuuguaaaaacuuaaccccaaggauauguuuuacuucugcuguuguuaauaggucucuguucauuuaauagguggcaauuaucaugagcauuuggggaaaaaaauuuuaacgaaguuuuguugggcagaaaguauacucuuggcuuuuuuagguauguuauacuccagguauuuuagacuacaaggcaagaggcagaaaucuagaaggauacuagggguagagcaauauuuucagcaaaauuguuuucccccucuucagcuuucucuguuacccuaucccucucccuuuuuaguagcucagaacauacccuccuccagcauccugcaaaauugaacacuuuugcuucaguguuaacacacaaagugaaauaaagaagagugccgagauagcacaacaagcauuuuucaagcacuaacuauauaucuaguacuaugcuugguucugggcaugcacauguguauaacacacgcucccugucuugagaagcccacaguagagcaguguggugaacauugauaauuuacaguuaugcuuuuauggagcuacucacagagcugauuuuccauuugauagucuugacaaaaaguaauuuuguguauaaucaaaaaagcaauacuagcauagcuuuuuuucauagacauuaaaacuuguuuuuggaacugcacacuuauauuuuuaagaauuguucuuauaaagagcaaauaaaacaccuuuuacacuuuguauuguuuggcuaauuuauugucauuuguuuggccaaaugacaaggcauuuuuuugguaguacguugagcuaaauauagcuguucaauguuuauauugaaaaauuaauauuauuaaaaaggguaucuuuuuaguccauguguucugauccuuaacauuuuauuuaaucuugaagcuauauuauuucuucucccuauuccccuuuugaguacuuuugauuuucuguaauaucuuucaaaacauuuucuuucccaacauuaaaacccuuuugauguauagagaaaugucguuuaaaaauccauuagcaaaaucccuuaugaugauaacaggauacauuuuuuuuuccuugcucuuuuauuguaccuuguuaagcuggucucacaugaacuuucuuagaaucaggcaguuccugguuccuaugggacuuccuguuuucucaaauaaaaauagaaaagcaucucagaaaggaaaccuggucagugugaacuacuuuguaagaucaguuagucuuaguuagucuuaguuguggccuggauuauauagauauauagucuauauaaaauauaaaaguuuacagguaucugaaagcuuugaauauuuucguauguaauaucaaaauaaacaaaaugauaaggagaagacucugaauaaaaacccugagaggugcuacauauucagccguaaacauuuuuguaucuuaauuuagaggugaaugaaggaggggcauagggguuggauggaaagugguaaauccuuuccuuauuauguaauauuuuauuguaaauuuggaauugcuuaauacugagacuuaauucuuaguuacuuugaucuguauuuuuuuuucuugccacuuuuucagauguuggcaaggauuaggaagguggauuuuuaaaaaaucauuagaagucagaauucuaaaugaauuauucaguuuuaaagcaucuuguagauuucuuucaguaguuaacugcuucuuagucuauauuaugaagagaaaucaaauuaagguagaaacaaaugauauagucauuagcaguaauaauaauggauaguguguauugaguacauauuaagugcuugacacugugucaaacauuuuaucuuguuuaucucauuuaauccugacaacaacuguauaagguagguaucauuguuauccauacuccuuuaaagaagaaacuacaauuuagaguagcuaauuagauguuaguucaaagagacauuacuaauaagugguagagguggagcugggacuugaacucagcuucugugauaccagagcaccugaucucaaugauugugaggaaaaccacuaauucaaagugagaaugauaaguauaagucugaaaaauuacuucccuaaccuuuauuaucaccaguuuguuuacauuugguucacauauuuauauccaguuuuagcaaaguacaugcuggcauuucagagaguuuguuugggggauuuuaauucguaagugaugcuaauacuugucuuuuuuuccuuccuugauaguagaaaaccccuuuggugaaacauuuggaaaaauacaaguaaguaaacgaucauaauacugauaauuuugugucauguuuuauaugauaaaagcaugagaaugacuaucaacuaaaaaaaaguaauuuuaaaguuauuuuagucuuaaacaauagguuuuaucaacuuaaaaaaauaguaauuuuaagguuauuuuagucuaaaacaauaggcuuucuuauucugaguauucccuaacugucguauaauuaaaucugacacagauuuucucuuaagagcugaacuguuuaucacuuuacuguaaaagacuacugccaaguaaaaugggaguggcauaucaucaguggaucuugucuuacacuuagaaguaugccuguugccuguaguuguuggauaccuuagcaguuuuuguccguuuugcccucauuuuaccucuuuggaucuucugcauauuggcaugccuauucgaccaucaaaaggacuuagaaaggaagcauauccuucaggcuauuucuuuaauuuuuuaaagagugcuauaauacuaauuuuaaccuaaauuuuacuuauauaaaaauauuuuucacuuacccaucauuacagggacuucagagauuaagauguuuaagcuuguaauuaguuauuaauuuuuuauuauaggaacuguuauauagaccuguauagaaaacauuauuuguuguacugaaggauguguaauaauguguaaucacauccauagaauauuacuuucuguuguuaaaguggaacucugaaaugauuaguaauauucuauugcagugauaauuguuuaaaacaaaguuggcuuuuucaguugccuuaaguauaacacugcuacagugucauaauuuaaauuugguacaguauacuuacugaacauuagaaauagaagacuauuuucuucuguuuaauuuuccccaaggaagaaacugaaauucugaacuucugaauaauaguaacaauuauaaugaagauaguggcuguuuacuuauauuaaaugcucauucuguacagggccccuugccaaguuguauuagucuguucucaugcugcuaauaaagacauaccgagacuggguaauuuauaaaggaaagagguuuaauugacucacaguucggcuggggaggccucacagucguggcggaaggugaaagucaugucuuaccugguggcaggcaacagaauauaugcagggcaacuccacuuuauaaaaccaucagaucucacgagacuuauucacuauucaucacgagaauagcauggggaaaaaaacccaccccaugcaugauucaauuaccucccaccacugccucccacaacacguggggauuauuacaauucaagguaagauuuggguggggacacagagccaaaccauaucacaaguguuaaaauucauuauuauuuaaucaaaggcauaaggcaaacaguuuaaaauauccuugaagaguccgggcgugguggcaggcgccuguagucccagcuacucgggaggcugaggcaggagaauggccugaacccgggaggcggagcuugcagugagccaagauugugccacuguacuccagccugggcuacagagugagacuccaucucaaaaaaaaaaaaaaaaaaaauuccuugaagagaaaauuggcugaggauugaggagggaaauauuuaauggugacaauauaugagaaaauuggauagagucacccuauagauuuuucucccuccaaaaugaaaaacaauagucugggccuuacuaaaacacaauuagaaaguagcuaauucaaauuacaaaauugccuuuauuuaaugaaagauuauuugaaagcuuauuuuauguauuuacuuguggaacuuuaacuaguuugcagaauuauuagggaagccaguaguuagacauuuaagcugaaauauuaggagacaaucugaaaagcagucaaaauggaagaagaguguaaucaaacuguaaaccaguaaguaaguuuaaaaguugauuuguauacuuuucagauuuacugcuaguuuaguguacuuguacuaaagauaacugaaccaaaaccuuuguuucuuucucaaaauguguucauucacuuaauagcauguaucaucaugccacugcacucugccacagccugagugacagagcaagacuguaaagauagauagauagauagauagauagauaaaguaaauaguauaucucauaaacaccuacuuagauuauaauuuaguuggucauuuggauagcaguugaggcccuucuaguauauagacggucauuuaaacuguuuguuuguuuguuuguuuuuuugagacaaggucucauuuuuaucacccaggcuggagugcaguggcaugaucacgacucacugcagccucaaccuccugggcucaaguuauccucccaccucagucuccugaggagcugggacuacaggugcauaccaccacacccagcuaaauuuuguauuuuuuuguagagaugggguuuugccacauugcccaggcuggucucaaauuccugagcucaagcaauucuccuggcucagccucccaaacuugggauuucaggugugagccaccgcacccggccuuaaauaaauuuucauuggaaagauaauucuuguaaaaaacuauaguugagcuuucugaguucuuaaguuauuuguaugagaauguaacaguauguaugucauccaguaugagaucaguuccaucugguuaaguguuguuacuucuauuuaucuaguccaauguuuaguaucugugaaucaaaagcuaaaguuuauucgcaggucccucuuauguuuauuaaagauguaaucagaggacagaugccaauguucaaauuuuguuuuguuuuugaaaggggagugaggaaggguaugauaguacauauaaaacaaaaagaaaauaagucucuuuuccagaugagaggaaaagaaacacaaaacuuuccauugcuuuaaucccaaaacuuaacuagauucaccuugguuuuuaugugucacauccauaagcuacacugucauuggaacaccuacucauccuauuauguugaagauauuuauuaaaaaugauuuugugguuuaauguaucacaaaugcuuagguuucagaauccuguuucagcccugcucuuacuuuuuuuuugagauggauucucgcucugucaccaggcuggaguacaguggcaugaccuccgcucacugcaaccuccaccuccuggguucaagugauucuccugccucagccucccaaguagcugggacuacaggugcaugccaccacgcucagcucauguuccacccuccucggccucccaaagugcugagauuacaggcaugagccaccacacccagccuacuguuacuuuuugaugucuaauuuugcaguuugaauuuuugaucuuaugugaagauaaggacuggcuugauucagaaucugauuaagauaaaauugaggcaaaaauauauauauauacguaggaaggcaaguaguaaacugaaugaauaaguaacuuaucucagucaaccgucugacauaaaaccagguauucuggugguaggaucuuggcacuuuugaugaguuuuccucuuaguauaaccgauuaaagcugcaaugacaaaagcaugccacccauagugugcaaacauguucucuucugucccugcacauacaccacaaaauaaauggaugagguugcauguuauuagacauauaaauguuacuuuuccagucuuuuauaucuugcuucaauuugcuccaugaucuguucauccaguaaaucuguuuuguuggaaacuucaggaagaaagaaaguaauaaagacagagcccccugauaaaucauggacuuauuuuagguagugcaauaagcuauuacccccuccccacccuacccuccaucauuuaugucgaucccuccugaucguaauugcucuuaaauuggaggucuuguugcuuuagacuacuuggcagguacuuaggcuguaccauugcaauaauucucuaucuggacucuuuucauacaauuauuucugcuuccgagccagccuauacauuguacauucuggcccggguaguauuccugaugcacaagucuguuuuacucuccugcuaaauuuucagaaugaagucaaacucucugucuugcuauccaaggcugucugguaguuaauacuaaacaacuuuucuaguaguuugcagaaucaaacaagggcuacugguuauguaagaaauauaaccaaugcuuucaugccuucaugcccuugcucagggucuuucccauugccuaggaugcugaucuguuaguuuuuccuuuuaaaucaaacucaaauauucuguuccauaaauucuguucccuccuucccuccuucuauauuuacagaagaaggagggaagagaaucuucuguauuacucugcaguuguauaacauuuaauauguuuuuugcccuugaguacaggaaccaucuuguucacugggucucucgcuuugcugagagaacaguucuuaacuccuaguagauguuuauuuaauguuuguuucauuuuaacaguucauaaguuuauacaggggcaccuugggagccuaggagaggacugaguaucagucaacgugccaguacucauucccuuaguuuuaugugguugaguuagauuaaaacaagacaugaagggcagccuugaugaagaaaacagucucauaugaacaguuuacauaagaauacacugugcagagggggauugggaacauugcuuuggugauugauggaguuuauugucugugagaccuuuuuuuuagcacuaaccuuaugccaauuuuuaaaucguucuccagaaagugaaauauuuagaguaauaauuuagagucuuagauuaagguuucuuaaaaauauggugcccauuacuuaaaugugaauuugucuuucagauuauguggcuucugugauuuuaaauuuacuguuuuuuuuuuuuugauuaagaauuauuugguguuuuuuuucuuguaauuggguauuucauaauaacuucucuuaauuuuaggaaagugaaaaaacucuuaugaugaacacauuauauaagcuucaugaucgauuggcacagcuugcagguaauuguuuuaacuuuuauaguugcuaaaaauguuuugaaaaauguauguagcauguuauuaguagaaaauauuuuuccaaguccaguguuauauuugugaaauauuuuucuuuagaaguuuucauuaccuauacagagugauuuuugauuuuuacauauguauuuaaugaaggcuuuuuuccugccugccaucuguauuagagguaauauauauauauaauauaguuauaaaguugaucaaauuucuuuauugcaucagugguaacaaaaaaucuggaaagcuuaaguaucagaggaauuagguaagcagugaauuaacuaaaaucuuggauuaaauauacaaaugcagauuuucuuuuguugguuguauagguaucauucuguuugauaaaguaaauuuauucuccuguaauuuucucuccggauuaauugcauuuuccucauagucugcucuuaguaauucuuugagagcucuaagguagucaacuuguccgaaaugggaauaauuuauuauagauuaauuaguaucaaguuuagcacauguaaacugcaguagcagcuuaucuauuaccuuuuuuuaguucuuuuuuuuuuuuaaacauauaaucugaaagaagagacuuggauucuuguaagcaggcauaagaaaagaaaaaugcaguuuucaaacuuuucuauguagcagaacuuuuguguaaaccagauuauugguagcagccuauagguaaauauggaacuucucugguugaauggagguauuuaggauccugacaguuucccauccucugaucucucuuuguuuuguacauuggguucuuaauucuggucaauuuuuuaagcuuuuaauucuguauuauaucgcuaaaagccuucuuugcuuugauugucauucacacacuucaagcuaaugacauuuauuugguaugcuguagcacccagagauagguuaaguauaugcuaguuaugcuagcuagggauauugcuaacacaagcuucuacagcuaucucuguagcauuguuuuaucaaguaugguucauggccagcuaaaucagcauaaucugaugugcuuuuaaagauacagauuccuuccccuugaguaagggucaacaagcuuuuuuucugugaagggucagauaguggauauuuuaggcuuuguagguuaguuugccucugucacaaccacucaguuauguuauaccaugaaagcagccauaaauacuacauaagugaaugagcuuggcuguauuccaguaaaacuucauuuauaaaaaccagaguaggccagauuugacccaugggcuguaauuugcagaccucugcucuaaaucuaugggaucuaaaucucugaggaugcacuaauaaacuuucaagacuuguucaucugauagguacuucuccccuuuuuauagcuacugacauuaaaaugauuacuugaacaaaacugaaaugagaacauggcugcuuuuauuuuagaaacauuuggcaaggauuuuacuuuaauuauucuacuuucauguuaacaagcuuuuuaacuacuugaaagacacagggaagggaaaacaugacaauuggaguucaauaugaggauaauuuauuucuaauaaccacuuauagucuaaagaaaaagcccugaauucgcuucuuaucaacaauuaaaagaaaagauaaauguaguuuuccaaagauuuauaugagcacaucccuuuguagaaaccagaucauagguggaaacuuguaccugauuucccuguuggucuguuauaacaauuuuuguuuuuuaagauuuuuuugagacaggaucuuuucugucacucaggcuggagugaaguagggugaucacagcucacugcagcuucaaauuuauggagucaagcugucuucucgccucugcuucccgaauaauugggacaacagaugcauacuaccacaccugguuauguuauaacaguuuuuaaggcaugcacaccccuugcuaaagauaggauuaguuauacucugaaaaugcacauacuuuaauucauuaauaaauucaaacuuauuugaacccuuaaaugauuagcuuuaagaauagauguguaaguuaaguuagcacaaugaauaugcugaauuuuuucccuuuuaggaauaauacauauuucuggagggcgucuugugugccaagaucuguggauaggcaucagugugacauaguuccuauaccagcuuacaguuuaguugggaauauaagaggaagauaaguucuuguuuggacugaaaugcauuuaaaaguugugguuaauguaaugguaguuguuuguuuauauucuuacuggaauuucuuuguuuauauucuuacuggaauuucuucuagaaauuauaaauaauauuguucauguucuuucuuuacugauuauaauaauauaaccuguaauuguauaauguauaaaauauuugaauuaauuauguuuguuuucuucuguuuaagagaguacugauucaaaauuaauaauaugcuaaucuuuccaggagaucaugaauguggcaguucuagucaaagaacgcuuucuguucaagaggcagcugcguauuuaaaaguaagcaaugaaauuagaauuuuaauagcuauauuuuaaaaaauuauauaaaucauugcuacuuguaagaaucauauguuugauuauuuuaauuguacuguuaaaagcuugggccugcuguuugguauaauaugagcaguuaugagaaaguaaaauuguucaacuuuuuuuuuuuuuuuuuuuuugugagacacaguuucgcucuuguuccccaggcuggagugcaauggcugaucucgacucacugcaacguucgcaaccgggguucaagcgauucuccugccucagccucgcgaguagcuggaauuacaggcacccaccaccucgcccagcuaauguuuuuuguauuuuuaguagagauggaguuucacuauguuggccaggcuggucucaaacuccuggccucaagugaucugcaugccuuggccucccaaagugcugggauuauaggcgugagccaccuguucaauuuuuuuuaguuuguuuuagaacauucucuaugagagaaugcauauuaauuuggaaaggguacaaagaaacauuggucauagggaaauugagauaggugaguaguagcauguaagagagcagguaaauaucuaaccauuuauuuaaaaucuucugucccacaucaguuucuucuccaaauacuaagagaacuugcuguugaauuuucuaaacuacuguaaauaauuucuggaaaaucuuaaugaaagguaguaaaagauuaaagauggauaaaugucauucugauuucucagaaguggaaaguggcauuugaaaaccauacaggaaagcuuguugucgguccaguuccauaaagauaauuucauaaagaucugaguucuugcaaauggaaacguugaucccuggaagguggcuggcauuugaacguggacaagucaugccauacaaauuucaugccucccauccccuuguuaaaauugugguaaaaaauauauaacgugaaaucuguuaacauauuuuuaaguauaccguacaacuauaugugcauucuuauacagcaaaucucuagaacuucuucaucuuguaugacugaaacucuauagccauugcacagcaggcccccguuuuccucugcuccauaucccuggcaaccaccauuuuacuuucuuccuccaucagugugauuaacagauaccucauauaaguugaauccugcaauuuuuguccugugacuggcuuauuucaccuagcauaauaucuucaaguuucauccauauuguaacaugacaguacuuccuucauuuuuuaaggcugaguagaauuucauuguauguauacauauauuuucuuuauccagucauguugaugggcuuuuagauuguuuccaccucuuggcuauugugaauaauucaucaaugaacauggcaaugcaaguacuucuuugagacucuacuuuuaauucuguuagacaaauaccuagaagugggauugauagauaauaugguaguucaacuuuuuauuuuuugaggaaccuccauacuguuuucauauugacuguaccauuuuacauucuuuccaauaguauaguaggauuccaguuucugccuauccuuaacacuuauuugccuuauagcucacuguguuuuuauuuguguuucccugaugauuacugauguugagcaucuuuucauauaccauuuauauacauauacaucuguguguauauauagcauguauacagcauauauauaauaccuuaucuguuggccauuuguauaucuucuuuggagaagugcuauucaaguucuuugcugauuuuuaaguuggguuauuuauuuuguuauugaauuguggggguuucuuaugcauuuugcauauuaaccccuugucagauauaugguuugcaaauauuuucucccauucuguagguuacuuuuucacuguauucacuguuuuuuuuuacugcacauaugcuuuuuaguuugauguagucccacuuuucuguuuuugcuuuuguugccuaugcuuuuggugucauguccaagaaauuauugcccauaucaacgucaagaagcuuuucuucuauguuuucuucaagaaguuauauaguuucaggucuuacauuuaagucuuuaauccauuuggaguugauuuuuguguacgguauaagauaaagguccaguuugauucuguugcauguggaaauccaguuuuccuagcaccauuuauugaagagauugucauuucuccauuguguagucuggcacccuuguagaagauuguuggaucauacaucaguggcuuuauuucugguucucuauuuuguuccacugguccauuuaugucuauuauuaugcuaguacuauacuguuuugauuacuauaguuuugucauauguuuuaaagucagugugaggccuuugugguuccauauggauauuaggauuaugucuucuauuucugcaaaaaaugcuauugggauuuuguauugcuguauugccuucggugguauaguaauuugaguaauauuaagucuuccaauucacgaacaugagaugucuuucuauuuauuugugucuuuuauuucauucagcuuuuuuuuuuuuuuuuguaguuuucaguguauaagucuuucaccucccugguuaaguuuauuccuaaguaucuaaaucuuucuaaugcuauuauaaaugggauuauuuucuuaaccuccuuuucagauuguuguuaguguauagaaauguaacugauuuuuguauauugauuuuauaucuuccaacuuagcugaauuuguuuauucuaacaagauucuuuuuaguagagauaggggccuugcuauguugcccaggcuggucucaaacuccugggcucaaguuauccuccugccuuggccuccuaaagcacggauuacaagcaugagccaccacacccagccaaauaacaagauuuuuuuggugaaaucuuuagggcuuucuauguauaagauuaugucacuugcuaagagagauaaauuuacuucuuucugauuuggauguuuuuuauuucuuuuucuuaucuaauugcuuuggcuaggaugucuagugcuaugagagauagagaugggaaaaauagccacccuggccuucuuccugaucuuagaggaaaaucucucuuuuuuuuuuuuuuuuuuccuugagacagagucucacucugucgcccaggcuggagugcaguggugugaucucugcucaauacaaccuccaccuccugggcucaagcgauucacaugucucagcuuccugaguagaugggauuacaggugugugccaccacaccuggcuaauuuuuuuguauuguuaguagagaugggguuucaccauguuggccaggcuggucucgaacuccugaccucacgugauccacccaccucggccucccaaagugcugggauuauaagugugagccaccaugccuggccaggaaaaucuuucaguuugucaccauugaguaugauauuagcuaaggguuuccauguauggccuuuaauauguugagauaauuuccuucuauuccucuuuauugaaugguuuuaucaugaaaggauauuuaauuuugucaaaugcuuuuucugcaucuauugagaugaucaugugauuuuaauccuuuguucuauuaauguggcauacucaguuuugauuuuuguauguugaaccaucuuugugucugagguauaugauccuggugugugauccuuuucaugugcuuuugaauucaguuugcuaguguuuuuuugaggauuuuuguaucucagggauuuuagucuguaauuuucuuauaguaucauugucuuuggugucagaguaaugcuggccucauaaaaugaguuuggaauuguuucauccuuuucaauuuuucagaagaauuugaauaggauuggcauuaauucuucuuuaauaaaauagauaauaaacucagaaaugaauucugauuuuuuucuuagucuaguuaaggguuugucaauuuugaucuuuucaaaaaaucaacucucaguuuuauugauucauuaaauucucuauuuaauuuauuuuugcuccaaucuuuauuauuuccucccuucugcuaaucuuaggcuuaguauguucuuuuuuuaguucuuugagauguaaaguuagauuucucauuugagauuuuuuuuucuuaacauaggcuuaccacuguaaaccucucucuuguauugcuuuuacugcuucucauaaauuuuguuagguuguguuuuuuauuuuuuuauuuuaauacauuuauaauuuuucuuuugauuucugcuuugauccaaugcuuguucuaggagaauguuguuuaauuuacacauauuugugaauuucucaguuuuucucugcuuuugauuuuuaguuucauuucauuguggugugaaaaguuacuugguaugauuucggucgucuuuaauguguuaagauuuuuguggccuaacauaugaucugauuuggagaauguuccaugugcacuucauaagaauguguauucuacuccuguuggguggaauuuucuguauauuucuguuagauccauuugaucuauaauuguuguucaaguccucugcucccuuauugaucuucuaaugugggauacauacauauuuagaauuguuaaaucuuccagaugaauugaucccuuugucauuuauauaauaaauauccuuccuugucucaugugaugauuuuuuuuuuuuuuuuuuuuuugagacagagucuaggccugucacccacgcuugagugcaguggugagaucauagcuuacugcaaucucaaacuccugggcucaagugauccuccugccucagccucccaaguagcuggggcuacagacacaugccaccacacccggcuaauuuuuaaaguuuuuguagagacaggaucucacuacguugccuuuaagucaaaaauuugucuaauaugaguauggcuaccccuacucuuuauucauuauuaucugcauggaauaucuuuuuccaucuuuuggcugucagccuguguguguccuuaaaucuaagguguacacaugauaaaauuggagcuuuuuuuuuuaauuauucauucagccacucagugugcuuugauuugggaguuuaguccauuuacauuuaaaguaauuacuaauaggaaaggacuuauauugccuuuuuuguugaauauuuucucuccguguuguagcuuuuuuguccccuuuuccauaucuuacucuuuuuugugucuuuuuuuuuuuuuuguagugacaagcugugauuucuuucucauuuucuuuuacguguguuuuuuaggcauuugugguuacuauuggggcuuauauaaauuaucuuauauucacaguaauauuuuaaccugauaacaccuuaacuuuagucacauggaaagugucuacuuuuuuauaucucucuucauccuuuauauuauugaugucacagauuacaucuuuucauauuguguaucaucaacauauuuuuauaaaguuuuuuauacuuuugucuuuuaaauuguauaucacaauuaagugauuuacacaccaccauuacaguguuacaguauucugauuuugucuauauauuuaccuuuaucagcaagcuuuauauuuucauaugcuuuugcauugcuagguagcauccuuucauuuaacuuggagucacuuuagcauuucuugugaggcaguucuagugaugauuaacucccuuggcuuuuauucugaaaaaaucuuuauucauuuuugaaggaugguuuuucuggauauguaguaguccccuuuauccaugguuuugcuuuccacaguuucaguaacaccuagucaacuauggucugaaaauauuaaauggaaaauuccagaaauaaaaaauuguauaccauuuuuaauaguacgauguacugcuccccccuccccccuaccacacacacacacaguauucuugguuggcaguuguuuucuuucaguacuuugaauauguuauuucacucucuccugcuuuguaaaguauuuuggggacucccuuguaugugaugaguagcuugcgucuuggcugcuuucuucuccuugguuuucaacaauuugaacauaacaugucugaauauggacuuauuuuggucuauccucauuaggauucauuggcuuccuugagucugaauacccauuuucuuccccagguuuggggaguuuugggccccaaauaacaugguguuuuuguuuuuguuuuguuuuguuuugccuguuucuuucuucucuuucugaaacuuccauauuacuuauauugguuggcuuaauggugucccauuaagguccuuagacuuucuuuacuugucuuuauccuuucuucauuuugcuugucugacagaauaauuccaaaugaccuucuuuugaguuugcugauucuuucuucuguuugauccagucugcuuuugaaccccucuaaugaauucuuaaauucaguuauucuuuagcuccaaaauuucuggguuuuaaaaauauuuucugucucuuuguugauauucuuacuugauucaugcauuguuuuccugaucuuguugaguaucuuuaugauggcuuuuucugaauucuuugucauguaauucuuagacuucuacuucuuuaggauauguuuuggaaguguauuuuguuucuuugauugaccauguuuucaugguucuucaugugccuuguuacuuuguguugggauucgugcauuuaacaacaacagaaauaaaaaaaacagccaccuuuguagacuuuguguggggaaagucuuuuaccaauaugucuguguagacauucuggauuucuuagauaucuuuucugugguugugguugugaccucucuggauuuuugccugugaauuuccaauuagagaaguuuugcugguuuauuuucucauaguuuauaaucuuuugaucccugguaucuguagguuaucccuggugucuguagauuaucuggagcugccauaagcuauccaacucuuuuguuuguuuguuuugagacagagucuugcucuguugcccaggcuggagugcaguggcacgaucucagcucacugcaaccucugccucccuaguucaagcgauucuccugccucagccucccaaguagcuggaacuacaggugcccgccaccaugcccagcuaauuuuuuguauuuuuaggagagacgggguuucaccauguuagccaggauggucucgaucuccugaccuugugauccaccuaucuuggccucccaaagugcagcgauuacaggcaugagccacugcuccuggcccagcucuuuuuucuucuuaguggcccccaggcaucuggaguauacugaguccuauccgcauuuugaaucaggugaggcagaagccagcgaggcaacacuccuugccccugugaagucagaacuuuggaugcaugucuaacuuuuuuccuccccagggagaagccaagaguugggguuuuucucaacuuucuucaugccgagcuggggguagggacaauggugagugagugcuguugccuuuguucuuaguaguccuuaauuuggugucuuucaacuauuagauucagacaugacagaaaccaguugccccgaaaagucagaucauuagauguauguucuagucuucuguuuuccuucugaggaggaagccacgaguugggaguuuccucucuauugcacugcccuguggggugaugagagugucugggaagugagugauaugaauuuuccuaacagcuuugauacaggugguuuugugcuugccuaggugcaggaaccuuuuaacuaauuucuggauuuuucacaaauggaauugguccauguauuuuuguugaaucggugucucauugagggaaggagggucuggggcuuccuauucugcugaugucacuccuccacuuuuuaaaaauuaagaauguaguauauguuuuaaggcuuucagcaaaguuuugguaauagucuccugugauuaugcuugucaacaaagagaaauauugacugaguuuuuaacuuaaugcaugacuuauauguagguaccaaaaagauccuaagacaguauaauaaggagauuauaucuggagucaaauucugguacugccaguagaagcuauuacauuuugguaaagucucuaacuuuucugaacauguuucucugugaaugugggacugccguuaauaccugucaaaguuguugggagacuugaguauauaaaaugccuagcucagugccugaugauuauaguagcuucccaauaaauucaauuucuguguuuucuaauuaaaucagugccacucuagcgaguaaucucuaauaacaugccacagaaauuuuguuuaagguuguuuauugucuuuauuuucaauuuugaccuagaugagaacauuaaugacaguaaaauuuauggauaguguaauagcuaauagacuggacaguuaaaggaucagaauucaaaaagaucuugacuaaggaggaguuaugauuauagggcucaguguuaugggauggacgaaugucagggugcaggcaaaaaaagggauuggauugaggcuaaaggagacauagaauaaaauauuccaugaagaaaggcauagugagaauccaaagcaagcaaacuauuccuuauaaaauaauugaauggguuuucacuucuaguaguaggacuaucuuaucccauucaguguuucuuuccuguuuucuuuuuguuagguaguuaaaccucugagauuugaucucugagagguaauaccguagaucuguguuaugauuggucauaaauuccuggagcaaguuucauugcuuuucagaagaaugcugagacucuuaaagcauaugaaauaggauuaauucuuccuugguaucuggggauuacuuccgggacccccauggacacaaaaauuuguagaugcucaaguucuuuauauaaaauacuguaguauuuacauauaaccuaugcauauccugcuauauaccuuaaaucuucucuagauuacugauaauacaauguaaauuguauguaaauaguuauuauuauacuguaucauuuagugcaaacuuguccaacuugcagcccaggauggcuuugaaugcggcccaacacaaauuuguaaacuuucuuaaaacauaagaauuuuugcgauuuuuuuuuuuuuuuuuggcucaucagcuguuguuaauguauuuuuuguguggcccaagacaguucuuccaguggggccaagggaagccaaaagauuggacacuccugguuuaggguauaauaaggaaaaaaaaaaagacuguacaaauuuaaugccgacauaaucaucuguuuuuuucccagauauuuuugauucaugauagacuauauugacucuauucaguauuucaguccauggagguggaacccauggauaaaaggacugacuguacuguguuugaaggacugaagaaaugggauagggacuggggacaagauaggaccugaccaguaauuaagguggagcugaggaagaggcagggguugguguggaauuauuaaccucucuuucacuucuuccaaccauuuucuuguagcugugggucagcaaugguacaaguuaaaaagaagggacacagaugcgggguugggguaagucaaagucuaagccaggcagcaauagaguauaagauuaauucuacugaagacuagcagcaaaaaaguuacuagaagcacucuugcaugaguuaaauuggaaacugcuuauaucuacuuaaaaaaagauauuaaugaacuguagcuuuuuguguuuuauuauuauuauuguuauuauuuauuuauuuauuuauuuuuuuuuuugagguggagucuugcucuguugcccaggcuggagugcaguggcgagaucucggcucaccgcaagcucuccuucccagguucaugccauucuccugccucagccucccaaauagcugggacugcaggcaccugccaccacgccuggcuaauuuuuuuguauguuuaguagagacaggguuucaccauguuagccaggauggucucgaucuccugaccucgucaucugcccgccucagccucccagggugcugggauuacaggcgugagccaccgugccuggccacuuuuauuauuuuuaauugacauaauuguacauauuuaugggguauagugugauauuuugauacauguauacaauguguaaugauacagucaggauaaaugagccaucaccucaaacauuuaucauuucuuuguguugggaacauucaaaauuugcucuuuuagcuauuugaaaauauauaauaaauuguuaauuauaguugccuugcaguguuauagaacacuagaauuuauuccuccuaccuaguuauaauuucauuuaaccaaccucuggcuacagacccuccaccugccacuuugccacuuucuagccucuaguaaccacuauucucuucuaccuccaugagaucaacuuuuuaguuuccccaaagguaaaauaagccaaguucuuaguaguccuuaacuuggacuucuaacucauuugucuuccacaagugagaauauaugguauuugucuuucugugguuggcuuauuucacuuaacauaauguucuucaagugcaucgguguugaugugaaucacauaauuuuauucuuuauuauggcugaauaguauuccauuguauauauaccacauuuucuuuauucaucuguuaaugagcacuuagguugauuccauauuauuguuaauaaugcggcaauaaaugagaguacagauaccucuuuucacuuacugauuuucuuuccuuuggauauauacccaguagugagauugcuggaucauauggugguucuauuuuuaauuuuuugaggauccaccauacuauguucugcaaugccuguacugauuuacauucccaccaacaguggauaagaguuccccuuucucugcauccucgccagcauuuguuauuuuuuguccuuuugauacuagcaauucuaacuggggugagugaauaucucauugugguuuugauuuguauuucccugaugauucauauguugggcauuuuuccauaugccuguugguuguuuguaugucuucuuuuaagagaugucugcuaagcucauuugcccuuugaguuccuuguguguucuggauaucaaucccuugucagaugaauaguuugcaaaugucccccauucuacuagucaucucuucacucuguugcugccuuugcugugcagaaucuuuuauuuugcuauaacaccauuuauuuuugcauuugugucuucuccauaaaaaccuuuguccagacuaauguccugaagcguuccuccuguauuaucuuuuaguacuuuaauaauuuuaggucuuacauuuaauuauuuaauccauuuugaguugauuuuuguguauggugagaaauaagggggcucguuucauucugccuguuuucacagcaccauuuagugaagagacuguccucuccccagugaauggucuuugcaccuaugucgaaaaucaguuggcuguaaauacguggauuuauuucuggggucuuuauucuguuccaguggucugugugucugcuuuuaugccaguaccaugcuguuuugguuacuauagcuuuguaguguauuuugagguuuuauagugugaugcauccagcuuuguccuuuugcucaggauugcuuugacuguucauaguuccauaugaacuuuagaauuguuuucuucuacuuaugugaagaaugucagugguauuguaauagggauugcauugaaucuauacauagauuauuuuugguaguguaguuuucauaaucuucuaauugugaacaugggaugucuuuuuaugguguuuuaugguuuuuuuuuagauaucuuuuaccuucuugguuaaauuuaauuguagguauuuuauucauuuauuuauuuuuguagcuauuguaaguagaacugcuuucuuaauuucuuucucugcuaguuuuuuguugguauauguuacugauuuugaguauugauuuucuguccugcaaguuuauuuaauuuauuuaucaguucuaagagguuuuugguggaacuuuuagaguguuccacauuaacaucaugucaucugcacauaggaacaauuuuucuccuuuccaauuuggaugcccuuuauuucuuuuucuugccuaauugcucuggcuaggacuucuaauacuauguuaaauaagaauggugagaaugggcacuguugucuuguuccauuuccuauagggaaagcuuucagcuuuuucucauucaguaugcuguuggcuguggguuugccauauauggccuuuauuguguccuucaguaccuaguuuguugagaguuaucaugaagagauguuacauuguauuaaaugcuuuuucugcagugaacucuguagccuuuagaagauuuuuuuaucuugaguuauuuuauguuucauauucgguuuugucuuaauuuaguagaauuucuguggcauauuuuuauaagauuauggauuaauuuaauuucauucuuaaagaauuauguaaaauguuaauacucuuuuuuuauaguuagguuuauguauguguguuuuuguuaccuuuucuuuuuggaaucucauuuuucauguuuuucaaaugcuauaaaaccugccgugguuugucaccaccauagacgcaguuuguacugucaaaagcaaaacagagagagcuuuaaacaggauuuuuuucccccaaaaauguaauuuuaaggucuauauaaaagucuuaaaguacuauuuuuaauaaugcuuauuuuuucaacauaaaauuaaauaauauuggcuaggcacaguggcucauaccuauaaucucagcacuuugggaggccagggcaggaggaucaugugagcccaggugguggagaccagacuggggaacauagugagaucuugucucuacaaaaaaaaaauuuuaaauagcuaggugugguggcacauggcucuguagacccucuguagucccagcuccucgggaggcugagaugggaggauuaccuugauuguaccacuacacuccagccuggaugacagagugagagccugucucaaaaauaaguaaauaaauuaaauaacacucauuauuuaauucauauggaaaaugaaaggaaaaaaagcuucaaauucacuaccuaaggauaacaacugguaaaauuuugguccauuuuccucuaauuaguauuauaaauauuuuuuucuaaagcuaauauuacuuuauuauaaauauuuuauacuauaaauauucaugugucuuucccuugaaauuauuguguguauuucaaaaaccguugaaugauuuuugaaaauguuuucuaucacugaauaauauuucaugguaugauuuuauuuuauugguuugugguuuuucaauauuaugaaaucacucuaaucuuugcauauaguauuuaauuuucuaauauuucuuaggaaauaauccuaaaaaggaaauuacuuguucaaagagcaugaacuuuuaaaaaugcuuuugauauauguugcuauauuaauucccaauuuaaaaugacugcuuuagcacaaucuagccaaaauucucuauguuauuuuauccauauucuggcauaaauauggaggaaacucacuacaaaguugauaucaaacaaggauuauaauaucuauauggagggccuucugcuuaugagaaagagaucuauuacauauuuucauguauuugcacuauaguuucaccagcaacacauuuaaguuuuuagauugaggaauaaauaaaccaaagaauguguagagccccuacaaguguaagcuaauuuuuucacaacuucuaguacauuuuaagcacagugaguauaguaaauguuugauggaguaaaaugagugaauaagccucaguaacauauuuuuguuuucuugaauuuaauuauuuauguuuaauucuuuauccaguuuucuccuucaaaggaaauuuaaauaaacuuaauaacuaauuuaaauaauuuaaacacuauuuuucuaacuacuccagugcucuucuugagcuuuuuaaaaaacucguuguuuuugauauugaaagcuuauuuuaauuugugaaaaguuaagaggucccucugguggaacauugaagaaauacauaguuuauauuuccgugaaaauacaugauugguuuuuaaguuagaugguagugacuuuguauaacuuuuuauggaauaauguaaugaauggguuuacguuccuagguugcuuucaaaaccuucuuaaccuuuaacacaaugaauauguuuaagauuugugaagaaaauaauaggaaaguagacagcugcaaaugugucaaauuauggggcuggauagacuuuuauggccuagaaugcuaauuacuguuaauaaaagucuguguggaaaaaugaguguucugagaaguggagugagggggaaauuuuaugauaauaauuaagguuuauaaaguacagugugguacuuucuauauguuaauucuaauuucagaaugauccaacaagauaggugguauuagacccauuucauaaagaaacuaaaccauagaggggcuaauaacuagaguauccagcuacuaugugauggaacugggaauagaaccaaaguacuugcucuuuucuauauauuguucugccucuuaaguggauggaguggauucauaauccuuagcuccagcuauugagugggcaagggacuggugcuauuaaggguuaggaucugaaaaaguggucaaaguagauacaucuggauagguggcauauuuuucacuugucccauuuaagguuguacauauagcuaaucuguaauggagccagcaucugguucugggucuacuugauucuaaagacuauguuuuuuucuguuauucuagcaggugaaagaucauacaauucuuacugaaucaggaguuacauccuguucagcauuguggauuucuguguguuauauuuuaauuaauuuuaaaaggugccaucugaugcauaguguagaucaucucacaguucacuagaauauucaccagcuggaaggcugcauggcuauuacuguguaaauuaucaguuucauaaacuauccauauuagguuuuuaguccuugcuugauuucucccuauaccagugccuuuuucccuucuuacuaacuaaaguuuuguugccuuauuuaaugaaacaguauuauuuuuguacuuggaaacuguaauccaaguucagagcaucugauguggguuuuaaaguacacauuuuugacccacgauuuugaaaauaaagaacauuugggagaguucauggggguaugcgugaguacacacauaauguguuagauuuaagauuugggaaaauauacuucaaauuuagaaagauuuacaugaagcagucagugguauacugacugagcucuugccuauaaguaaauaguaauaaacaauaguaauaaaaguugugccuuaaaaauuaaaaacuuaguuucuuccugauuuuugucaucaguuauuggaaaauguuuguuuuaugaugcuggaaugccuuaccuuagagguuagcaagccauggcuuaugggccagauccagccugccuguuuuuguauggcuugugagcugugguuuuacaacaguuuuaaagcuugcuuuuaaaaaagaaagaaagaaauuuauauggcugcacagcuuaaaguguuuacucucuggcccuuuacggacaaaagaaaaagcugaccaaccccugccgugcccacagcuuuccagguggcuacaaaaagugaauaauaaaacaguuuaaacuguuaaaaucagguauaugcuauguaugcuacaguauuagcaucaacuauuuggcacaagcaaauaauucaauuuuugcuuuuauaaaaauuccauuuucuaauacucuagaaugccguauauauauuuguggaaauaguggcauauuuuagaccucaacaccccauuaaguccuuaaugagguuuuaaauaaucaauuguuuauugagaauguguacccauaaaaugaacauuccaugguuuucuuguauuccagauaaugaguggaugucaagugauauuaauaaaggaaaggaaaacagaaaaagggaaaauaacaacagauccucuuuucuuacccuuacuauuuuauaacuaagagauuuaaggccuucauuccuccucguacuuagcuuuuuagaucuguaggugucuuuguuaauuugaaccauuguguacauuuuuuaaggauauuugaugagaacaguaauauuuauaaugucagccuccuaaaauuuguauauuuaaaauuugcacuaauaaccuugggaguuuguuuuuauguuaucugaaacuuauguuuauagucuggucuucaaagacuagauuauacuuguccaguauuauauguaguaaugcaaagcaugccaugauacuaggcaaaucauagcaauacaagcugaacagcauguauauaaguacaaguaaauacaacauuuauuucauugauuuuuaauauaugcauguauuugaaggguacuauguggcaucugugucuuugaagaacuaaaugaguacaaaauccuuuuuaaaaauguaugguagugacaacauuacaaagaagacuaaaugcaauaauguugucuucagcuacacugauaaccuauauuaaucuugcuuuguagauuuucauuuauauacaaagugauuucuaguaguauauuuauaacaauugaaacuaauugccugaaauuauuuuguguaacuuuauugcauaauauuuuaaaacaauauuaaagcaaauaaaaaucacuuguauccucauucuugugcuacucauaugaguacauauauuuuauaauuauaaauacaguuggcccuacguauacauggguuuugcauccauggauuuaaccaaccguggaucaaaaaucuuaguggcaauaaaaagaaaaaaaguacaauggaaaaaauacagauuuuaaaaauacagcuaucuauauucauuuauauuagguguuauaaguaaucuagaaaugauuuaaaguauaaagaaugaugugcauagguuauaugcaaauacuaugcaauuuuauaucagggacuugaacaucuguggauuuugguauccauggggcauccuggaaccaauccucugugaauacugagguaugacuguauauauaaauuaaauguuguaguuuuauuuuuuuaagcagauagcuguuuagcucucaucaugauuauuucuaaguucauaauauccauugaaaugaucucauauauaaaccuuuuuucaaucauuaaauacauugucugcaauuuuuuugauguuuguaaaugcuauaauaaacacccaagcuuaaaaaaacagauggccuauaguuaucuucaccaucuuaaaaauccuaauaguaguuucauguaaugaugccuaacaagauuaguucugcuuuauaaaacuuuuuauuacauuugcaaauuugauacauuagaauaacuuaccaguuuuauauuaggaaguaaacuauacugaucaaaugaaaaccuuauaauuuccaaugcuguugaagaaucuguugauaaaauacaauaggacacuucuuagaaaaaucuuuuuuuuagagagaauuugaaaugacuuuuuauuucuguuuuuagaaauucauuuuuuccucuacgagccaggcacaguggcucaugccuguaauccuagcacuuugggaggccaaggcaggcggaucacuugaggccagcaguucgacaccagccuggccaacauggcgaaaccccaucucuacuacuacuaaaaauacagugauuagcugggugugguggcacacgccuguaguaucacaguuacuugggaggcugaggcacaagacugugcuugagcccuggagauggagguugcagugaggcgaguucgcaccacugcacuccagccugggugacagagcaagacucugucucaaaaaaaaaaaaaauucauuuuuugcucaaaagggacauaaagacauacuaauaauacaagcuccaugaacacagggaauuuuucacuguguuguuuaugcugcaccucuaguuucuaaaauaguacuuggcacaugguaaagguguuuauaacaguauuauauuugauaaauuuuuaaaaauuggacauauucuaaauguucauuaauaagguguugauuaaaaguauagaauaaucauacaauggaauacuauuuuguugaaaaaaauaggguuuuuuccauguaaacugacauugacacaauauuuuguuccaugaagaaaacaaguagaacaguaguauguguaauaugauaccacauuuauuuuuacuauuuuaauuuaaaaauacucuacccacacauagcaguucuuaagcuuuuugguucccuauaauuacugaggacucuggcuuuuguuugugggagauauacauuuauauguuuuuguuucuauuagaaagauauauuuacuuucuaaugguaaauauguauuacaaauacauguuuauauuaaaaauuaaaacugaaaaaaauuuauguauuuagaauaagaaaaaugaaucuauuauauguuaacguaauguauuuuuaugaaaaauaacuuuuccagaaugaaaacauucaaugagaacaguggcauuguuauauauuuuauaaaucucuuaaauguguagcuuaauaaaaggugacuggauucuuaucugcuucuuuauucaaucugucaugauguuuuaguugaaguaugucaugaaaauccagccucacauugauauguagucaaaacauuggaaaguauuuuaguugccuuuucagguaauuguagauagauauuuucuuugauaccauaccaaaccucuauaaguaguaguuucuuaaauguuaguugcaauguggaaugucagacugugccagugaacuuuuuguacucuugucucauaaaauccuuuuauuuuguacuuugaauggaucuuuuaccuaugcgugauugguuuuuauaaaaaucagaauuuuucaaaugcauuggucauuuucagaugcauuggucacauuucauuauuccauaucaaaaaacugcauuuguuaaugucacacaaaucucauuggaaaggucuucaaguauugugaaguuguccaggucacaaagaugaaugcuaguuuuucaaaauucuacuuuuuacuugaaugcucaaaucuuauaauugguaacccggucaguuuuucuuuaguugauaggcuuacugcuuuuauguguugagaauacuugucugugaaacauccaaaucuggaagaguuugccauuuauuuguucaucuauaaauaauauugcauuuuuaaaagugguaaauucacucuuaugauggcacugauaaacuaaugauaaaaaaagaacuuccaagccaggcgcaguggcucaugacuguaaucccagcacuuugggaguccaaggcuggcggaucacuugaggucaggaguuuaaguccagccuggccagcauggugaaaccucgucucucuaaaaguacgaaaaaagaaaauuagcugggccugguagcugaugcuuguaaucccaacuacuugggaggcugaggcaggagaauugcuugaacccaggaggcgggggcugcagugagccaaaauugucccacugcacuccagccugagugagagagacucaguucccaaauauguaaaauauaaaaaagcaaaauauuaacacugauuauauuggaguagugggaaaaugcuaacuuuuuuuuucuuuuuucucauucuuuuuaaaauuuucuguaaugaauauuuuauguuauguaguuaaaauaaaaauguuauauagaguguguuauaaaggauacuuuacagagagucgaauguagauuaagaauaguuauuuuucucuauuuuucuuguuaggauuuagguccugaauaugaagguauauuuaacacuucauugcaguggaucuuagaaaauggaaaagauguuggaauaagguaaaggaucugauuuccacuuugaccauucuguacugggagaaaugguuuuugacuuuaaauucuaccuuacuuauuuuuaaauagguguguugguuuuggcccugaggaagaauugacaaauauaacugaugugcaguuuuuacaguccacaagaccacugaugucuuuuuggugucguuuucgacgugcuuuuguuacuguaacucacagauuauuguuguuaugcuuagguaaguuguaaagauaagaaaugagauaaauugcagccugaauuuuuguguguauuucacuaaaugccagaguugagaauucauuuuugugaugguugccacauaagucacagcuagaugucuucacuaaauauaauaaaaauaaugucagaaucauucuaaaggcuuagaaagcaguaauauaaggagagguagaaauaaaacuuuguuauaagacugucacagaaaaacaaguguggucaguauauacauagaaaucuacuuuagaaaguagaauugaaaaauacaaaaauugagcuuauuuuuaaauaauaaaguguuauaaaguuuauuaaaauuuaguuuuuaaaauguaauuuaccuacauuuaaaauuuuuaucauuuuuuaauugauaauagggauuuaggugagaguuguuuuuucauucuuucuuucuucuuuaaaaauaauucauuuuggccagcuuuaguggcucacaccuguaaucccagcacuuugggaggcaggaggauugcuugcacucaggaguuuaagaccagccugggaagcauagacccuaccucuacaaaaaaauuuuuaaaauuagacaggcauaguggcacgugccuguagucccagcuacuugggaagcugagguaggaggauuucuugagcccaggaguuggaggcugcaguuagccaugauugcacuacugcccuccagccuggaugacagaguaagacccuaucucaaaaacaacaacaacaaaagaaaaauucauuuuacuuaaaguaagauuuaguauguuuaaucucaugagguucacuuuucuagucguuuuaugcuucaaaggaaaaaaguuugugaaacauaguuauauauauauauuuuuaaauaguaguuagaauuuaaauguucacuuaucaguguaauggaagaaaugcuuuuuucuagaaagugaaucuuuggaaaauguucaguauuaaauuuuuuuauguaguuuuaauuauauagcuaauucagccaucugucuugaagguucauuccguuguggcaguuaaaauaaucacugaaauauuauugaaugauauugaccacaauuuuuaaaauacaaaguauauuaauauuacagguguagugaugguuugugucguucugcguuacaugaaauaucgauggacaaaagaagaggaggaaacaaggcagauguaugauauggugguaaagauuauagguaugauauuuguaagaaucucaacuauuucuagaagagucauugcaugauuaaacuacauuaugucaagugauugauucauuuguaaauuuuauuuauuuuuagauguuuuacgaagucauaaugaagccugccaggaaaacaaagauuuacaaccuuacaugccuauuccacauguacgcgauuccuuaauacagccucaugacagguguguucaaagcauuaugaguucaaguaaaucagaaaauuuaagugcuuucugcaguauugaaaauuauauugagagcugugacccuucucaacuagacuugcuuacugcacagguuuuuuuugguuuugcuuuguuuuuguacuuuauacucucuuucuaaauucucuuccauucuccugauuuugagugacaccuggauuucuaagucauucucauuccuaggcauucuugauucuuuguuguuagucuccaucuuauuuccuuuaauuucaucuugauaaagaaauagaugacagccaguggcugguguuuuacuaauguuuuuuaaguacuaacuuuauuauuaaugaagcuuuuaaaguaaaaacuaaaaugcaacuuuuugaaaauaaaagauaauuccauauccugaagcagcaucuugacccuagcaacacauaaagccaguggagcuuuuggggaaaaaaaauacagauguuugugcucuagcucuggaaauugaaacucagaaaaucugagaugagauauaggcaucuaaaucuucuuugaacaaacuccaugaguagugguaagaacagcuagaguuaacuauuaccucagauacuaauauuucaaaaagaugacaagccaagaugauaguaaauuugccauuuuguucacaugauaggaaaaaaaugaagaaagucugggauagagcuguugacuuccuugcugcuaaugagucuagaguucgcacggaaacacgaagaauagguggugcagauuuucugguuuggcgguggauccagccuucugcauccugugacaaaauauuaguuauaccuucuaaaguauggcaaggucaagguauguauuuuuaaacaucaaaaaaguaauuuucuucuaauuuuucaaaaugacaaauauguguuaagugaaacaguacaauucaaagauguaugaaggcaaaacucucucguucuguuucguagaaggaaucaguguuagcuucuuauguauccuuccacacuuuuaucuuugcuaaugcaaacauaaaugguuuaucuuuaauaaagaugaauauuccuugaaucuugccuuuuucacuuaaugaagcaacuuaguauuauauauauuaacugcauucuuuucaucuaauuucuuuauguaaauaagacacauaauuuauguuauauauacaauaaaauauauauaaacuauauauguauauaagugaagucauaacuuuuuaacugcucuuuuuuuuccaguuuuugccugccuccucuuacuaagaccuuucuauuuauauauuccuccugccaaguaacuuuuguggguaucuuuccauauuuuucuuaaugccuacauaguuucaaaaacauguauaaauaagaaagggguaaguuuauaggggguuuugaagauuggcugucauauguacccaaaccuuuacuacacagaaaagcagaaaacaaugcaucagaaaauuaugacuuuuucccuauaaaaguaugucaguauuugcuaaacauaguauuuguggaaaagguaaguuguuuuggacaugcaauacaaaguccagucacuccuuuuuuauucuccaauuaauuuucacuuugaaaaagcuugaauaagaggcuucuuuaaacauggcauaaaagugaugcucugucaggguaaacagcuaaagcaggcagggcuuaauaccugggugauggguuugaguugauaggugcagcaaaccacuaugacacacguuuaccuauguaacaaaucugcauguccuguacauguaucccagaacuuaaauuaaaaaaaugaugcuuucauguugccaaugauuauacuauuuccucuaaaugaugcaugcauuucaguuucccuauaaacugaaaauagagaauuccuuauuuuacuugaccucuuaacaguguuugacaguucagcccuccuugaaacuuucuucacugggauuuggggaugccaccuucuucuguuuuuuuucuccuaccucagacuuuuucuucaguccuuuucuagauuauccucuuuuucuucaccucuagguguuagaguuucucaaggccaucuuuuuuuucccacucugccauuucucccuagauaaucgucuugcugugacuuaauuuaccauauugggauaacucccaaauuuuuuauuuugaaugaagucugguuuucagauuuuuguacccaacuauauauuucuguacuaggaggugggcaccacagauucaacauguacaccagccugauccucuucaguguuccuagucuaguuaaugauaccuuuccugaguugauucugccauaaacuuagggauaauucuuaaucucuccuuuaucccucuuuguccaaccuuucaacaggucaugucauaucuacuccauaauauguccugauucuauccgcuugucacuugcacuguuggccugucuuacccacaucauuauccucuccuucuuagacaacuauaauauaauaauaaccuucuaacuggucaucuugcauucacuucugcuuuuaccugagucuccacauaacaauguauuuuuaaaauauguaguuuuaaaagacagaucucauccuauucuacuccuuaaaacaguugaguggcuauuacucuuaccauaaugcccaaauacuuuuuuguagccuacaucaucuuaaauaaucugacaucuucuguagguuuaucucuauucuuucuacuccagccacauuugcuccuucgugccccaggagcuguguacaagcaaucaccucugcuugaaaucuuccuuuacacaccucucuucacccugcuaauuuuuauucuucaguucccacauaaauuucacuuuuucagggaaguuuuauuuucucauaugagguuaaguuacuuuuaaaaagcuuuuuguacuuuuuuuuuuaaggacuuaaucacaguuguacuuucuuacaugacacucuuuaucaucugucucucccauuaaacuguaaacucuuugauagcaaugacugucuuacucaccuuaacaucuaaccaggggucuggcuccuaguaaaagcaugcagugaauauuuuuugaaugaacugaaugauugaauaccuuucaacaaacuagaacaaugucaaauaguaaaacuaacuuguuuuuuguagcauuucauuuagauagaagaaauucaccaccaaauaguuugacaccgugucuaaagauucggaauauguuugaucccguuauguaaguauuaugaucagggguacauguaacucuuauucugaauauuuggcuggaaaaugcaugauauucuuauaauggugugucuguaauugaaaauguuuuucuucugaaucucuaccacagaaauguuauguuuuucucuuucauuaaauuccaagcaaagauuuggccaaaggacacuaauguauaaagauuuguaaaacuuuuauaaaucuuuguauuccuuaugaaucgucauagcagauagauaaaugcuugaggcaaauuaaugacucacaaugacaaagaguacccuuuauuaaauguguaagucauuauacaugacugucaauauuuuugccucaguagaaaauauagauacaaucacugcugcuuacaaauuucaaaucucaaauuguaaaaaguuuccuacaaagauguauauaccugcuucucuacaaaguccugucuccacuugucaauauaauauuugaagaacuuuucagacuuuauaauuccaacaacauaugcuuccagagaauagcacagucaaaagugacugccuuagaauucacaguauuucauauauaagcuguaauaguucuuagaauuagcuuccugagggcacugcuuaucuauccagugauaguacagaucaaauucuguuuguuuuaaaagucccaacaguggcaauuacaauauguauacaauacccccaaagucucaucuaaucacucauugaugaaauuccaaauaagugacagcaaaauuggaaaugugaggaagcaguaugcacacguguuugcacgugggcacgcgcacacacacacacacacaccccccccacacacacagagacaaacaccgccucuauuuugcagagauagaaacaauuaguagugugaugauaccucuguugggaaucuuaccucaugccuuaggaauuggcaaguccacuauuuuauuaccuaagaugaaaauuugugauuugaagugaagucacuuuccucucucuccugccaucuuugucucacaagcaagacaaaugucccuuacuacagcagaaacaccuuaaaacugucauuauaguaaggugacuguacaaaauguuaguccuguaucaauuauuuuggaaaagagaagcucaaauguaguauuuacuaagaauuuucuuuaggaauuugaaccuaucauuacaauuaaagaaaauaacauucggcugggcacaguggcucacaccuauaaucccagugcuuugggaagccgagguggguggaucacuugaacucaggaguucgagaccagccugggcaauguggcaaaaccccgucucuacaaaaaauacaaaagaaauuagccagaauugguggugugugccuguagucccagcuaucugggaggcugaggugggagaaugguuugagccugggaggcacauauugcagugagccgagaucacgccacugcacuccagccugggugacaaagcgagacccugucucaaauaacuaacauuuaacuuuuacaacuuuaauaaguucacaacucauuuaaaguacuuauuaacaauagaaagaaaacagaaauuacuguaaguacacaggauuuuuaaacauaggaaugacccaauccauuuauucugcagcggugggcuagucuuucauugccucagcucucugcacucuuuuuuuuuuuuuuuugagacggagucucacucuguugcccaggguugagugcaguggcgugaucucggcucacugcaagcucugccucccagguucacgccauucuccugccucagccucccgaguagcugggacuacagacaccugccaccacgccuggcuaauuuuuuuuuuuuuuuguauuuuuaguagagacgggguuucaccguguuagucaggauggucucgaucuccugaccucaugauccgccugccucggccucucaaagugcugggauuacaggcaugagccaccgcgccuggccagcgcucugcacucuuuuacuggaaagugggaggagggcugagacuucugaauuguaauuuuuaaaucuaccuccuguuagucaacaagcauuuacuuaauaccaauuaaaaucguaugugguuuuaaaacuauaccaauucuaguaauauauauauguuguaagagacagugaagaauuuuuaccgaguaggaauaugguuguugauuuuuguuuucauuaacuuuuagggaaauaggggaucaguggcauuuggcaauucaagaagcaauuuuagaaaaaugcagugauaaugauggcauuguucacauugcaguagacaaaaauucacgugagguaaaguaacuuuugguauugaauuucauguuuuggauuuguugcuauuaaacuaagacuauuuucuuucuuuuuuaauaucacaggguuguguauauguuaaaugucugucuccagaauaugcuggaaaggcuuuuaaagcauugcauggcucuugguuugaugguaagaaauuugaguacuacaaacauuuugaaaagauaguuauaguuuaauuuuaaacuauaccagauuucaaauaaaagaauuuagguuagcauuuuuuugaguaauaauuuuagaugacuuuauuuauguuuugugcucauaugucuuuuaccacaguuaauuuucugcaaauauuaaacaguuuuacugaucuaaaauauuauuuuuaucuuacaacagggaaauugguuacaguaaaauauuuacgacuagauagauaccaccaucgcuuuccccaggcucucacuuccaacacuccauugaagccaucaaauaaacauaugaacuccaugucucaucuucgucuucggacuggccuaaccaauucucaaggaaguuccugaaaagauuuucuuccauuucuaagacuguuauuuacaauaggaaaauuccuguuuggcuuuuugucuuccuuuuuaaaugcuuuuuguauguaauauuuuuauugaugaauacaucucugaacguuccagaagucuuaagguuccaaagggauuuagcagugaggcagcaaugcugaguagguaggauaauuauuucauucaguuuuuggagcucaguuaagccaauacauuuaaaguuuugcaugaggaacacugacuuuauuaagcauuuucagauguggugguuguauuuuugccccaagaaguguuuggauaaccacacaaaagcaugaugaaaaggcuucuuguagucccauaauuucuugugaacuaauguugugaauuuuuguauacagucaccugcauaguuccuacaggcuaaugugguaaaacuguugauuucccaauuuaaccuuagguuucuguugcuuauaagcgauucauuugcuacggcuggaauaugggaaaauuaauuugggcuuagugguuacaaauauguguaaguggauguauauguacuuaaacuggcuuuguauauauguauaaaugcuggugguggugaaaguagucuuguuuuaugaggaugucugcauuaaagcaguaaaauaagcuuuccauuuuauucauaaucuaauguguguguauauauguauguguguauguguguguauauauagauguauauauauacacacacagagauauauacauauggcuguacuuuugcauagaucaaacagccaaacaccuggaaguauuagauacaaguuuaaaauaucuuuuauagguuuuauauaaaaaugucugaguaugauuuugugugaaaguucugauaccaguuguaauagagucaaauuuaugugagcaauaaagaagaaauuggcagauauuggaaaaauauuuugugaaaagcuguauuuauuauaaauacuagggccaugacauaguaccauugggguuaagucauuuucccaaucuauuuauaauuuaaugauauguuagugccucuguuauaugucaaguuuaaagcagggcacauuguugcagcaaaauguguauuugacaaauuauacuugcaauuuugggucaugaaaguuugcaauauaguaaaugcacgauugacuguugcuuugugccucaguauuuaauuuguuucaguaaacuuacuuuauuacuguuuaugauuucagauaaaaauaguugcugaguaaauuuuacuuguaaucuacaauuggcuuuuuaaaaauaaccuguugauauauaauugucaguccaaaugaauaugugaaacagcuggaauuguacaaauuuugguuguauuuaaagcucaguuuccuuuuuguuuuauuguaugcguuggguuugcagcaugaacuugcacagauaaugcacguuuucugguuaaguaaacaugaugcacacuauucuguaacagaaagcccuauugugccuuaccugugugcuuuugugggcaccuuguuuaugaagaauaaaaaaugauuuguuaucugaagagaauaaauuuuaaauucucaguuuaugucucagaugcuaacgugugaaaauauaaauauauauaauauauaaaguaaccagucuuccuguauuuuaugugcaucauagugauuuaucugagcuuagugacccccaucuuguaaccuguugcaagagugaauguaaaaaauaguuguggcauuuuaaaaggucgccuuugaugcagaugcaucuuuuucuugcuucuaaaacauauuucauguaaacauuguacauuuauuauuguaauauauacuauuaugcagcuuauuuuaccugaaacuguuaagccgaccaagaucccucccugcaagacagaugggaauguguauaauaacuagguauuugagaaguucugaaguuugauguaaucuguuacuuguccuguuaaaaaaaggaaaaaauucuaauuaaaaauuuauuaguuuuuuuuuau

SEQ ID NO: 16412 - RNA, 46004 nt, Homo sapiens
ugucccuggcucacgugaucgcgccuagggagaaaacgucugacuccagccaccggccuucaaggcacggcuuuuuauuccuucggcuggucggccucucgcccuucagcuaccugugcgucccuccgucccgucccgucccggggucaccccggagccuguccgcuaugcggcuccugccucuagccccaggucggcuccggcggggcagcccccgccaccugcccuccugcagcccagcgcugcuacugcuggugcugggcggcugccugggggucuucgggguggcugcgggaacccggaggcccaacguggugcugcuccucacggacgaccaggacgaagugcucggcggcaugguaacucuucuguuucugccccgccccucuaucucuugggcugacuacccgguuuguugcucucuuucccgguccccaccacccuccuccccgaacuggcugucuuauccuuggguagguuugguuuucccaccugaggcccuuuaugccgguguaagggacugcaauacucuuuuccuuucuggauugaggcacaugcguacagcacacagagcuucuagucuggaccguacugcuguggaguuuacguuaauaucucaagauaaacauguggagaccaguggaggauggguugaaccaaugaggaucaggugcugucuaagagcacucaaggccugauuguuuuucuuuuggauuagaggaucacagacaaguccaguccccuuuaugagggaccuagaccaccuccacguuugugccuguauacaaugucuguaucugaugucaauaaaaauaagccugggccgggcgcggugugucacucauguaaucccagcacuuugggaggccgaggcgggcggaucagaaggucaagagaucgagaccauccuggccaacauggugaaaccccgucucuacuagaaauacaauaauucuagcugggcgugguggcgcgcagcuguagucccagcuacuugggaggcugaggaaggagaaucgcuugaacccgggaggcagcaguugcagugagccgagaucgcgccacugcauuccagccuggcgacagagcgagacuccgucuccaaaaaaaaaaaaaaaaaaaaaaaaaaaaaaaggccugaagugaacuaaucugguaggccgaccgucgaacuauugaggguguguguugccucacaagaaucaagaaaauucaauuagugugauugaacaccugacuguugcauuagagacugucaguguuucauuuucuaucuaauggguguugucacaagacuucauuuuuuuuccagaguaaauuuugcuuguguauugcagaauuauggaaugugugaccuuuggaaacauccacuccaaccccuuccccauggaggcccagaaagcaacuugcccaagacaugaguaguugaggcagaguccucugacccuggguucagcauuccucucuucgcuuuaaaaccaaaugcuuuauugcuuucuucguuucaguucucuuuuugcuuucagcugaaugcugagacuaugaaauacuccaggcaagacguuccuaacuuuucuuguguaguuacacacccuagcucaguguccuucaaaccucuggucccaacccuugagugaguuaugaaaucaguuuagugaguaacuaccaacauuuuuuauuuccucuggaauagaauagaauagaaaagguccaugugugugaguguguguguuacacuugauaaagguaaucauuaucuaucucucuuucuucccgaguuguaaaauauauuucuuagguugaugcucaagagcuugagagucuuuuauagcugauguuuuaagaggcuugcauuuugacuacacauuucuuccugccauauaugcuucauugucuguuaguuucuaccaagccauguugacauuggucuuaauuuaauuuuccuccuacacuuuagguucacuacucuuccaacuacugcacuuacuugucugcucacaaaauuccuuuuuuauuaaaaaaaagaaaauguguccuugaagaguguuuuguccagaaaaagcaagccuucucuagcagugacuuaaguacucaguuaaaaggucaggcuuuuuuagguguugaaaacaaaauugauuacuuaaauauaagguauucagaguuguuucuucaauucuuauaaaccacagcuguagucuguguguauuugaggucucuuuaguauguuaauccaauuugcuucguuaagccaguagcagauuuuuugagucagggucuugcucugucauccaggcuggagugcagugguacaaucaaggcucauugcagccuugaacuccuagucucaagcaguccuccugccucagucucccuaguagcuggaacuacaggcacaugucacuacguccagcuaauuuuuaaauauuuuguaaagacaggauuucuccauguugcccaagucggucuugaacuccuggacucaaguaacucuugaacuccugaacucuugaacuccuggaccucagccucccaaagugcugggauuacaggcaugagccacugucucggcccagauucuuuuuuuuaauaaguguuucuacuggagagagguaccaaaauugaguggagggcauaagucaaacuuaauguuccaaacucaagaauucuggcuucucuucuaggcuuuuucagaauauucuaccacuaauugucaaacaggacuccaaggggaagagcuaggacaagagcauuugagaacuuacuuggagccgagcagaguaugaggauuuuuauacuugugcuucagucaucacaggaguccucugcuguacauaguauccuuaucuuaaaaggaaacuaaaacuggaaggugguuaagugacaugacuaaguucauauagcuaauauuggacaaagccuggguaucuuaugaccucagaucaccaugcuuuuucuccuauucuagaauacugugauaauaaucagauuucauuccacauacccacaccagcauaaucacaccauaggucagagagucugcaggugacauucggggaugccagugacaucauggaacuccuuaauuuacauguaaaacuuuguguauaauaucuucauuuuuguggaaagagcucuaaccuaaaaaagauuacagauugcugccauaguuggcaaaauaaauagugguuaacccccaccaaucucacucaggucaaaggauuguauauagcauuuacaacaugauuuagauuuauaguggaauuuuucaggcaucuuugaaaugcucuuuuauauaguagcaucgucuuuaacauuucauuguauuuguuccagguaucugugggacucuguuuuuauuuuuuauuuugccaggacacuguucuuaucacuuucuugauuuuauuuaaacaucauuauagugugguggacacacuguucuucacagaagcauaagcugcucuuuuaaaaauaauucauggccgggcgcgguggcucacgccuguaauccuagcacuuugggaggccgagguggacagaucacgaggucaggaguucaggaccagccuggccagcauggcgaaacccuaaaauacaaaaauuggccgggcaugguggugcgugccuguagucccagcuacucgggaggcugaggugggagaaucacuugaacccaggagguggagguugcagugagcugagauugugccaccgcacucuagccugggugacagagcaagacuccaucucaaaaaaaaaaaaaaaaaaucauuuacucuaagaaaagugacauuuggccaaaaccacaggcaagugaaagaagaaacuaugaugaaagguaggggaagaauaauuuuuuuuuuuuuuuugaguuggagucuugcucugucacccaggcuggagugcaguggcgcgaucucggcccacugcaaccuccuucuccugaguucaagagauuccccugucucagccucccaaguagcuggguuuacaggcacccaccaccacgcccggcuaauuuuuguauuucuaguagagacgggauuucaccauguuggccaggcugaucuugaacucuugaccucaagugauccgcccacuucagccucccaaaggggugggauuacaggugugagaauaaauaugucauugcuucacugaaagcaaaacaauuuccauuguuagccacagaauuaucagaauugucguuucagagcaacugugcauggaaccaggaaaguaaaugauucuuuaggguuuuaaugaaaaggguucugcuuggggugaguagaguaacauguuugcccacaugaaggcaugaaguuggcugcugcuuaaagacuguugcauggccuuaacuugaccagccacugucuuugcuucgaucuuaaggauucauuuuacauucuaauuagcauagagacacaugacacauuuugaguagugugguuucuuguuugggacuuuuucaauuaagcacggauuaugguugucuuuuguacuauaguuagcaguauaaagauggcaguuaauaaaaacuucuuuuuuuuuuuuuuggagacaaguucucacucuucuugccuaggcuagauugcaguggugcagucauagcucacugcagccucgaacuucugggcacaaacaauccucccaccucagccucuuaaguagcugggacuacgggcaugcacuaccaugcccagcuaauuuuuauauuuuuuguagagccagggucuugcuguguugcccagacuggucucaaacuccuggccucaagcaguccuccugccucugccuucuaaagugcugggauaacaggugugagccacugcaccgggccuaaagucuaaauuccuauguggcccugcaucacugacuccugccugccucucugaccucaucuuaccucacucucccuuuuccucccuaagcugcuuccaucaccacacuggcuucucuguuuccucccaggugccucucuccuuccucuggcagcccuuguacuugcuauauacccagccugaaacaucuucugaauuuuugcaugacugacuccucaucgcauggcucuccguacugaaguuaccuccugagaggccuuuucugaccacccaucuaaaguaguuccccuuucuucccaccagcuguaaucacaucauccugguuuauucucuucauagcacuuaccaccaccugaaaugacugauuguuuaccuguuaguuguuuuaaguccccaagagugcagagaucaugagggcgaggaccaucuauccucuguccaccacugccuagauuaaugccuggcacguguuguguuuaauaaauguuauuacacagucuuacuguaaaucagauauucuuucauaauuuuacauauuuaucagacaguuugacaauuaagucccauacagucaacucugguccuuuucuccacuuacucuuugaauccucauuucaccuucaaauguccucacaguaacucagguguuuuaucaaaccaaugucucaugaagcccaguauucuuuuccugaggaugguacccagugaugcuuugaggagaguauggcugacgaccuugcuucggaaggcuggcgaagaucuucugcuucucuagcgucucuuggcagccucuucuggaucuacucaugaaauuaucagagcuuuuuuuggauaaguuagaauccucauccuuuugaguuuauggauuccguagguuuuguauuuauauaaaacaauggggaaaagucauuuauacauuauugaaaaugaggcuccuguuaaccuacuuauguauuuagauuagcaaucuuuaaggaauuauugcacaacaaaauauacuuaaaacugcauucaauauggucuuagguuucaaagguaucucagaaucaucgugaacugacccauauuacaacuaaaaugaccucuucaauggugcuuuuugcugucuggaaucugaagaauauuaguguuccuuuuauucguauuuaaaugacugucuucauacuuuuguccucauucuagaaggaaguuaauuguucucuguacuuguaaggaucuuagauuuugaacaaaagaugaaaagcaggacauaaaauaguuucugaguagccuuuugccugacaguguucuguguacaccugcuugccaccugguucaaguccuuauccugaggugcuugugggucuaugcagacaacaguaguugguaguugaacagugugugucuggccuccaccacugagugugugagguuugaaucagucucggaguccuggggccuugucuggcuuucagaauccaacuguugucuuacuucuguucuauagggcggaaggcucccuuuauaucauuucccacauccuacuucuaaagauuaauucauggagauaggucugcccuaucugccuuaucugggcgcugaugacuaauaagggcacaaagauguuauugccaucaacugaacuuucccuuccugcaagcauuuugacuuccugcacuuuuauacaggauggagcuggccggaaccaaacuugucucuagaaucauacaagacucucuuuggcuguugcuuagagcugaccauuugggaauaaaagauugaguaagauguaacaaaacaggaauucugggcugugugucucaauuuauuggaagaaauuguuuaauggauaauuacuuacuuuuacagacaccgcuaaagaaaaccaaagcucucaucggagagauggggaugacuuuuuccagugcuguaaguuugaaaguuaauucaauuuuguuaauuuaacuguguuuguauucuaagaagauacucucuucucgggaaucugguaugaucuaugugguuuuuuccuuguuaaaugccugaucugaaggaaggauuuauuuaaugugaauuuuaauugaaauauuaccucuuaucaauugaagauuaauugcagauauuucuaagccagucucagaacuagagaauuuuauuuuaaaccuuaccauuugagguuugaaaauggauuauaaaaaaucaaggaauauguaugcuguguaaacuuuuccuugguaaaaacccaauuaacccuaauagccaaaacugacaaauagcaacacacacaccccauaaauauagaugcagaaauucaaaauaaaguauuagcaauucauuuucaagaaccauguacauaaccaagugaaugguagucuaggaauguaaggguagccuacuaucagggaaucccuugaacaguagcauaguguuauguuuaagugcucagacucuggagccagacugccuagucuggaacacccucucugccucuuuucuagcagugugaccuuggacaaacuauuuaaccucucuggcccucuuccuccccauuuauaaaagggaguaccaaaaucuucuucagaguuguugugagguugaguuaauagguguagagcacuucuaucagugccugacuuauuuuuucuuuucuuucuucuuuuuuuuuuuuuuuuuuugaguggcgcaaucucgacucacugcaaccucggccucuggggaucaagcaguucuccugccucagccuucuggguagcugagauuacaggcacccaccaccaugcccugcuaauuuuuuguauuuucaguagagaugggguuucaccauguuagccaggcuggucuugaacuccugaccucaagugaucugcccgccucggccucccaaagugcugggauuacaggcaugaacuaccgcacccagccaaugccugacuucuuauaguaaauacuacaugauguugguuauuauaugucuaccaacaugauacaaguaagugaaagaaggaaaauugaauguucuucccaauagauacgagaaaguacucugaaauuuuagcauucuuuccugguaauaagcuaucauaagaauacauccugacuaugaugccuauuucaaauacauaagguaaaagacucagggcauugcuguuagggaugaaacagugcuccauuuaauguuguuccgacugucuagucauagccauaagucuuauggaaauaagagguaaaaauauuggaaaaauuauuucugcuuguuuggauuuucuaucuaagaaacacaggagaauuauugaaaacccuuuaaaaucacuagaauucagcaagauaaaaaugaaaaaauaaaaauuaauaacuuucuuccauguaaucaguuagaaaaauagaaggcgggagacaaaauaucucauucauaauuauuucuuuuuauucuauauaaagacagagaaaaggucucacucacuauguagcccgggcuggucuggaacuccugagcucaagugauccuuccaucucagucucccaaagugcuaggauuacaggugugagccaccaugcccagccucauucauaauuuauaaacucucuaagaguaacugguuggggccagaaauggcuaugaccuauguauuuuacaaaaugaugcgagugguaagauaaaaaauauuugauacguagauaugcacaucauuuuauauacauuucuuucuuuuuuuucuuuuuugagacagggucucacucuaccgcccauguuggagugcagugacguagcucacugaagacuugaacucaaacuccugggcucagaugauccucccgccucagcuucccaaguaacucggacuacaggcaugcaucaccacacuuggccaauuuuuuuccacuuuuuuuuagugacagggucucacucuguugcucaggcuggucucaaacuccuggccucaagugauccucugcuuuagcuucccaaauagcugggauuacaggugugagccacugugcucagcuaagacacaauauuauguaauaaaauguuuauucuaguuguaauccuaacaagauuauuugagacucaagugauuccaaaaguuaucuggaauaauaaauagaugagaauaaucaaaguaauuuuuuuaaaaaauuacaguggcucaugcuguaaucccagcauguuaggaggcugaggcagguggauugcuugagcucaggaguuugagaccagccugggcaauauggcaagagccuauaucuacuaaaaauacuuaaaaauaccugggcauugggccaggcaugguggcucacaccuguaaucucagcacuuugggaggcugagguggacagaucaccugaggucaggaguucgagaccagccuacccaacauggugaaaccccaucucuaccaaaaauacaaaaaauuagccgggcgugguggcgagcgccuaugagcccagcuacuugggaggcugaggcauuagaauugcuugaacccaggagguagagguugcagugagccaagacugugccacugcacuccagccugggugacaagagcgaaacuccaucucaaaccaacaacagcaacaaaaacagaggcaugguggugcacgucuguggucccaucuacuuugggaaguuggggugggaggauugcuuaacccugagguugcggagguugcagugagcugagaucgcaccacuguacuccauccucggugacagaguaagacccugucucaaaaaaaaaaaaaaaaaaaauugcucuaccagaugcuaaaauguaauauuaagauaaacuguguacuggccauaaaauugaucagaaaacaaaaagagaaagaguuaagaguugccaauuuaaacuuaagaagucaaacaucuaauaaaaggcaaaaguaaaaaugggaaguauuuguaacaugacugaauucuuccuuaacuuaaaucuuauguaacaagaggccgacagcccugggggaaaaaaaugagcaaagcauaugaacaaaccguucacauaaacacagucaguuaguacauguggagaauguuccuccucaccauuuuuuaaaaaugucaaaucggcuagacacgguggcucacgccuauaaucccagcacuuugggaggccaaggcggguggaucacgaggucaagagaucgagaccauccuggcuaacacugugaaaccccaucucuacuaaaacuacaaaaaauuagccgggcgugguggcgggcaccuguagucccagcuacuugggaggcugaggcaggagaauggcgugaacccaggaggcggagcuugcagugagcugagaucgcgccacugcacuccagccugggcaauagagcgagaaugugucucaaaaaaaaaaaaaaaaaaaaaagccaaaucaaggccgggcacaguggcucacgccuguaaucccagcacuuugggaggccgaggcagguggaucaugaggucaggagaucgagaccauucuggcuaacacggugaaaccccaucucuacuaaaaauacaaaaaauuagccaggcaugguggcgggugccuguagucccagcuacuugggaggcugaggcaagagaauggugugaacccgggaggcggagcuugcagugagccaagaucgcgccacugcacuccagccugcgugacacagcgagacuccaucucaaaaaaauaaauaaaaauaaaaaugccaaaucaaauuugaaaggcaaaaaaacuugcuaauauugaaaggauaauacccaauuuuugcaugagugugugcucaaaugcccauuccuucccugcugguccaaguauaagcuaguauuccuucccugcugguccaaguauaagcuaguauuaccuuucugugaaguggcuuggugauguguaccaauaugauuggguagaauggggaaaaucuguugcugacaguagcuaauggaaauauaauuacaguagggaaaaaaagucuguguccaguguauaaaaugauauaggaaauguguaaagcugcagaucagccugcaaaugaaccacugugucucaauuagauccaaguaguauucuuugucuuugguuaagacccgucucucaccaugcugugcccccuguguauaaauauuauuucuggcugggugcaguggcucacaccuguaaucccagcacuuugggaggccaagguggaaggaucacuugaauccaggaauuugaggcaagucuggacaacacaggaagaacguuaucucuacaaauaaaaaaaugaaaaaaaaaaaagccaggaugguggcacacaccuguacuccaagcuguuagggaggcugaggugggaggaucacuugcgccaggaggucgaggcugcagugagcugugcuugugccagugcacuccagucugggugacagagugagagcucgccucaaaagaaaaaaaaaaacaacuaucucugcggcagaugagacuagaauuacuguuauccugcagaaagaagccacuugagaaagaaauccguucucaguuuguucugucugcuuuaaugucuccacuaugauuuaaagcagcccugaagcaugucauguguagaaaaaaauauauauauuccaugagaaacuacauauuugaaguuagaguauuaaggagcuuuucuuuacucucuuuaacaaugaugagaaguccaucuuucuugugugacuuugucguuuuugcuuccuuuccuuuguaguaugugccaagugcucucugcugccccagcagagccaguauccugacaggaaaguacccacauaaucaucacguugugaacaacacucuggaggggaacugcaguaguaaguccuggcagaagauccaagaaccaaauacuuucccagcaauucucagaucaaugugugguuaucagaccuuuuuugcagggaaauauuuaaaugagguauguugaaugaucuguuucuuuuuuuauaauggcuuuuaaaaugugaauauaauucauguuaauuuuauuauuucaauuaauguuaaaggauuucuugguauacguuguuuucugugaaucugcccauuaaacaaguacccauaucauguaaauauguucauauaaguacacauguacauauuuacaugauuuggguaagaacuuguguauuuauaugauaugggcacuuguucuuccuuucaguagucccaggagcauguauuuaaaaauuguccuaagagugcugcugucugaugcgucuucccuuuuuccucaggaauucuguuugucauguggcugucaugguaucuuuguuuccauuccuuguuaucaguaucuaacugaagauauuuuucgucuuagaaucuuuccucagauuucuuagaaucuuuucugaauuauaacaacuuaaugcuuaauucauuuucugaugugaaacauggcaacaaaaugugcagagauuaguuacccagagucagggucgugcaggucauuaaaguguauggccagcagcugguacaccagccuuguagaccuggauggagggauaccucguggugaccugucaaggcuggauuccaugugcccacauucacacauuggccuuagcuuuuacccaaaguccaagcuuaaaggaaauaguauguucgagaauguuugggguuagcucuuacaguuaaaguggggguucaagacagagaaaauguacuuaugcucuuuaucuguaguugcuagagaucuuaauaucugaucuggauuuucuguuaauucuccccuccccccaauaauuggggaaaucugcaaccuugugaguuuacaggaagaugagucaguuugaaaaggaucaugagaaauaggaacuguggauacuggaucauuugguuggggcuaugggucauaaagagagcuuacacuacuuugcauauuugaaggucaucugauguguauauaaaauuaagagagaucguuaaaguauaaagauuuuguuuucagggauuaaauucugccuuaaguggauggcauuaaaccuuguaaggauaaagugggauaauucugugguuucuuuauuuuauucaucucaucagauaaaucgagcucuaaaaguggguuucaucugcagggcaacugaaauacagauuaucccuuauccaaaaugcuugggagcagaaguauuuugcguuucagauuuuuuggauuuugaaauauuugcaugauacuuacugguugaacaguccaaaucugaaaaucugaagugcuccagugaacauuuccuuugagugucguguuggcacucaaaaaguuuuggauuuucagauuugggauguucaacuuauaauaagucaauagcuuauagucugauuauuugaacugcuuagggucaguuggacuauucagucuaugguaucagcagcucagcauucaccccaugaauaggcugugugggguaggcuguguggacuuuuucuguagugggucagauaguaaacauuucaggccuugcaggccauaugucucuguugcuacuauucagcucugccacuguagcgugaaagcagccacagacacugcacuauguaaaugaauguggcuguguuccaauaaaacucuuuaucgcuguuaaaauuugaauuuuauguaauugucacauuucacaaaauauucuuauuuugauuaacuuuuauauuuuaaaauuguuaaauucuuagcuugcuguucauacaaaagucaucaggccagauuuggcucacuggcuguaguuugccaacuccugcuuuagaaguuccuaggauuauuagcguuuauuuuugacuagugucuauuuggggaaauuagguaccuacuauguuucaggcacuggucuaaaaagauuguaaaauuuccuguuucuuucuggucuggucauaucuaaggacuuguaauugucccuacuuguuuugcuuuucaguacggagccccagaugcagguggacuagaacacguuccucuggguuggaguuacugguaugccuuggugagugauuauugaagucugugacaauuuuaugcagcccuacagaugcagaauauguuuaauuuagcucugauauugacauaacuuuauuugcuuuuacaauuagucauuuuaaaaaccuuaaaauuuauugacuuguggccagguguaguggcucacgccuagaaucccaacacuuugggaggcagagacaggaggaucucuugaguucaggaguucgagaccagccugggcaaaauggcgagaccccauuucaacaaaaaauuuuaaaauuagcugggugugguggcgugugccuguagucccagcuacucgggaggcugagguaagaagaucacuugagcccaggaauuugaggcugcagugagcugugauugugccacugcauuccagucugggcaacaaagagagacucugucucuuuaaaaaaaaaaaaaaaaaaaaaaaaaaaaaagucuauugacuugugagucacuccuuucugggauguuuuuccugcauuguacaagguuuagcaaaguaguuugcuuuucuaccugaucuacuucuggcuuuuaaacuagaaugcauaauugaaacuaugcuugucuuuaauaaaacccuagucaaaaaauccaauucaguauugacuugaguaauuaucuuuuuaaugucuuaucacugcucagaguagaguuuagcccagcacggauucagacuuccacuuugugcacugaccucauaacaaauuugacuuuccucuuuuuaauaggaaaagaauucuaaguauuauaauuacacccugucuaucaaugggaaggcacggaagcauggugaaaacuauaguguggacuaccugacagauguuuuggugaguugcagaagcuuuguagcucuguccuuacaggguuggcucacauuugauugaagacucugccuagaaaaccuauaaucuuauucguuuguguuggguaauauaaaugcacaguaacuuggucuaacugcccaagaguauuuccagcugauuacaaacuccucaggguguuuucuuuguguauaagccaggcucagaucuaaugcucuugaaauuccagcaacaaaucccuuuuccaaagguuaaucucuucgacuacagagauuacuuuguagagguuuuacuuuguaaguguaccuacucuugaccccgguuuuacucacaagcuacaagaugucagcuucacaggccccauuaugaggauggagagauagggauacuggauuuauuugggcauuggguauuuacauauaaaaauuacugaaagcaggugaaauugggacuuuccuauucugaggcguuucuaaugacagucuucaauaguauuauauauucacucaauaguugagcaccuaguguagccaguguucaacaguaaaugaagcaaagucccugauucuguggaaguuaauuuuauuuacacacacaaacacacacagucuuacguguugcaucauuagcuggugaucaguucgagaaauaaguuaggguaugagguuacuuagauaacauuuaagcagaaaccugaaguaggugagaaugagcugugcagaucagggggaagagugcuacagagucagggaauaguaaguaggagggcccugaggcaggaguauaccuggcauauuugagaaaccacaaggaagcugacaggacuggagugaaagguggauggagggauuauaggagauagauacagucaguaucuguugaguuaguguugggaauacaugaaacuacuucagaacaaugaaaaacaacauguauguagcaugcuuucauuuucauaaaguaucuccugauaagcaaaggcaaaacuuaaguccauguauuaaaacccuaguggaauguauuugaaucuaauauuauucacuuagcuacuucagugcauaauuuaugacaucuacuuucuacauauuuucauaagguuaagguaacuuaaucuaccuuucccacuguuuuaaguugacugucuuuuuacauucuuuaaggcaucacauguagauaccauaaucuccauuaguguaaguuaauaguaaaauauccaaguuacuguuuccuucuuugugggagacaugauuucuaggucauaaaaagucaucaagaucuuaauugccuucuuauguugguaugcuucucaguuuuuaaaguauugccuaaaaaacaaauauauuuguuccaacaauaugcuugcaaauggcuaugacauaagaucaugugcuaagauugcuuaaaagcuaguaagacccuguacugucugcucaccagaagacauuuaucuauuaaauacucaucuguuggguaagguaggagaugacaaaucuuuuuaugugucaggcuaaugucuccuuggacuuucuggacuacaaguccaacuuugagcccuucuucaugaugaucgccacuccagcgccucauucgccuuggacagcugcaccucaguaccagaaggcuuuccagaaugucuuugcaccaagaaacaagaacuucaacauccauggaacgguagcuucccccaccacuuguauucagccauacuaaguaucauuaacuauaugguauacuugucaggaagccuuugagccauguaguggguuuuucuucacaauauuuuaaagguaauugcaucugucccuaguacaaccaauaguauaaacuugcauugcaaguacagauaaaguuccugcuacacauccagugagcagcuggagaguugacagggaaugguaaagaaugccaucuuucccaauuuacaggaauaucacucaggcucuccugguaaccucugugcugacucuccucccuccuggcauagccgggacugcaccagccuccugguggcccucacuagccuuugaggcaugggaagaagggguggcacagagcaauaugguuggaaagggaaguugaauggaaaaaugaacgaggugacaugauuaagaaccacaacaacccauguauuugccucacgugccaauuacuuauacuucccuuggcuugguguauagacaguucccugguucaaagacagaaggccugcauugccucagguuuguuauccagaaauuguaauugcuuguaagguuauagaaagaaugagucauaaagucaaacucaguacuaccacuuucuagcucaguacagacuaugagcacgaugcuuaacuucauuuuuucaugugaagugggaguucuugaucccucauggaacuacuguaugaauucaaguacauagaaacaauuagcauauugucuggcacauuauaggcaugugcuuguuaaauacaguuucaaagcugagugaacuguguuuuaaauuagaguacuggccgggcgcaguggcucaugccuguaaucccagcacuuugggaggccaaggcgggcgaaucacgaggucaggagauugagaccauccuggcuaacacagugaaaccccaucucuacuaaaaguacaaaaaauuagccgggcguggugguggacaccuguacucccagcuacucgggaggcugaggcaggagaauggcgugaacccgggaggcggagcuugccgugagccgagaucgcaccacugcacuccagccugggaaacagugcaagauuccaucaaaauaaaauaaaauaagaugagaugagacaagauaagauaaaauaaaauaaaauaaauuaaaaaauaguaaaauaggacgauucucaaucuguguuccaaaagaaguuaauaaaaaguucccauggucaaguaaguuuggaaaguuugaguuaaauaagucacucugcuacaggacuucucagaguuauucaugaucgaaugugaauuucuagcaggagaauaugcuauacagcauuucucaaacuuaauaacacuuugaggagcauaguuugagaucugguggcuuaggguuuuacgaauagagaagagagaauaguauauagggaugucuuuguuuaaaugggagggcccuccagauuuagacuugaaguuuuaggaaauugcuguaauaagauuuuuccuuaggaucuagggugaccgauaucuuggcuaggcaaaacuuagaggaagguagaccagguaugguggcuuaugcuuguaaucccagcacuuugggaggcuaaggcaagaggaucaccugaggccaggaguucaagaccagccuggcgaacaugaugaaaccccaucucuacugaaaauacaaaaauuagacaggcauguuggugcacgccuguaaucccagcuacucagguggcugaggcaugaaaaucgcaugaacccgggaggcacagguugcagugagccgagaucgugccacuguacuccagcuugggcuugggcuggaguguaguagugcgaucucggcucaaugcaaccuccgccucugucucaaaaaaagcaacuuagaggaagguaaaguuauuugcccauuuucuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccuauuugcccauuuucuaauuguaguagaccaaaggcauaagaucagaguuguaaauguaaucucgcuuuagcuaguaguuucccagugacauccucuaaaaucucuuaauacugccaacagagaagccaagaccuuuuaugguuugggaggugcugggaagcugaagaaugagagauugaguuaaucuacagaaauuucuauuuuaggaacacaggaagggagagaaguucugaaauugcuuaaacaaguuccaguuaguuccuucuugcugaaguaugagugaaacgguucuauuuauuaucuacuguaguaauccaguaguuuguuugacuguggugacuugguguuaacauuuuuuuucuucuaaauuuuagaacaagcacugguuaauuaggcaagccaagacuccaaugacuaauucuucaauacaguuuuuagauaaugcauuuaggaaaagguaagagcugcugcuacauaacaaucugagugguuuuaaagacccugcaaaucagcucaugaagaggagaccacaccacauuguugucucugaaacaaaaacagagggaagcaagucagugggagagaggcuucgauggggcaccagaagcagagagauuccuuuacacucaaaugaaugagguggcauuuggaccccaguacuaauuagacugcccauuuuuaggacuuggcaaaagucuugcaaacuugaaccaugugguagaauuuuuucuccugcuuuaaagaaaaggugacuugguugagagagcccauugucauaugugacaaaugacccaaaagcuuagacaagaucaaaauaucugccuuugccauuuggaauuuucaagaaauucucuuaagucaauuuuuaaaaauccauuacuuucucuuaggaaguguuuaguguagaccagggauaagcaaacuuuuucuguaaaggggcagauaguaaauauuaauaggcuugcaggucauacauucugucacaacuacucagcucugcuguuguagcacaaaagcagcccuggguaacauguaaaugaaugagcaugguugugguccaauaaaacuuuauaaaaacagacagugggcaagcuuuggcccaugagucauagcuugccagcuccuaguucaaacaucuuaagcuuuuuuguagcacaguccuaucugaauuaaucuguaauacacaguacugagaauggacaacucuuccuuccgauugucucuacucucaucacuauugccaauaaaaaguaaagcuaacugguuauuuaaaaacgaguuuauuucuuuggaaacaauuaacuuuggaaugaauuaauuauguucuggaauuuucuaaucuguuuuuuacaaugggaaggucuagggaauggagauuggggauuugaguuuugggggagaguguuuugcaauuuuuuuuuuuuaaacggggguuguuuuggauuuuuuuuuuuaaacgggggugucuuuguuuuuguuuuugguuuuuuuuuuuuuuggcaagauagugauaccucagccauugccccugaagucccauuucuaccuucuguucacauccagguggcaaacucuccucucaguugaugaccuuguggagaaacuggucaagaggcuggaguucacuggggagcucaacaacacuuacaucuucuauaccucagacaauggcuaucacacaggucagaggcaggaguagguacugcugugaucuuugagaauaugucuuuccuuuuucacccaaugagcccugggagggaguucuagucuuuuuauaacuguggacaugccagagggaggaucuugcccucaggaccccuccaguuggagcaccacaucauacccacguggagaaaccagguuucauuauuugcuguuucacaugcaagaugacaugguguucuaggagugggagcagagcaugagcuugauggguuggaggcaggccguauggaaggcauuugagauaggaagaccaaaaggagguugucuugggaaaacuuucuugccauucauggaauuuguuuuuuggguguuuuuguuuuuuucaaaagcugcaggaugagucagcucuguguccuugacuuucaugcuuucugcuuggaccuucuguuguuaaaagcaaauguuuucuucuuuccacauauauaaauguccacuugaaugggauucacuugagacuugcuugcauaggaggagaucgcuuaggcauuuaaugcauuauugugauuuuuuuggggggcugguggggggacagaaucucgcucugucacccaggcuggaguacaguagcgugaucucggcucacagcaaucucugccucccagauucaagcaauucuccugccucaaccucucgaguagcugggacuacaggcacacgccaccacgccuggccaauuuuuguauuuuuaguagagauggguuuuugccauguuggccagacuggucuugaacuccugaccucagguaaucugccuaccucagccucccuaagugcuaggaguacagacgugagccacacgccuggccugugaauauuuuuaaacacucaaaguagagaauaguaaaauaaccuccauuauccagcuuagauuuucagcugcaugaggccagucuuuugaauucuuccuacucucccuguguuuuucuuuuguuacuagaagguuuugaagcaacucccauacacaugacuccaggauucaacaccggauuaugcaucugacucugguuauuauguaucaagaugcagaccaccagccucaguggcucacaccuauaaucccagcacuuugggaggccaaggcagguggaucaccugaggccaggaguuccagaucagccuggccaacauggcauaacucuuucucuacuaaaaauacaaaaauuagccaggugugguggcacaugccuguagucucagcuacucgggaggcugaggcaggagaaucucuugaacccaggaggcagagguugcaguaagccaagaucgugccacugcacuccagugugggugacagagcgagacuccaucucaaaaaaaaaaaaaaagaugcaggcaaaguccacauacuaccuuuaguucuuguaucuccuaacucugucauuugccacgaauuuacagggagaagugggucuuuguccaucagaaugucucacauuuugaauuuggcuaacugcugucuuauagugccuuaacuuguucaucucuaguuagcauuuccuauagauugguaguuagauuagggacuugauagaaguuugcauuuucaggugacagugcauccucaccugcugcuguguacuuccuguugcaucaugucaugaggcccguggcaucuggcugcacuguuuuuggagugcugguguugauugaugagucaggugguuucagccuuagcucuuccuaugagcuuuucuguuguuccauugaugauugcugccuaaauucauuauucccucagaaacugcaaaauauugauuuuguaauccuguccuuucuuuuguauuuauuagcugaaauuccucagagaagaacuuccccuuaucaguuauuugguuauuuugagaugcaguuuauucaggaaacacaggauagguguuuuuguucauuugacaguuuuuggaguaaacuucauucaguugugaugaggcugaguagcaugcauaauuuuuuauguauuuguguuucaauacuuuccugucauuauuuuugcuuauuuuguucuaucauaagccagggagucccuucuagucauuuguuuagagaagaugaauuuguuguuuuccugccuuguaguaacaagagacccaggcaaauuucagcuuucuauuaaaacaccagaaucaguagaacaaaguuguuuuaguuuuggcuguggauuaaaugagugaaacauaacaugagcaaggcuccugucuuggcuccaucuuuacauuguguguuuuguuuucaggacaguuuuccuugccaauagacaagagacagcuguaugaguuugauaucaaaguuccacuguugguucgaggaccugggaucaaaccaaaucagacaagcaagguaggugccugacaagcuggugcuguggacagguaggcacuugccugagaaaauaagguguuuccuccugagauaagauugguuagguuccucuucccacuagggcugagcagcagaagaguuuuuaaguggaaacaaugauugcuuuuuuuuuuccuuaacuucccacugcucucuguaucuguauuuucaccccacauauacaugucucauuagaaugcauagcuuuucuuugucuuuugagacuagaucuuuacuuuguucuggagcagugacucucaacagaggaugugcaucaaaauugcccuccgaaacugaagaagaaaaaugguacgugcuugggcaauauccagaaagaguaugauugacucacuuggucuggaauagggacccaacaucugccuuuuuuccuuuugaaguuugcaggugauucugagaggcagccugguuuggggcccacugccuuguagagcagagccccucaggcuuuucugugugugaauccccugggaucugguuaaaaugcagauucugcuucuccauuucugaucagcucccgggugaugucugcugcuggccugaccuugcuuugaguauaaggcuaucaaaaacaugucuucuaggaauuagucuuucccugugcugggcucuuccuuaugaaugcuuuguugcuuuccugguucucucuccuagaacugccauaauaugccacauuguucuguugucuuucccauuugguuucagugucuuuuucuaaacgugguaccuaaugcugaggcacuuuguuccuagcagucaugaggaccuucauccaaaauacuguccuccaacacucaggagaaaagaauugacagccuccaccagcuaugucuucucuccuuccugauaucacaauuucaguuucagucccaguucugugagaccaaggaagaugaacaaauacacacuuuaagcuaaaauugcaaaguggguuuuuaaaugggccagacuuucuggguauauuggguacuuuaguuuaauuuuggagcuugauguuuacuuguuuaaaugucuauuuuucacuuauuuccuuuuaaaacacucuugauggaauucuguuaaaauucucuuggaaggguaaaauggccuucauaauuacguuuuguguuuuucucugaagacccacauuccuaaagcuagucacuuuucccuacaaauuucagugccuucuaaacaggcuuccucuuucaaaggagauaagcaaguuuagaagaccauuaaaucuuaaaaguguuuucuugagguugguguuuggaacugauugaggagaccaugucagcagccauguucuguuuuuaggagcagggcuaccucagcccacaugggaaggaggcugaaugagaucauagugaaaugugucagccagcugccuguggaaaaaacuguuccuuuuuuucuuuaaguuaacauugccaucuaaauguuaaaaaucagaaacuucaccuucucuaagcaaucuaaaugaagucugguuccugagaagccauuucaauaauauagcuaacauuuauugaguguuuaguaugggacaggugcuauucuaaguuuauuaccugauuuaacucauucaauccucacaguugaugagauagagguacuguuaucccuauuuugcagaugaggaaaacugaagcagagaaguuguuugcugaagaucacguagccaaaaaguagcagagcccugcauuugaacuggggcagucuggcuccaaagucuguauacuuaaccauuacauuauaguucagucaacaaguauuuauuaucuuccuugccagcacgguacaccaaggagccuugcauacggcaaggagcaaucaaacaagaugaguuuuguuuuguuuuuucauuuuuuuugagauggagucuugcucugucacccaggcuggagugcaguggugcgaucucagcucacugcaagcuccgccuccuggguucacgcuauuguccugcccagccucccuaguagcuaggacuauagguaccugccaccaugcccagcuaauuuuuuguuuuuguuuuuguuuuaguagagaugggguuucaccguguuagccaggauggucuagaucuccugaccucaugaucugccugccucggccucccaaagugcugggauuacaggcgcgagccaccaugccuggucacaagaucaguucuuaaauccuugugucagggagcaccagauauuuaagcugcaguggucagugaaagccucuuaggcauuuggcauuugagcagauguggauguugagaaggauuuagcugugcagagaucugugggaagaguguccugagcaggacgguaaaugcgaaggcccagauguagggauaagcuaggcuuguucaagagacagaagguagcaguuguacugaacuccuuguacuuccuaagcggaccuucucugucaccuccuggcuuuuguacaagugacuacuccuuccuucuggaaugcccaucucgcgccuucuucagcuagucaaguuaauuguccuuuagggcuuugguuuaccgcucccucugggaagucgcuucauaauccugcucccacaugggguagaugccccuuccuauauguucccagcuggccucacacuugucacacccuauuaaguuugucuuuuucagucuaggauguccuagaaaagaggaacuaucuaaacuuaaaauauccagccccuaacauacacuggggaacauccacauugguugaauggauuuugccaaggucgcaaaguaaguggcagaucagggacugaaaauuaagucugugcauucucagaauuuacauugcugcauugacagguguaauuugagaagcaugaaaugccccagcuuuccccuggcacaaagaaugucggagacgaugggugaugcaucauguguuggcagcauaguugucucagugccagcuguucugugugaguggcacaggcuugugaguugggcauaaugagcugagcugucagcagccuugacagccagaucagugcacauuuaacugacugguggacuuaagcugugugggagaaaugggacaaggucauauguguagaugucaaagauugacuauugacguuuucuccucugacuaguuuagcuuuagauuuggugguagaaguucugcaaaaggaauucuaaaaaggaaaagguuaguaggaaaacuagaaugacacagcaccgucccagggaaauagaacugaacugggagucaggaagacgaccuguuggcuuuggacaaaaucagccuugguuccccuacuuuuguaaaaguaagaggauguuaagccuccauuaucagguggaaccaggugaugccccagcuucuuccuugucaggaaagcuggaacugaggggcaaguccagcugaagcaaccaagauaugggauucugcacuuucucauguaguuacagugcuuuucacuaaauggauuuggggugcuuucugguauguuuggagccuuuucuuugauaacucuacagaaauucaacaucaggguuugggugucuggaaaccugauguguucugagagcccguugccaucuuguucuuuucaguaauuaugcaagugucauucuuucagagcaagaauaagcagguucaaugcaugauacccuuugauuuaagccccaggaauuuuuuuuuuuuuuuuuuuuuuuuuuuuuuugagacagggucuugcucuguaacuuaggcuggagugugguggcacaaucuuggcucacugcauccuccaccucccaggcucaggugauucuccuaccucagccuccugaguagcugggacuauaggugcacaccaccaugcccagcuaauuuuuguuuuuuguuuuuuguuuguuuguuuguuuuuguagagacgggguuucauuauguugcccaggcuggucuggaacaccugggcucaagcaaucagcccuccuccccucauuacaggcaugagccaccacagccagucuaccccaggguuuucuaaggacuuucauuugauuaggauauuuauauacuuaaauccuaagaacauucucaaccugagaaagugauuuaucaaauaauuuauuuuuuugucugggcaugguggcucacgccuguaauccuagcacuuugggaggccaaggcagguguggaucaccugaggucaagaauuugaaaccagccuggccaacauggugaaaccuugucucuacuaaaaauacaaaaauuaggccaggcgcgguggcucacgccuguaaugccagcacuuugggaggccgaggcaggcggaucaggaggucaggagaucgagaccauccuggcuaacacagugaaaccccgucucuacuaaaaaauacaaaaaauuagccaggugugguggcgggcgccuauagucccaguuacucgggagacugaggcaggagaauggugugaacccaggaggcggagcuugcagugagccaagaucacaccacugcacuccagccugggcaacagagugagacuccaucucaaaaaaaaagaggcugggcgcggugguucacaccuguaaucccagcacuuugggaggcugagucaggcggaucacgaggucaggagaucgaggccauccuggcuaaaacggugaaaccccgucucuacugaaaauacaaaaaaaguagcugggcgugguggcaggcgccuguagucccagcuacuugggaggcugaggcaggagaauggcaucaaaccgggaggcagagcuugcagugagcugagaucgugcuacuguacuccagccugggugacagagugagacuccgucucaaaaaaaaaaaaaaaacaacaaaaaaaaaaaauuagccaggugugguggcaggugccuguaaucccaacuacuugggaggcugaagcaagaguauugcuugaacccaggagguggagauugcagugagccgagaucgcaccauugcacuccagccugggcaacagagcaaaaaaucugucucaaaaaauagauauauuuuuggucuugucaaagcuuuuucuguuccaauccguaaaugauuuuuuuguuuguuugagauaggugcucucucaccagguuggaaugugguggcucaaacauggcucacugcagccuuggccuccugagcucaagugauccuccugccuuggccucccaaagugcugggauuaccagcgagagccacugugcccagcccuuaaaugaauuuuuaaguuuauacuagacaaaagcaauacugugaaacuaguguuucucaaagucaucacauugaugggugaauccauccaaauucuugguuauauaaaaaccagagguagguauaauucuuuuuaacucuucauucauacuugguauuugcuagaagucucccaucuccugauauaguaugcuaauuuugagacuguccgcuuauucaaauaaaauucuagaagaggagacauuuuauccauuauauuuaggggagugugaucauuauagauuucuagggagaaggaguccuggaaugacuugugcuuacgguacuugugcugaaucuuagugacuuuggauuuauacuggaacuuaccccuuuaucuccagagagcaaaaugccauuagaaagagccucggcugggugcaguggcucacgccuguaaucccagcacuuugggaggccagggcaggcggaucacuugaauucagaaguuugagaccagcccaggcaacauggcauugcuacgaaaaauaaaaaaauacaaaauuuagcugggcaucaugguguguaccuguagucccaguugcucuggaugcugaggcaggaggaucaguugagucugggaggucaaggccacagugagcugugauugugccacugcacuccagcucgggugacaaaaugagacccugucucaaaaaacaacaaaacaaaaaagagcuuccccccaccucaccaaaaaaggaacaagccucccauuauacaggugguggcucuugcaauuuuuggugagaugacagucaccauuuuauaucucuggguuuuuuuauguuuccucuuuucuuuuaaaacugccuuggacaucauaguaguaucugaggaacuggcuucaccucauucauuuuacagauaucacugaagaucuguuagucacacuucagggucuguagauggcuuguugucuugaucucauucuggagaugguaucucucucugacccuccuuuccugcugugaccucuuccauauugacauucacacuugaugacuguuuuccaagcugcucaguuugccugggggucuucgaaccaggaaaauuaucuguaacagugggucuuguaucaucccuggagacaucguuuuuugugugugagguuuuucccccacugaguaacauauggauugccuuucuccugaagugccugccuuugggcaguaauaccugacagcugcagaguuagacuaauugauucagggccaggauauuuaucauucugcccucuaagagcuguccuggccaucaggaaaccuggccccugauaauauucugaagcuuuuuuuuuuuuuuuuuuuuuuugccuuucauaucuguacuuuugguuuuguuuuuaaauuaaaaguggcagggcugggguguuuuuguuuuguuuuaucucccuguuuggccucuccuaagaugaucuaaauguucucaacaguuuugaagacuguuacuuccugucaguaaguaauggcuuuuccaguuauaagcugauaacuuugcuucagugauuuguguuucauuucuucaccuauaaacacuguguccaaggacugugaugaggaauaaaugagaauaaaugucaaaugccuggcacaguaaacuuuaguucccaguuuuucucacuuccucuuuguuucgcucaauggauuguuucagugcuugaagauuuuucuagccugugaccaagugacuucuaugcuuacauucucucuaggccugcauuauccacuuguggcugucgagcacuugaaauguggauaguccaaauggagauguauuauuauugugaaauaccagauuucaaaggcuugguucacaaaaaguuaaaucucauugauuuuuuaaaaaauauuguuuacauguugaaauauuaauauucagauauuuuuauaggagguuaaaauauauacaguuuuaccuguuuuuauuaaugugguuauuggacaauuuuuaauuacauaugggguccccuuuauauuuccauuaggcuacucuggauuaggcccuguagaggcauugucuuacagaaggaaaauagucuaauaaccaaggaaauaagucaaaguauaaauacaggacaaugccuuuaguuucuagaauguuuaaaaacaucuaagucuuuugcucuuaaaaaaacuuuuauugcuacauuuuuggaauaaauuuucugcagccuucacagccuguugcaaacauauuuuggcaguguugucccuuugagaagcuauaaaaagagcuaauaauucucacugaugggaagcauuccuuuuuugaggccuuccaaaaugucuggaguucauuugaaaucaaacuuaguuaaucugaauaaucaaguuguaagacacuuuguauaaaauaauuagaccaacauuuuucucaugauucgcaacaaacucaaagcagucccaaaggaguuuucaaaaaacauuuugaucaauaacagaauggguagaauaaauauguaacuugccagggggauauacuauuauacaagccuuauaagccuuuauauuuuguuugaaguuauuauaguuauauuuggaucuaugaaacagaccaaaguaugggcuguauaaaagguaauagugcuguugucucaugggcgggguggggggaagagaacuuuaguauagguagaaaaggaaaaugagaccagcuguguucuagauuguuuuucccucauucucauagaugcugguugccaacauugacuuggguccuacuauuuuggacauugcuggcuacgaccuaaauaagacacagauggaugggauguccuuauugcccauuuugguaaguauagcgcccucaaucaggccugagccaagaccgcaauaaauucuggguuguguaaagacuuaagcauuuaaauauuaaauaauacuauuaaauuugggggcagaaaaucuugugaugggaaggaguuuucuaaaauaaaaaauuagaccacaugugaaaucgagaguuguuuccuccccucuuuugcucuccuuuaagaacacccaccauaaauaaagagagguugggaacacacuugcaacauacauaaaaaagagucauuaguccaaauacaugaguucuuagcaaagauuaauaucccagugggaaaaugggcaaaaaaaguggcuaaucaauuugcagaagaauuaaaaauggcuaaaacaaacgcaaaaagauuacuucagugcuaaucacagaaaugcuuuaacugaaggagaccucucucugugaacuggcaaagauuuuuaaaauacccaagauuucagaagucugagaauuuggaaacugcuucauauacuuuucauacaaguguaaucaguauaacuuaccaagaguuuaguuuaacaagacauaccacuucagagaacacaugucaaaaacagucagacaaguuaacuuuugccugucuggugagugaaaaguggcauuuggucuuacugugcaucuguuuguuuaauaaugaggugaauuauuuuuuaacagcuuaauucccauaccauacaauucacucauuuaaagugucggccaggcgcgguggcuuacgccuguaaucccagcacuuugggaggccaaagguggguggaucaccugaagucagggguucgagaccauccuggccaacauggugaaccucugucucuacuaaaaauacaaaaaacaagcugggcaugguggcgggcaccuguaaucccagcuacucgggaggcugaggcagaagaaucacucgaaccugggagguggagauugcagugagccgaaauugcgccauugcacuccagccugggcaacgagugaaacuccaucucaaaauaaauaaauaaaucauuuuuuuuuaaguguccaauucaauaguuguugguguauucagagugguacaaccaucaucauaaucuaagagcauuuucaucacccuaaacucccaggcacauuagucacucuaauaggagaaaacugaaaauccagauaucuaguagagaauugauuaaauuguggugcagggaauugauuagaucuguugcucccauucccaccaugaaucuucuuuacgucuguauagauuuguuuguucugaacuuuucauauaaaugaaauuacauaauauguggccccuuguaacugguuuuuucacugagcauaguguuuucaaggaucauaucauuguaacgugucaguaccuucuucuguuuuacugccgaauaacauucugugugugaauauaucacauuuuauuuauccauucaucagauauuugggcuguuuccacuuuuuggcuauuaugaauaaugcaguuguaaugguuuuguuuguuuuugagauggggucuugugcugucacccaggcuggagugcaguguugccaaucacagcucacugcagccucagucuccuacgcucagaggauccucccaccucagccuccccaguagcuaggacugcaguugcuggcuaccacgucuggcuaauuuuuuuuuuuuuuuuaauaguagaaaugaggucucccuacauugcucagggugaucucgaacuccugggcucaagagaaccucccuuguuuuccaagauuuuaagaaaaaaaaaaauauccuccccccucagccucccaaagugcugagauuacgggugggagccaauacuugcuauuaucugucuuugugauuauuauauuguaguaggugugaaguaguaucucauugugguuuugauuuguauuucccugcugacuauuggugguuagcauuucaucauguguuugucagccauuuguauagcuucuuuggagauguguucauauuccaauccuuugcccaguuuuuuuuuuuuauuguguuauugaucagggaaucacuuuucauuuaugccuuuuuguguuucuucccuugagaaaugccucugcauuuuugcguaucauagucuccuuauuaugacuugucuuuuccauguauuaagauaugggagccaggugcaguggcucacaccuguaaucccagcaauuugggaggcuaaggcaggcugaucucuugaguccaggaguucaagaccagccugggcaacauggcaagacccagucucuacaaaaaauacagaaaauuagccaggcaugauggugugcaucuguagucccaacuacuuggaaggcugagguagcaggaucgcuugagccaagcagguggagguuguagugagcagagaucacaccacugcacuccaagaauugaagguauauauuguuucuuuuaauguuuaguguccuuuguguauuuauaaagaugcuucuaaacuuugaagccagaaagcuauucuccuauauuuucuccuaaaaguuuuauagcucugccucuuacauccaaguccuugauguaucuaaaauuuauuuucuuguaagauaggagucagggauucaguuucuuuuuuuuuuucucuauagauacucaguugucuuuuuuugcuccacgaaucuguccaucccugugccaauaugauuuugucuuauaaagcuguguaacuaaaucucaauuugcauaggcauaccucucugcuuauuguccucauggggauccuagcccgugucuuccacauacauaaacuuuagaaucagcuuuucagauuaucugaaaaauguuggcuuuugguuggaauugcauuuaaccuauagaucaguuagaggaaauuuuacgucuuuuaacuuuucauacaagucuuauacuuuguaccuuauuauguuuauuucuuuuuuuuuuuuuuuuuuuuuuuuuugagacagagucuagcucugucgcccagguuggagugcaguggcaugaucucagcucacugcaagcuccgccucccugguucacgccauucuccuggcucagccucccgaguagcugggacuacaggcaccugccaccaggcccggcuaauuuuuuguacuuuuaguagagucaggguuucaccguguuagccaggauggucucgaucucccgaccucgugauccccccuccuuggccuccuaaagugcugggauuacaggcaugagccacugcacccggcauuaaguuuauuucuaauuagaaaaaaaacugauucacucuagggguaaaaaucauuauguuguguauaauuucucugcacaguucucuaagugccaccuaagaugugguucuuuuccuuguucauguuuuguuuuuggaggcuauuccgaugaaauacugauguauuagaacaguuaauuagccauguguggcuauuugaauuaaaaaugaaauucaguucuucgguugcacuagcugcacaucaugugcucaguagccaucauauugaacagcaaagaucgagaauguuucagccagaaaguucugcuggacuagcaguuggcagacuacaaccugugggccaaaucuagcgcacccccguuucuguaaauaaaguuauaucagaauacagccacacucauucauuuauguauuguugauggcugcuucccugcuaccugaguagaugugacagagauuguauagccaggagccuaaguauuuacucuguggccuuuuacaaaaaaaguuuaacaacuccuacagaccaugagucucaaauuuggucagacaucagaaucacucggaaacuaaaauacuaaugccugggccucaccccuagagauucugauuuaauuggcaugagauagaaucccuugggauuuuucaaguuucccuggugauuuuaauaugcagcaaaguucaggaaccacugaucuagacuucucaggugcucuuuucuccucuggacacuuugacauucaagggugggauuuugaaguucacucaauucugacaguucacucaauuccaccuucuggcuuccauggcucagguuuggcagcaucaugagguuuguuuguuuguuuuuuccgagacagagucucgcucugucaccuaggcuggggugcaguggugcaaucucggcucaccacaaccucugccguccggguucaagcaauuauccugccucagccucccaaguagcugggaccacaggugugugccaccaugcccagcuaguuuuuugguauuuuuuaguagagacgggguuucaccauguuggucgggcuagucucgaacuccugaccucaggugauccacccaccucggccucacgaagugcugggauuacaggcgugagccaccgugcccagccagcaugagcuuuuuaagucuccagugacucaugauuucugagauccugagccgcacaggauuguucaaguuucauuguagaacaacaaguuaggaaauaauuccuaucucuaacuccuccuuuucagguggcugcggcauucaaggccuugcacaagccguuacccauuccccacuguacucacccacauuuagcauucuuuagagcagugauucucaaacaggcauuccccagaauugccugugggacuugcuaaaacccagguugcugucuaccuacguuaggaacuaagaauuugcauuugugacaaguuuccaggugaugcugcuuguccugggaaccacauuuuaagaaccacuuuuuuagagcagugcugcucagauuuuuacuaugcguggaaaucaccaagaguucuuacuaaaugcaggcuuuggcuuauuagagcuagaguaggaccugagauucugcaucuccaagcucccaaccagacuuugaccauuuuaagagcagcuucuaaccuggucuuccugucuuuccacuuuuugacuguuaugaauacugcaguuucugucucuagauucugccacuaagcugacuuuucuaaaucacugccuugauuguguuaccucccugcucaaaaaccuccuaugauuucccaucaccugcuguucuuuauaggacaagccugggcagcaugauguucagggccuuuuccugugugguaccagccugccucuccacccucacugugcacugcuuccuugucugaaagcuguguuucaggaagccacacaucuaaguggucugcguucaaccuauauucaugcucuuugaaucuaaaacuugcucccguuccuagauucuuucuccuuucaccauuugugucuuaaacuugcugcuuucaaaugcugccacuucuuuccuuccacaccaugaauguacauugaaaagugagugaauuaauguacuauaccuucauucugaccaucaagaggugcuuugaaccuguuacagucuuuagcacacaagucuguggaauauuucuuuauuguccuugugucuauuagguuauaaguuucuuagucugagcuuaaaacaguucuuacauagagcauaugacaguauuauuuauucuagucuggacuuucagcaacuugcacugugacuuugauucuugcuuagcuaccuugucagguuccauuccugaccugauucacagaaguagccuugggaaggaacuauuaaauuuucaaagcauuucaccaucguuuguaaaggcccuuaacuaccaaacauacugcucaguagcuuucauauguaccuguuuuagucauucccuuuaguuacugaaugaacaguccaauuacuuuugacucccagguccccuuuagcagucaauuacuuugugaucuuuaucauagucuaugugcaucacagaaauuccacuugcucuucuuucuagagaggugccaguaacuugaccuggcgaucagauguccugguggaauaccaaggagaaggccguaacgucacugacccaacaugcccuucccugaguccuggcguaucugugaguaauagcuugaaucaacuuagacagcuuucucacugacaacauggcaaggugcugguugccaugugucaaauauugaaaccuuucaucugaguccuguuccuuugucacugacugugagugguuaguagauggacaaagguaaauccagugaucuuggaaaugaugcugcugaccugucaucagaaugugcacuguuaaucuuccaauuuauguagcaagugcauguauccacccguguucuuaucaauuccucuucccuguuuuucuaccccucccaauaacaguaccauuuuuuuuuaauuagggauaauguuacugaggcaugcaguagagagaugugguuccugccuguaaccaugccauuaugagugccucgcauuggcggcagccaggcaggucacaaagagggaaacagccauguuggccucacuuuggagaagggaaaauaggcuuccacuuggaguugauugauucuucuaacaccaaaguguuacaguauaaugaaccaaccaaaagugcaauaacagaucauaugguagacaaauuagauuuaagucguaccuggugauaagaacacucauaaauaacuuacuugcacaugacuccacaaaacucauuuuagccuucuccuccaacuucuuagggugacauuuccuaguagcucuuagaaaugagucauuugggcuggguacuguggcucacaccuguaauccuagcacuuugggaggccaaggcggguggaucaccugaagucaggaguucgagaccagccuagccaacaugccgaaaccccaucucuacuacaaauacaaaaauuagccgggcgugguggugcaugccugugcuacucaggaggcugaggaaggauaaucgugugaacccgggagguggagguugcagugagcugagaucgcacgacugcacucuagccugcacgacaagagcaaaacuccaucgcaaaaaaaaaaaaagaaaggagucauuugaguugauuucuucuccuugccaacccauacauuuuacaggugcccauuuuaaguaauuauugucaggaguuuagcagacaaggauggcaacagucuacaaauggaacaacccauauaccuugaucaaguuagccaaaggaacaaaaccucacaucuguuuuugaguuacuggcuuccccauggaagguuuucuaauugcugucaaauugcauguccggcaugagccaagccgauugcccuucuaggcaacuagguauuuguuacuauggaagaacugucuucauuuaacuuuugaaauaucccuacagcaaugcuucccagacuguguaugugaagaugcuuauaacaauaccuaugccugugugaggacaaugucagcauuguggaauuugcaguauugcgaguuugaugaccaggagguaagagggacuucugccugcacuucccccgcuccuuucuugcuggugcuuuguuggcuggacuugguggcauaagagcaauuccaaggcugcucccuagggaagagguuguguuucuuaucugugcuucacuuuagguuuccuucaguuguaaggccaugucucacuucucuaauuguaaucuuucugaauugaguucucuccacucccaccaccacccaaauauacacuuuaaaugcacaauucacguuuucagaaugauaaaugcuuugucuguuagcuucccugguagauugguuggagcauuuucuagaaagcuuaccagcaccugguguauucggaaacuccuguucccaccacagcauaauccaaugcugcuguaauagauuagagugggggucagaggcccaggaguccauccauggaagaaggugguuuuuggccaacacagguugguauggauuaucugaaggaucccauggacucuagucccuugugguuucuuacuguuuaucagcauaugcucaccugccccaucuggcaacccucaucugaccaucuggaacagaugcccaucuguguuucucagaaauggacucauucuccacuccauuugcagcugauaagcacuuuggacaacaagcaagagagcuuuccucaaacucaguuccuguucccugcucccccauaauguuuaucaguuugauaacuacuuuauaagugauugugugagugagggcagcuaccugaagccauuauaggcaaaauuaccuaccaucuuucuagccucacauuugacuccaauuuggagaacagcauacagauuauagagggaaaaguacugcguuagaccugucuuauuuuagaaauaauaauuaguauuguguccuuccccaauauauccacaauuacuuuuuaaaauaggaaaacuuaacauuuguauaacacaggcaagaguacuuucauaucauucucauuugaacuucacaauucuagggcaaaaaucaccuuuaaauauucgcucucacuuuaguaacuuuauugccaagucuuguuucugagaccuugccauuggaggcuccugcuuucuguucuaauuacagaagauaaugcauuucuuccccauacccucucuugccucugccugaaggcacagggugugcaggggccccuuuuuagcauguggcuagagacccgaagcaacugaacccccagaacagaugcucccucaucucaaggaagcagugagcucuuugaggaucuugaaaacagauugagagucuccagggccuugauuuuuuuuuuuuuuaaucuaccuccucccuuccccuuuagaaauaagucacguuaagaguauuucuucacggcuaaccuuugcucuuuucuuuccuccauucuuucauguccucuagguguuuguagaagucuauaaucugacugcagacccagaccagaucacuaacauugcuaaaaccauagacccagagcuuuuaggaaagaugaacuaucgguuaaugauguuacaguccuguucugggccaaccugucgcacuccagggguuuuugaccccggguaaguuuccuuucucuucauuuacuuggccaaguuuuuucuaguagacaugcuguucuugaaggcaaagggagcccuuuuugcugugagaugaugauucuucugcuuuagagggaauacuguguucuaauugcaucagcccguugugcugggaaaaucaagcuuuugaaacuuuuguucuccacugccaguuguuacuuuagccagagguacagcccugcuccccaccaaacauggggcucuuguuauuuucgugcugugauuauugucaugguaccacuuguuugcauuggugacacuuggggcuucuuuaaguaagcugcgacccacugcugcccuguucaccuguucccuagagcuugcaagaguauaugccuucauuucauuucucagaaaccccuacuacagaaacuugaauguuugcuggugaauuuaauauauuaaacacacaaugaaaauagaagguguaaacucagauguugaaauauauaagcccauugcacgauauggagguauaaaggauguuuagcugucaccugcuaugucagauuuguuccccacacgguccuucuuaguaacuuuucagcaguaacacugggugucaguacaccaugcauuugagcugcugguggcaggaaccuugucauuuaucuuuugcuugaagaucaugaaguuuaaaaaucaaacuuucacugggaaaggaauauuuuaguuccuaccuucagacuguaagagagggaagaaugauguccuaaguugauggaaaguuaucacuuaauuuuuuagccgucuuuguauuaaauuuuaucuuuaguccaaauuagagacaaaugaaugugaaugaguagaaaaacucgaugauagacuguucauuguuugcuuuuaaauaauguauauagugccaaaguggcauggacaccaguaaacuaaagccagguaacaauauaaaaagauaauauuuauuauuuuauaucacuuaaaugaaauaacuguuuuuauauggauaaucccauuaguacaauaagaauggucaagaauuuugaccauuggucuuuccuuuggucuuuccuccaaguuagugaaauagauccuagcuugguaccaguuaccugaaauaggaaguccagucccuaaaauaaaagcacaagacuuccaguuuacaugugcugacuuugcaauuuccaacaguuacuuagcucagaauguucuuuuaaaccaaauuaaguuagaugucgauagcaguuaauguuuuuuaaccauguacucccuggcugacucugggaacuuaaagccagcaucugauuaaaucuuaaauggagggucaagggacuggaccucuuggauuaugauguguggccaaacagucccugaccaugccacugcuaggacauggaccugccaggcuggcaucugguuggccaaugcaagguagauggagccagcugucuguuucuucugaacaucuggcucuaaguguuagaauucauagaauuuccacacagcccuuagagcccaaacagguaaauuucaaaugaggaaacugagcuugcaguugugauuugcccaagggucacccuauaaggaagugaauacguuauuuccuaagcaaguuuuguuugguuuuuaacugcaacaaauugucuuccucacauuuuagaagcuuauaacuaaagugcuagaugcuggcuuugcugauguuagcaugaacuacuuaaacuuaaccugauuuucuguuuuaaauuccuuagcccugauuauuccuuuccuaucaaacauuugggccuguuagccugaacuacuuaaacuuaaccugauuuucuguuuuaaauuccuuagcccugauuauuccuuuccuaucaaacauuugggccuguugaguccuccaaaauggggucaucagaccagauccugugagcccaaucuagccccaccugcgggaacacagccucacacauucguuuaccugguuuuggcugcuugugugcuucagcagcaaaggagaaugguugggacagagacuguauggcucccauacccuaaaauauuuauuaucuggcccuuuacaaaaaaucuuggucaauugcaguucuaaaaugcaguaguccccccuuauccacagaggaucuauuccagaacccacaguggaugcgugaagccccaaggauagugccaggcccaguugccaucaguuggaagauguuucuguucaugucuucuacccacaaauuuuaugccuuuuccaucuuaacuaagcuuuugucaugcacuguggcccuaacuuuugcaguuuaagguguggcagcaaaacuagaauucguuuuuccuucuucaugauuucacagauagaagauucauuccuggcugggcgcgguggcucacauuuguaaucccagcacuucgggagaccaaggcgggcagaucacaugagcccaggaguucuagaccagccugggcaacauggugaaacucuugucucuacaaaaaaaaaaaaaaaaaaaaaaaauuagccaggugugguggcgcacgccaguguucccagcuacucuggaggcuuaagacaggagaaucacuugagccggagagguggagguugcagugagcugaaauugugccacugcacuccagccugggcgacagacugacucugucccccugccagcgcccccaccaaaaaugacucauguuuauggugaggcucuuguaggucuuagcagucuugcuguaugauuuuuuucuuuccuuauuaagucaagagcguucacuuuuucacuuaaaggaagcacuuuauggcuucucuuuggcauuucugaauuggcagcaccacuacucuugugguuuggagccauuguuaaauaaaaucagggugacuugaacacaagcacuguaauaauguaacaguugauccaccccuacucccucaaaagaaaaaaaucucaaaucuugcugccuucugacaccuuucaagacuaaccuacuuguuuuucuccucuugacuugcacugugugacuuugugugugcugacuggugauagaaauguucggaacugucgagggcucauguuuuguaccauagacuuucucacuagagucccuucuggugauuuguuucuuuuacaccccuuccugcuauccuuuccacugaauaauauucugagugagaagcuagugagagcuaauguuacauuugguuuuuccuccccagauacagguuugacccccgucucauguucagcaaucgcggcagugucaggacucgaagauuuuccaaacaucuucuguagcgaccucacacagccucugcagauggaucccugcacgccucuuucugaugaagugauuguaguaggugucuguagcuagucuucaagaccacaccuggaagaguuucugggcuggcuuuaaguccuguuugaaaaagcaacccagucagcugacuuccucgugcaauguguuaaacugugaacucugcccaugugucaggaguggcugucucuggucucuuccuuuagcugacaaggacacuccugaggucuuuguucucacuguauucuuuuuauccuggggccacaguucuugauuauuccucuugugguuaaagacugaauuuguaaacccauucagauaaauggcaguacuuuaggacacacacaaacacacagacacaccuuuugauauguaagcuugaccuaaagucaaaggaccuguguagcauuucagauugagcacuucacuaucaaaaauacuaacaucacauggcuugaagaguaaccaucagagcugaaucauccaaguaagaacaaguaccauuguugauugauaaguagagauacauuuuuuaugauguucaucacagugugguaagguugcaaauucaaaacaugucacccaagcucuguucauguuuuugugaauucuaggcuggugcugcacugaaauagagcaguaagcuugugauaaaggccaauuccagguagcucuugaaggugauagccaucuacuuuccaguggcugccaaccacagggagugccaguuaacacuggaaggauuaaggcaaggucccuucucuugagacuccccucugagaucugaaaaaugaaguggcuuaggaacaucagcagugaagaacugccaagaguuggugaagguugucucuuccgagggccuucugaagacagggcucuugaacagacaaguggaagggcuguaccagggauaaaggaaagaagugccuguccagcagggagcuugaauuuaaguuccauguaugaagucauuggcucuaucugcauuuuucugucauucucuucauuuguuuuaagguggaaaauuuucuuacaguugaugcaaaguaucaacuacuuuacccuaccuucuccccuuuuagauggguucuuccugaguuuuggagucuuguaugauuaucaguauuccccugucaaaaucaaaucuauucagguuucuucacuguugagaacaccuaaauguuuuuauuuuugagaaguggggacagagucucacuaugucacccaggcuggagugcaauggcaugaucucagcucacugcaaccuucgccuccuggguucaagcgauucuccugccuccgccuccugaguagcugggauuauaggcacgcaccaccacgcccagcuaauuuuuuguauuuuuaguagagacagaguuucaccauguuggccaggcuggucuugaacuccugaccuugugauccacccaccucggccucccagagugcugggauuacaggcaugagccaccacgcuuggcuaagaacaccuaaauuuuuauguuucuuggcucaaaaaccaguuccauuucuaauguuguccucacaagaaggcuaauugguggugagacagcaggggaggaggaagagcugugguuuguaacuuguucaacucaggcaauaagcgauuuuagcuuuauuuaaagucuucuguccagcuuuaagcacuuuguaagacauggcugaaaguagcuuuucuaucagaauugcagauagucauguugggcuaacagucaauuggauauauuccuuuaccucacaugaccccagcaacuguggugguaucuagaggugaaacaggcaagugaaauggacaccucugcugugaauguuuuagagaaggaaauucaaaaaauguuguaacugaaagcacuguugaauauggguaucggcuuucuuuuucacuuugacucuuaacauuaucagucaacuuccacauuaaugaaaguugaccauaguuauuuccaaauaaaaagaaaccaacucuuaccaggucuuggacugugaugucauauuauucaguuuuaugcuuguuccugagcagaacucauaagagugacauagucagcugcugacggcaccucagccacgccacucuuacucaguucagugggugugcuugcgugguaggauguggugcagcccucucuacgcucuucuauuuuugguauauuuccuaucuaaccuucaaauagcuuccaauucuuuuuuucuuggacuggcuucauucugaauuugugcuaaaauaaucuuucauaaagagaccucaguuuauagcguaacagacuacacaaugcacugauguuuucauaauguuuaagggacccacugcaagaagcuugcugccuccuuuuaauuguauucauuuagauuuugauuuuccauguuaagaaggugagguccauguuggugcccuucagaguagagaaccauguaaacauuaggaaugaacagaggccuuaggaaugaauagagaguuugccuuauacaauuuccuguuacaaagcucucccucucaugcaaaguagggaacaccuuuugagcaucuuugaauuugacaaauggugcuguugcaaacacuuuuuuuuugagaugaagucucgcgguugucacccgggcuggagugcaguggcgugaucucggcucacugcaacuuccaccuccuggguuccagcaguucuccugccucagccucccaaguagcugagauuacaggcgccugccaccccaccuggcugauuuuuguaauuuuaguagagacgggguuucaccauguuggccaggcugauuaacuccugaccucaggugauccaccuuucucggccucccaaagugcugggauuacgggugugagccaccgugcccggccugcaaacacauuuuaauugacaacacuagggcuguuguacaaaauaguaaugauagccauggaaguuuuaccuuauucugugagaaguguucuuaaacuuauuaagugucuaaacuaagguuuagugcuuuuuuaaaggaaaguugucccaggauucauccuaaagaaagcaaaaguuaauucaacugauccaccaauggaauuagauggguagaguuggguucuugaguuuuaccaccacuuaguucccacugaauuuuguaacuuccuguguuugcauccucuguuccuauucugcccuugcucugugucaucucagucauuugacuuagaaagugcccuucaaaaggacccuguucacugcugcacuuuucaaugaauuaaaauuuauuucuguucuagugggaaug

SEQ ID NO: 16413 - RNA, 2027 nt, Homo sapiens
auuaggauccccugagauacgagagcauauaaggucauuuuaggauaggaagaacgaagcuucucaaagagucaaauuuacucagaaaagcuggaagacaggacagcaguuuugcaaccacaugacauaauuuggcugauguugugaauagggauugcuacacaacaaaaugauuccucaaugacaagucucaagaugaaauccaguugccaacgugacuccaaaugguuuaguguuaacaaugaugaaaagauggaaugaaauaaugauuuuuaaggagauugagaaauauuuucucuaaaaaauauauaaaguguuuugagagaaaguguguguacguguguguguguguuggaccauauccaagaacgaaaguggcacacaaacugaaauaugcugagauugguguguuggagcaaaaaagaucaucuuggcaaucucaaguccucauuccuucagaggaugacuauuauuagcacuacuuaauaucuauuaagccccagcuggggcaacuugucaaaaugggcaaggaaggaagaggggaaaauguauaauuugucccaggcaugggcgcucgguguggggaaaaugucuuuuaagauauuuuaaguuaucugucagaagguuuaggagguuucauaugauuuucagagaucucucugccccagagagaaacugauucaauaagcaucuauucugaguuuguuugaugcuuaggguacagaaaaauaaauaaaacugggucucuguugucaagaauuuacauucuuuucuaaauuauuugaauacaaccuucaaaauauuucccauaucaucuguauaauaguacucaauacagauuuacucaauguuuuucucaauauuuuccuaauauuacucaauaauuucccaauauguguaccuaccuuagccuugucauaaagaauaccugggaaaucacagauuugguguucuagguauauaguuuuaaauuaccugugugugcuuuuuuuuuuuuuuuuuuuuuuugagguggagucuugcuuugucacccaggcugggguacagugacacaaucuuggcucacugcaaccucugccucccggguucaagugauucucaugccucagccucccgaguagcugggauuacaggccugugccaccacaccuggcuaauuuuuguauuuugaguagagaugggguuucaccauguuggccaggcuggucucgaacuccugaccucaagugauccgccugccucagucucucaaagugcugggauuauaggcaugagcuaccaugccggacccauuuuuuucuuuucuuuuucuuucuuuuuuuuuuagauggcgucucacucugcugcccaggcuggcguacgguggcacaaucucagcuuacugcagcaauuucuugggcuccagcaauccucccuaauuagccuccugaguagcugggacuacaagcacaugccacugugcuuggcuaauuaaaaaaaaauuuuuuuuuguagagauaagguaucacuauauugcccaggcugaucuugaacuccugggcucaagcgauccuccugccucggccuccuaaaaguguuggaauuacaggcauuagccaccacgccuggcuguuaugugcauauuucuaauguacuuuuaaaaauaaacauacacauuuuuuuaaauuuuuaaauguuuuuauuuuauuuauuuuuuuugagacagagucucgcuuugucgcccaggcuggagugcaguggcgugaucucggcucacugcaagcuccaccucccggguucaugccauucuccugccucagccuccugaguaguugggacuacaggcaccugccaccaugccuggcuaauuuuuuguauuuuuaguagagacaggguuucaccguguuagccaggauggucucgaucuccugaccucaugauccgcccgccucggccucccaaagugcuggaauuacaggcgugagccacugcaucuggccuacaaaauuuuuuaaaaugugucuuccuugaauuaccuaaagucaucu

SEQ ID NO: 16414 - RNA, 7997 nt, Homo sapiens
ccuuguaguauaauugcauuuucaguuauuuacugaguaucuggagaaagugagaagaauaggaauguggcucaaacugggaagggacuacauuauucagugccuucuaguccuuuuuacggauuugggguuuuauccuaagauaaauggaaagugauugaaguguuagcuauuucuuauugggucaccauuuguuuguuuguuuguuuguuugagacagucuuguucugucacccaggcuggaguuuaguggcacgaucucagcucgcugcaaccuugcccccccaccccagguucaagcaauucucgugccucagccuccagaguagcugggauuacaggcacaugucaccaugcccggcuaauuuuuguauuuuuaguaagguugggauuucaccauguuggccaggcuggccaccauuuuguuuuuuuuuuuuuucuuuuuuuuuuuuuauuauacuuuaaguuuuaggguacaugugcacauugugcagguuaguuacauauguauacaugugccaugcuggugcgcugcacccacuaacuugucaucuagcauuagguauaucucccaaugcuaucccuccccccuccccccaccccacaacaguccccagagugugauauuccccuuccuguguccaugugaucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauucggguugguuccaagucuuugcuauugugaauaaugccgcaauaaacauacgugugcauaugucuuuauagcagcaugauuuauagucauuuggguauauacccaguaaugggauggcugggucaaaugguauuucuaguucuagaucccugaggaaucgccacacugacuuccacaauggaugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucauguguuucuuggcugcauaaaugucuucuuuugagaagugucuguucauguccuucgccaacuuuuugaugggguuguuuguuuuuuucuuguaaauuuguuugaguucauuguagauucuggauauuagcccuuugucagaugaguagguugugaaaauuuucucccauuuuguagguugccuguucacucugaugguaguuucuuuugcugugcagaagcucuuuaguuuaauuagaucccauuugucaauuuuggcuuuuguugccauugcuuuugguguuuuggacaugaaguccuugcccaugccuauguccugaauggucaugccuagguuuucuucuaggguuuuuaugguuuuaggucuaacguuuaaaucuuuaauccaucuugaauugauuuuuguauaagguguaaggaagggauccaguuucagcuuccuacauauggcuagccaguuuucccagcaccauuuauuaaauagggaauccuuuccccauugcuuguuuuucucagguuugucaaagaucagauaguuguagguaugcggcauuauuucugagggcucuguucuguuccauugaucuauaucucuguuuugguaccaguaccaugcuguuuugguuacuguagccuuguaguauaguuugaagucagguagcgugaugccuccagcuuuguucuuuuggcuuaggauugacuuggugaugcgggcucuuuuuugguuccauaugaacuugaaaguaguuuuuuccaauucugugaagaaagucauugguagcuugauggggauggcauugaaucuguaaauuaccuugggcaguauggccauuuucaugauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguugacucaugauuuggcucucuguuugucuguuguugguguauaagaaugcuugugauuuuuguacauugauuuuguauccugagacuuugcugaaguugcuuaucagcuuaaggagauuuugggcugagacaaugggguuuucuagauauagaaucaugucaucugcaaacagggacaauuugacuuccucuuuuccuaauuggauacccuuuauuuccuucucuugccuaauuucccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuugccucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccagcuuugguaugagaaugaugcuggccucauaaaaugaguuagggaggauucccucuuuuucuauugauuggaauaguuucagaaggaaugguaccaguuccuccuuguaccucugguagaauucagcugugaauccaucugguccuggacucuuuuugguugguaaacuaucgauuauugccacaauuucagcuccuguuauuggucuauuaagagauucaacuucuuccugguuuagucuugggagaguguauguguggaggaauuuauccauuucgucuagauuuucuaguuuauuugcguagagguguuuguaguauucucugaugguaguuuguauuucugugggaucaguggugauauccccuuuaucauuuuuuauugugucuauuugauucuucucucuuuuuuucuuuauuagucuugcuaguggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuuccaacuauguggucaauuuuggaauaggugugguguggugcugaaaaaaauguauauucuguugauuuggguuggagaguucuguagaugucuauuaggucugcuuggugcagagcugaguucaauuccuggguauccuuguugacuuucugucucguugaucugucuaauguugacagugggguguuaaagucucccauuauuaaugcgugggagucuaagucucuucguaggucacucaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccucugccuuuuuuuguuuuccauuugcuugguagaucuuccuccauccuuuuauuuugagccuaugugugucucugcacaugagauggguuuccugaauacagcacacugaugggucuugacucuuuauccaauuugccagucugugucuuuucauuggagcauuuaguccauuuacauuuaaaguuaauauuguuaugugugcauuugauccugucauuaugauguuagcuggugauauugcucguuaguugaugcaguuucuuccuagucucgauggucuuuacauuuuggcaugauuuugcagcggcugguacugguuguuccuuuccauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugaugagagauccgcuguuagucugaugggcuucccuuugaggguaacccgaccuuucucucuggcugcccuuaacauuuuuuccuucauuucaacuuuggugaaucugacaauuaugugucuuggaguugcucuucucgaggaguaucuuuguggcguucucuguauuuucugaaucugaacguuggccugccuugcuagauuggggaaguucuccuggauaauauccugcagaguguuuuccaacuugguuccauucuccccaucacuuucagguacaccaaucagacguagauuuggucuuuucacauagucccauauuucuuggaggcuuugcugauuucuuuuuauucguuuuucucuaaacuucccuucucgcuucauuucauucauuucaucuuccaucgcugauacccuuucuuccaguugauugcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaagucauucuccauccagcuuuguuccauugcuggugaggaacuguguuccuuuggaggaggagagacgcucugcguuuuagaguuuccaguuuuucuguucuguuuuuuccccaucguugugguuuuaucuacuuuuggucuuugaugauggugauguacagauggguuuucgguguggauguccuuucuguuuguuaguuuuccuucuaacagacaggacccucagcugcaggucuguuggaauacccugccgugugaggugucagucugccccugcuggggggugccucccaguuaggcugcucgggggucaggggucaggaacccacuugaggaggcagucugccgguucucagaucuccagcugcgugcugggagagccacugcucucuucaaagcugucagacagggacauuuaagucugcagagguuacugcugucuuuuugugugucugugcccugcccccagagguggagccuacagaggcaggcaggccuccuugagcuguggugggcuccacccaguuggagcugcccgcugcuuuguuuaccuaaucaagccugggcaauggcgggcgccccucccccagccucgcugccgccuugcaguuugaucucagacugcugugcuagcaaucagcgagauuccgugggcauaggacccuccaagccaggugugggauauaaucucguggugcgccguuuuuuaagucagucagaaaagcgcaguauucgggugggagugacccgauuuuccaggugcguccgucaccccuuucuuugacucggaaagggaacucccugaccccuugcgcuucccaggugaggcaaugccucgcccugcuucggcucgcgcacggugcgugcacccacuggccugcgcccacugucuggcacucccuagugagaugaacccgguaccucagauggaaaugcagaaaucacccgucuucugcguugcucaugcugggagcuguagaccggagcuguuccuauucggccaucuuggcuccucccuccccacaccauuuuguuuuuaacuauaauuaauaugaagggaauuugggaaccaggauugaauaagggcugucugauaaaugcucuauuucuuuaauaaacauuuauuuuaucuacuguguuuuccauauaagcuuauaguagguacugucaucugcaagauaggcuuaauaccucauagcauuacugugaacauuaaaugaguuuauaugugucaucuacacauucaacagauguuuuagugacuuuuuuuguuuuaccucugccucuuuaggaccacacucugaaaagagcaugccuuguuucaaugauuguuuuagucauacaauugccagaauaaauaaaauacacucagaaagaauuauaccuaauuuaggccaggcaugguggcccacaccuguaaucccagcgcuuuggaaggccaaggugggaagaucacuuagaguuugaaaccagccugggcaacauagggagaccuugucucuacagaaaauggagugugugccuauguucucagcugcuugggaugcuaaggcaagaggcucacuugagcccaggaacugagcugcagugagccaugauuguacaauugcacuccagccugggugacagagcaagaaccagucuaaaauaaauaaauaaaaaaaaaaaaaugaauuguagcuaauuugguauuccuguuguugaaaggaaaaguggccacuacucucaggcuauuuccacaggagaauaugauguugacauaauuuugaaauggugaaauuauaucagaauuuuaaaauaaaucaacauguaguuccuccaucuuuucuuccccuguccugaagcauaauauuauguuuggccauuuuguugcuuugugguuagaaaaaugucaguguggcaagugaaguaacauuuccacuuaucucuauuucccucuccccuuuagauuucaccacccaauccucaguccuuuggaaagcaguuuccagcuggaaguugacguccugugucaucuccugaaagcccaggcccaggucucagaguggaaguuccucccaucucugguuaauuuacacagugcgcacaccaaacugcagacguggggccagaucuuugagaaacagcgggagaccaagaaacaucuguuuggagggcagucucagaaggccgugcagccuccacaccuuuuccuuuggcugaugaaacucaaaaacaugcuucuugccaaguuuagcuuuuacuuucaugaggcucugagccgacaaacgacugcuucagaaaugaaaacguugacagcaaaagcuaacccagacuuuuuuggaaagauuuccagcuucaucagaaaauaugaugcugccaauguguccuuaauuuuugacaacagagguucugagaguuuucagggucaugguuaucaccacccccauuccuacagagaggcccccaaggguguggaccaguauccagcuguagugucucugcccagcgacaggccagucaugcacuggcccaaugucaucaugaucaugacggaccgcacauc

SEQ ID NO: 16415 - RNA, 1057 nt, Homo sapiens
cauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagaccc

SEQ ID NO: 16416 - RNA, 437 nt, Homo sapiens
aaacuaucucccuagaauacagcacauagcaggugcucaacaaauguuuacugaaugaaugaaucugacagaaaucaacucugcuacuuccuagguguggauaacaguaucucacauuuguugagaacuauguaugagccagagacugcuguuaauauuuuguagaaaguaauuaacucauuucauccucuugucaacucuauaagguagcugccacuguuacucccuuuuuaaacgaagucacagcuagugacuggcagaguaguuuggucaaguuacuuaacuuuugcaaaucucaguuccuuagcuguacuucauggauuaaauucuaugacuuauuaagauuguguguguguguguuggggagggguguuuuagucaucauaauuaaacacauggguaauuuugaaguuagguuuaaauucaaguaggaaaaa

SEQ ID NO: 16417 - RNA, 2071 nt, Homo sapiens
uaggaaacaugauguaaacgaagcauggcagaucuguccagcacugauauugcucuauaaauugagcuuacucaguuuuggccuuauuuuuuuacccaggccccaugucacccaguccuaaaacaguaaccgugucuacauaacggguuggccccuggugcaucccuggaaaagucaaaggacgcacacuucgaaauucugcagaacguauuuauacaugguucagaaaucuugcguaucugacuuauagccaaaucugcuugcucgaauagccucagaggaagucuuguuuaauaaaaaccuuuugauuuccuagucaagucuuuaugguugucucgagggguguguggcuacuuuaaugaaaggcuuuccugcucuaaaucucuuugcugggcugggccucuucagacuaucuggugaaacuccuuuccuuagaacaaacucaguccguccaugcucuguggcauuuugcuagaugauaaccaaagccuuauuccuguagccagugucagcagucagagagguggaggguguguucugcugugguuaugcauaccuaucugcuguucuugagguguaaaaggaaaggugaaaaucgggccaggccaaguacucagcugucuuaauaggaugaagccuuaagcaguggaaauuucaguuauuuuccacaguauuccauuuuggaggauuugggguguuuacuuuuuaaauucuugaacaacuuaaccuccaugaggcuuugugaagucagcugugaccacccuccucuuacuguguucucaguauucauucacuuccagggaagaaugacagccacagggagaugguggugggcaagaaugagagucccaggauccagauuuagccucagaucuuccccauucaggaaggguuuuccauuuaacaagagcacuaguaugaaaacauuagggacaaaucucccaugucuuugaaauucggauucuccucuugagauccccuuccucaccugccaaucaacuuuauaaggccacaaguggucacugguuuuccuuccacagguuugagguucucagcuuuccuuaagcgacccagcagcuccgcuguuuucagagugaauauguuaagcuuugaugagauucuauuuucaguaaguuagugcuucugggacacuuggagaaagcugugagagucauugucuacgcaaagaacaacgaagcugauccuaaaagugauccaaucuaagaaaaugguaaaacgagcucuggccacagcacagaauuuuaugugaggaacucagauuuuugaagacuuaacaauugcagagaaagguugcagccugcacaccauagcccaccucucugagcagacuuugguuuuguguggugacguggcacauguuuguacacugggauuuuucaaaggacgcuacgcgagcagacugacuugccucuucugugagcacuguggcuuuugucagauggagugccggucugcagaggacugcucuuucgaauccacaguguuaucuguguaaauagcuuuaauuuuucuucugugucuuaggugaaguuuuguucauguagcaaccagguagacagugaccaaauaaggcuguaaaugugcuguaguuuucuacugugauguacuugaaggagaaccuguguccucuacuuuucugaucucccacaaguauuuuguguuuguuuccugaguccugagguuauuauuuuacuccuguuuugcccccaguuuucuuuguuuuuuuucuggagacccagggaggcccaugguggagaucauuuguaaggaauggaucauggucuggguuuccaaaacuacccuaguacagugaaugagagaaaucugccuggaaauuguuucagaaccauguaccuuuaugcuuugugauugugaaacauugacuuuuuuguaaccccaaaaugaaaacuguuuaguaaaggggaucuauuuuguguguuuugaaacuuaggugcaauguccccuggaaaaagcuaaagaaauguauauguucaaugacauuuuaaaauaaaauauuauauauauguauauacgacauauucagcaaaac

SEQ ID NO: 16418 - RNA, 149150 nt, Homo sapiens
ugguuucgaccggccgacugggaggggccgugggacgccauucccauaaugcucuggggcgugccgccgccgucgcugccaccuccccuaccgcuaguggaagaagauggcggaaggcggagcggcggaucuggacacccagcggucugacaucgcgacgcugcucaaaaccucgcuccggaaaggggacaccugguaagagaaagggguugagaugcccgcgguugcccgaggauaguggagaagugggcgggagccgcgagcugguucuuucgcuagugacaggugcgggcagguccggcggcggccgccggggcagcgggauuuuggccgcuucugaaauguuggggcaaagguuggacucuagaugagggucaggguucuuggcuugccagggcaugcugaaagguauccggggagcggcggcggcggcgguucugacucgugcgguucucuucguccuccuuccuuccguagugccgcucccaccucaggccuucccgaaugauagguuauagugguuugguuugagucuuauauacgccguuuugacaggucccggugccgcggcuuaucacgaucucaccggcuuuacuucucuguucauuuccuuuccuagaauugucggcguccaaguucccuuuuauucugauucuuggucuuccgggaggcaggcugcaggauguuugcggucuguacuacacagguggcaugucagggcuccacauaagagaaagaaacccuaguuuccaguuccuugucaaaggagggagaggaguagggaaccuugggcuuaugagagaccacguggucuugugcuuuagugguggcuugauagaagccggcagcguuucuguuagacgugcagcccuucccuucuguuugaaagauaauguaggccugcaaaaaguagauaaguccacuugaggcuuaacuaacugcuaauauucaaacuuguaaaauaccaaagguuauacauuuaaaauacugaaggauguauguggacauuuucacacuugucgaccauaucaaguggcaucuacaauaacuuaaauaugugaauauguaacauaauuuaaaauuccuuauuuuuugggaagcauaaugugccucuucauuauaauaaaacauauuuucacuuuccacuguuaccauaacaguaguauauaauucauagaguguuucaguauggcauagugaaaggaacaguaagauuuagaccugaguuaugucacaguuucaccacucaacuugcaguauggcuuugaggagaguuaauuuaaaucauugcaccucauuaucuucaugcuguaaaauggacaguaauuuuauuauaaggauuuuaucuugauucguuuuaauaucuuaagaauuucauauuuaugagauaucaaauuuuaguuauccucuuaucucugcucuuuacuccugacaaaaggcugugauauugggaucauuuucaguuaagcuaauagguggcagacuuaggaccuuaauuuaaccuugaucuaagucuuagucucuuuuuucuuuuuugguaggcuauauacuauguuuguaugauagaaaucccuaaggauguaaauacauacuuguuucauuauaucaaaaaaauagaaucuucaagugacuuaauaauaguuauuguuggccuggcagggugguucacgccuguaacccagcacuuugggaggccgaggagggaggaucacuugaacucaggaguuccagaccagccugggcaccauggugaaaccccgucucuacaaaaauacaaaaaaauuagcugggcaugguggcacgccuguggucccagcuacucaggaggcugaggugggaggauugccugagccuaggaagcggagguugcagugagccgagauccggccacugcacucuagccugggcaacgugagacuccaucucaaaaaaagaaaaaaaaaaguuauuguuuuuauuauaauguuagauguuuauuacuguggggaaauuggacauuuccuaggacacccauguuuaccuuggcuugugguaaugacaaauaaguccccgcuggcuauuguaaguuaaagaacauuuaaaaauucuuaauucacccaaccuaguaccaccuuauuuuaaaaagugaauuuccuuaaaauagaaaucuguaagucuauaaguuaaaauauaaguguuauugucucucauuaaugucacguuuuuguauauagaguaauugguagcauugacacuacaggaugauaggagcaauaugugcauugugggcguuuaacuuuaugaaguuugguauuuucaaauaaguauauuuuugcuuuuuuacaaaauuaauguaaauuguuuuauauaugugcgugugugugugcguguauagcuguauagguacagugucucacuauauugcccaugcugaucuugaacuccuggcuucaagugauccaccucagccucccaaaaugcuaguauuacaaguaugaaccaugacuaaauacaagaggcucauaaauuuaagucauuucagugcuuuuauuuuaaauaaaaguaaacugagggccacauauuuagauaaaagcagauugugcaaguuuauccucacguuaauuuucucuuaaaggaaaaaaacugcaagagaaagaugguacugggaguugcagaaaccaguuugguuuauuugugagccaguuuauuugcaaauuagcaagugaaaccuguccaaaaacaaaguaguagagagcaaaaauuugauucagaauuuuaaagagaauaauuugauaaguauaaauuugaugaugaacuuacagguacagaacugguggugauauguaauaauuuaguuuauguuuuuggaacucacuagaaaguuguuuuuccuuuuaauaucuuuuuuuaaucuuugaaucagguuauuugaaauuugcccuguggaauauugucguggcauauguauguaacugucuaggaaagacugauugggcuguugagaaaaaaugguggguuuaccauaaguuuauucuugaaaguuuaauacacaugucugaaguuauagucauaugcaucacagugaauaaauuucauuuacuagcuuuugagcacuuugcagauaaugacugucucaugguaacucggguaacuaacuuccauaccuaggcaaguauaaagauuuauuucauucuguguaaguacuacaguuucucuuuauuuguaagcagugaaugauuuuuaucuaaaaacugauuuucuagagaugaaaauaaguuacacaagugugagaugaagagaaacauacuuuaugauguauuuaguucuagacuuuauauugagaaguaaaucaaaauuaauacgagaguaauaccuuuuuaaaaagcaagaagaagguagcacugauuuguauaaggaauaaagcagucucaaaaugauauuuguugaucuguguuucaauuucaacaagagaucagaaaaacacgaacaaaauuuagaguuuaggaacuauaggaaagagauaaaugaacuagaauuguaucgcuuaggaugaauuaaaaacaauuuucagauacauggugguuucuucugaugagacaaaaagauaauuugcuuaagguacauaugaguauuuuaggaacauauuuaaggaaugguaguuaaugaguuacaaagaaaauuauggguuauaaaauacucucuuuggaaaaaaaguuuuugaaacagagucucgcugugucgcccaggcuagaguacagugcguggucucggcucaccgcaaccaccuccaggguucaagugauccucccaccucagccuccgcaguagcugggccugcaggcacaugccaccacgcccagcuaauuuuuuauuuuuaguagagacaggguuuccccauguuacccggguuggucucgaacuccuggccucaagugaucugccuaccuuggccucccagagggccgggauuacaggugugaaccaccugcaaaauuucuggccuggaaauuuuuaaagaaaugggccuauuaugaguaaguaaaacauaaccacaaaucauccaaagcacugcuucguuuccaccauuuuuauuaaauguuauucaucugccaaucauuuucaguaauuuuuaugugugauuauguuaagugguaauguguaguuaacuuuugcaguuuagcaaaacauugcaugccauuuuuguauaaacccuaauaacuguaguagguaacuuuacagaguaaguaauuugugugugaagucauuuaaaaucucugugacauuuucauuucaauaauugccaaagaaucugaucagugaaguuuuagacaagagacauugauuucaguuuuuagagcuuucuguccauuccgacuuuuacuuagaaaucuuugaggcuuaauuuuauuugaucccuuauguucgugcaacuuugaaacuaaaagaaaauaaccuuauacucacaaaucccuuaauaaugaaaaggaacacuauuacucaacaugaauuucaaaauauuuaguguauacuuaaagaaauuuuuauauuacuauuacuuuuaaaauuaguuucaguagugccaggguguuuacgaccagaguaggguauauacuacaucauuuauaggaaaugaaacuaaaaggaaaaacuucuucagucuugguaaauuggugaaaacaaggacagagauagugaccuuaaggcauguuucacaucuuagaugcuuaaaaaucuaggaaagcaacuuuucuuaauuuaagccuuuuucguaaguuuuuaaaugacuucuguuagugaguccaggguuaauguacccuaauaguccaggaagguccagagcuagucaaugauuucguuuaucuguuuugugaaauuaaggcuuuuuuuccuaaauuauaccauuuuccuguuagcacauauaaggcauuaaaugaccuuuuugcaaaaugguuuugugacaguuaacaauuuugcuucuacguaaguguaacaagauaaaaucaguuugucaggccaugaccuguaauauuacauuuaaaaacacuaugugccagguacuguuauaaaugcauauugacuuauuuacucaucaccauauuaccacaauucugggaaucgguguuauucacauuugacaaaauaggaaucauaggcucaaaaagguuuucacauagugguauagcugggauuugaacccaaguaguuuaggucuuugguuugugcccuuaaagcacuguaccacauugccucugauuuuauuuaaaaaaauuuuuucuagagacagagucucgcuucaucacccaggcuggaguguaguggcauagucauagcucacuguagcuucaaacuccuuggcucaagcaauuuuccugccucagccucugaaauagcuggaacuacaggugugcgccaccacacccagcuaauuuuuaaaguuuuuguggagacgggaucuuacuguguugccuagacugguuugaaacuccugaccucaaaugauccucugacuucagccucgcaaguauuaauagcugggauuacaggugugaaccccuaugcccagccucugucucuuauuuuaaagauucauuuuuuaaaaaguagauucacuuuaaaaagaaaagaaccuauuuuucuuuuuaaaggaagucuauuuuauauuuaguagcagaauucuaccauuugccucuugugacuguucaguuuagauaugauagaacauguaggaaaucuuaacaccuugcuucuggauauuaaaacaugcuuaaagauugauaggugaauaauugaauguacagagcaaaugucauuuugauccacaaguacauucagacaaaaaaauuugaggucauuuacuauugagcuuuugaauuuuaauugucuaucaauaaucauaagcucuuauuagagaugauauggccccuucacauauaguuuuacagaaauaacccaugaagcauauaguaagaucuuguaggcuauuuuguuucgguacuugguccauauuuuaaaaguaugguauugguuuacuauaagccacaaauacauacggcuuucuucuuggacuuaaauccauaugaaccacucagcacagaaaaugcaaauaugaaugcauuauuauguucaccaacugauuuuuucccuagagauaacucuuaaagaauuuuugaagugaaagaacauuuaaauuaagauaguggaagauacaaugauaauaaaacagucaauuuugcuaucuuagucuugaauuuaucuuaugaugugaguuuagagugauucuucuuuuuuucacugaaaaucacuucauuaauaagucaugauuauugacaaaaguaaauugaaaccauugggcauauugguagggaaauaaggggaagauagagaacaacugauaaagguugauuaugugcauuacgagauuugauccucaaaagaaggaccaaaauauauauauuuauaugacuuauagaugaggaaucugagagaaauuaauuugcuugcucauaguuuacuaccagcggacauuuauuaaaugcuuagucugucgcagccacuauuuuaaaugcuuuacacuuacauagccuuuaaaguacaugcucuuauuacacuucauuuuaucuuugaugauuucagagcugguuuaaauaccugguuuauaaagauuuaaaguacuagauacuaucuaauacuaagaauagauccuuaguauuaaaaaugguuuuaugcugucacuacucgaauguaauucaaacaauauuucauuaaaccaugggaauuucucuuuuuucuuaguccuuguauagaauuuuucaacaauuacuaaauacuuuuuuucuucccugaguaaugucagucuagcuuguuucuuuuaauuuccucacuuaccacuguaauucacauucugugucucauauucauuccucugaagccacuucgccagacucguucucccauuuauccuuuaaacaggggaauguagauccuuuagauuuuaucacccaguuuacacaaaagucacuauucaagaaaucuagcauaagccuaguaaguagccucaguuuuggauacagauuaaaauuauuugagggaagggucaaaaauggcuccuuacaaagaaggaaauaaguuccaauuauaauauaaaacagaaaaccccuguaggauuaaccugcauuugauuaugucuagacugccuuuacuacuuccaucacuaagauucuacaugguuuccuuauagcucuccaaaaagaaaagaguaaugaugccuuuuuuuccuccaaggaauggagaacuaagaaugcuaacugucccuuccauucucccuuuaguuuugagaagacccagauauuagcgugguaauuccccaccauaagagaaaaucauuuagcagaaguaccaguagcaaggacuucuuugugaaggaagucaaagaucucacaaagaaguucaaggguggcucugaggccaggguauucuaaguuuagagccaguuaaaucaagaccugagaacauuuagagacaaaguuacuuaacugaaaagagcaucaaguuccuuguuccagguagaaaacaccugguaaucuggauugauuucuguuauuuacccauauguuuuuacagcuuaacaaaguuuaacagguuagucaagagauuugccuuugauaaaaagaugggaaauuuauauucauacauuugaauggauuucaagcugaagaacuuuuuaauucucaggagagauguagcuaaguauuuauauguaccacauaguuguggcuaugguuuacaauaacuuauuacucauuuacuauguuaagagcauuuuaaaaguucucuagauacagguuccauauauaauguaauauauuuauuccaaauauauuacauauaugaaauacaugguaguauucucauuuuaccaguacagaaacugggauaguuaaauguauauggucauaacacuuagucagugguagagcaggaggucuaacuuaaagcuugcauuuuaaauucuaaguguacugccugccuaugugugauagagccauacccagauuauggaagcaacuuuuugaaagacaaauacuugaaaguauuaaaaucaagaaaugacagcuuuguaauacuuguuaaacacauuuucauuuguuauuaauaucaagagccucuagaauuuugugagucuucuuguuuuagccuuguagucucagcagucucauuucuaauuaacauaucucuguuuugauacagauagugucucccauuuccugcaaauuauuugcuuuuuccugcuuuuggggccuuuaugccccauuucuguuguuucagauacuucuuaaaaauuacugacuuucauuucaaaaccuaguucaaagucagucucuaaaaccaccucuaaucucauccaaauuuguggccccuccauucuuugcuuuuaaaauauauauguauauauaaaacagcuuuauugugaugcuauucacauaccuuacaauuugcccacuuaaaguggacaguucacuggguuuuaguauacucgaaagaguugugcagccaugaccauaaucaauuuuggaauccaaaaaggaaccucauacccauuaauagucaccucccauuucucucccaaacuccucuguucuaggcagcuacuaaucuauuuucugucuuuauauauuugccuauucuggauauuuuauauaaauggaaucguauaguaugugcgauuuuugcaucuugcuucuuuuacuuagcauacauguuuucuagguucaugcauguuauagcauauaucaauguuuauuuuuacugcugaaugauacagucaugagucacuuaaugacaaggauaacuucugagaaauguaugguuaggcaauuuugucguugugugaacaucuuaaggggguacuuacacaaaucuagaugggauugccuacuacauaccuaggauguauugccuauugcuccuaggcaaaaaaaaccuguacaacauguuacuguagugcauacuguagucaauucuaauacaaugguaaguauauauauauguguguguguauaaauauauauauguguguguguguauauauauauaucuaaacauagaaaagguagaguaaaaauacaauauuaugaucuuuuuuguuuuuagagacagggucuggcucugucacccagacugaaaugcaguagcccaauauuggcucacauugcccuugaucuccugggcucaagcaauuccacugccucauccucccaauuagcuaggacuacaggcaagcaccacugugucuauuuuuuauuuuuauuuuuuuguagaaaugaggaucuugcuguguugcccaggcuggucuugaacuccuggccucaagcacuccucccaccuuagucuuccaaaguguugggauuauaggcaugagccacugugucuagccagacauaaugugucuguuauugaccuaaauguuguuaugugguaugugaccauauuccauuguauagauauaacacauuugauauauccauuuaucaauugauagacauuugaauuuccaauuuuugccuauuuugaauaauccugcuaugaacauccauuacaaguuuucauuucucguguauauaccuguaaguggaauugcuaggucccuguuuaacuuuuuaaggaacugcuagacuguuuuucuaaguggccguaauuuuacauugccaccagcaguguaugaggguuccaguuuuuucaccucgucagcacuuauguucuuuuuuuuaauauauagccaucuuaguggauaugaaguaguaucucauuguaguuuugauuugcauuuucuugauagguaaugauguugaguaucuuuucaccugcuuauuggccauuuguaugucuuuuggaugucuguccagauucuuugcccauuuaaaaaauuugguuauuuugucuuuuuauuauugcauuguaaaaguucucuagauacagguuccuuauuaaauaguuaauuuacaaauuuuucucccauucuguggauuuucuuuuuacuuucuugguaguguccacugaaacauggaaguuuuuauuuuauugaaauucaauuugccuguuuuuuccuuugucacuuuugcuuuugguaucaugucuaagaaggcuuggcuuaacucaaggucaugaggauuuacucauauauuuucuuuuccaaguuuuguaguucuggcucuuacauuuaagucuguaauucaaucgaguuaauuuuuuguguauauggucaggggaggaguucaauuucauucuuuugcaugugguuauccaguugucccaaaacuauuugucaaaaagaucauucuuuucccugugcaauuaucuugguacccugcuugaaaaucaauugacuguaaaagugaggguuuauuucuagauucuauauuugauugacauauaccaguaccagauuauaacuguguagacaguuuuaaaaucuggaacuguguccuccaacaacuuuucaaguuuguuuuggcccucuucucuuauuaguuuacacuauguugaaauguuguuuuguaaauauucuuaaauauguguauuucauuacuccguauaaaugacacacucaucuuuuugcagccugucuucuuaccuucucucauucgaaaucuaccccaucucuuuauuucuuagagguaugugguauaguaguauuugcagugaauguuuugugucauuuaacccauggaucucucuuccacuccuaaucucaugccccaaaagcacaaacaaugcgcugucuuaagaacauagauaagugugcuaauuaucaaaaacacauuuacaguaccuggaaaauguaagacaacacccucagcagaugaaaaugaccuggcauccuaaaaggaggcuaaacucacauuaauccuucaaaugaaaaaaucgucacaucauacccuuuaaauaaugcuuuaaaacauucaaaauuauuuaugaauaauuauuuaugagucuuuguggaaaugcaguuaugcaagaaaaguauaaaaauauucauggaaugauaaaugcuaaaucagaguaaggguauuccaagagaggggcccacaaggggcuauauuaauauuuaugauaauuuucuuuaggugcuuguuuugaugguauguauauagaugcucguuauuauucgaaguuuaauguaugccuuuauaugauacaaaauacuuuuaaaaagcgaaguugauuguaagagcuuuuuauuuugaggaagucccaauuuuucuuaguuuuuucuguuuauuauuuuuauauuguuaauaccaaaccuaauucucccgguguagaaaaguuacacagagcugagagaauuuauguagagucaagcauuauuaauuaucauuuccuucuugcuucauauaugcuuaucacgcuuauaugucacauaugguuacaagauaucuuuaguauggagagacauacacauuuaagauauuaauggucauguauguguauucuggaugaauaguuuaaaaacaaucuuacuuggccuccuugaguuucuuauuugucuuaguuuagaucuaaaaagagaucauaaaaauuauuuauugcuaggugauggauuuaauguguggagaagaaaauagguuagaagugcauggaaucuaaaaauuaagcuauaaagagaugguaaacuauuccauugguuuauuugagugaauuucauaguuuuauuuguuucaguuuuacugaaaccaugaaauucugagucuuaguuugugguacuuaaaaaaaaagucagugaaauaucugauuuauaauaauuuaaaauacuagaugcugccaguaucuccuuaguguugaaaauuguuuuaugcuaucacuacucaaauauaauuuaagcauuuuguuaaauaagagaauuagucauaagagugaauuaguauccagaauuguuuaugccauucugcacaagaugauuauaaauauuuuucugagauuaagugugcuacauuggauuaggcugagauuuuuguguauuuuuuuacuuauaaaaggacugccuaugccuacucuguaaagaggcagauaggauuucaaaaaauaaacaagguuauauuuauuuuaauauuaggcaauuaagcaggaacauuuaucugaaaauugucagcauaaacauguacaaaucaauaacaacaaaaaaacugcuuuacuaccucucugguuuccuaaauccugcuguuggaauuuccacauauuccuuuuauacucuguuguaucuggaacuauuucuuaaucauuuguugguccuuguauaucuuucuuaaauuugcaucuaguguaaaagcaccaaacaacuuuugauauucucuuucucccugccaacuccaaaaccuuuuacauucauauaguagcuuuacugcauuugaacagugucuuaaaauugacucugaagccccaguuucuccagagccauugaaaauuauucuauccacaccauaauacaaauuauuuaucauaaugccuucagaauauuuagcaccauacaauuuagaucauuuugagguauucauguuaauauaacuuuauguaaguuuuugacguaguauuucacauguauuugaucguuccaguaaucuugugagguagucccaguggucuucaugaaauguaaaucaaaucauaucucuuuacaguuaaaaaucuuucagugguuuucagauuacuugagaugaaauccuugucauugcauuaaaggcacuauuuaguucggucucagucuaacucuuuagucucaucuaccauuucucccccaccuugucauaaacuccaacuuuauuuagucauuccuucaacacucaaaauucccaaaguccuucuggccuuagcaugucauccucauucaguuuagauacuuuuucuuaccacuuuucuuggaguaacucuuauucagaggcuaaaacauuuuuucagagagauuuucauuuauucuauauagggcccucauuauaugcuuucauagcucccuguacguuuacuucacagcacuuaacaauauuuuauuauguaccuugauugcuuacuuuuccucucuccuccacuggacucuugaacaaagggaccuuggcuguuuugccaaccacuuuauucauaugaaguauuuuuugaaugaaugaauucccauuucuaagauggacagucgaaggguuuuauugcugaguaacuuuucuaagacuucauagcaaguagugucaaaaauagaaguuugguguggugcuuuuucuauaguaaauuuagaauuuauaucuacucaagucugauuucaggagauaagaauauauauaaacaaaaauaaucaugaaaacaaauugagauugguaugacaaauucauccacaguuuaguguuugcuacauuucuaggaaacuucuucagagaaugguaguguuuuugugugugugugaucuuuauugaugugaaaacaugaaucucuuauaggcaugcgugugaacauuugggcucuuauucuacgaaguuucugauagucaaagcucuaacccuaaagauacucacuuugaaaauacucauuuucucaauaaguaaaguggauuguuagaaauuguuggaauuuaucuucuaaauaagccuuccaguucuauuuauagcuuggugauaauguuaucauauccucugcuaucucacuuuuaaaagugaacuuauuguuucauaaagagggagugugguauaugauuuuacuaggcaucuguuacauuucuaggucuuuguuaaauaaauggaauuuaaaguuugguguaaugaaaagaacacugaacuuuagagucugaaaacuagagugcgggacuuuguguacccaccgaguaguguuacaugaccuugauaaguuauauaaccucucugaguuuuggcuuuuccuucuguuaaaaaggaggcugggcacagugguucacaccuguaaucccaacacuuugagaggcccuggcaggaggaucacuugaggcgagcaguucaaaaccagccuggggaacauaggauuucaaaaaauaaacaagguuauauuuauuuuaauauuaggcaauuaagcaggaacauuuaucugaaaauugucagcauaaacauguacaaaucagcaacaacaaaaaaaaaaaacggugcauuuacuaccucucugguuuccucaaauuagaccugucccuacaaaaaauuuuuaaaaauuaaccgggugugguggugcugucugucgucccagcuacuuggaaggcugaggcaagagaaucacuugagcucagguguuugagguuacagugagcuaugaucacaacacugcauuccagccugugcaagaguaagaccaccucaaacaaacaaacagauaaauaaaugaagauaaauaaaagguugcucuacccugucucaaaggaaggagggaagggagggaagaaaaagguugcucuaccaucaacuaauauaaaaacacuuuguacgaaaaccuuauauaaacauuaaacauuuauauuaugcagauacuaagauuuuaaacagaagugagaugaucacguuugugguuuuaaaauguuuggcagcagaguggaggacagcuuggaagcaagcaaaacuuaaaguaguuggacaaaucaagcagcuaucauaguaaucuaugccacuaaaaauaguguggaaggggagcugcagaacuaaaguacuuuucugaggaugaagaggcgaggggcagacucuuagaaauauucuggaggugcuugguuaauggauguuauggagcggggaauauagguuaauauucugguuuguggcuugggaaauuaaauuacugaugaagucacuuguuaaaguaauaguagagaauggguaaauggagagagagaggauugacucaagguugagaugucuggaaaauccaaguugacauggacuaauaggaauuggaaauacgauucaagaacuugaggacuagcucugagaugcagauuuuggaauuauugauaugaauuauaggagaauauaaacagugaaagaagaaaucaaagagcagggcuauguaauacauuuaagcaaaagagaagguuguaaaaaaaauugggaggaguaucacccccccacccaaaaaaaaaaaagaauuacagaggcuaauuuuuagagggauuaauagauauauaaaauuaugaauccguuggauuuguuaagguggucauuggugauuugugagggcccauuagacuaggaagaccuguaagugaaaguugaggaaauggaaacuugagaagcuugacuguaaggacaagucauaaaaugagaauagaugagaaaauacgagaguugagaggugauaugaggggagaggaggaaaagacuuaaucccuguugaaaugcugguaggaaaaggucuccaaggaagcagaaggaaauuagauccacagcauaggagcaaaaauuauuggccugggauuugaggaagauuacuuccucuacugauacguaagggaaucagguaagauucaggugugaugcaguagaguuggacaggcuucugacugcuuuguaagguagguagcaagguuguucaaccuaauggguuagagacuagguaagacugccaaagguuugaaauaauuauugaggauauagaaggguaugcuauggacaugguggaagauuacaggucaucuuugaaggacuugagagauugaaaaccauaggucuucagucucuauaucauuuucuuuaguaacuaugaacccagauaauauuaacauuaugauaaaaauaauuucagauugauguauguaagaaucguguguaaugaccagguaugaggcacccucauaaaauuccuuguaauccucugaaacaggaagauuauagugauuaagccauagaucuuuuagauuauacauugguacauuuacuucauaacuucuuuacaggaacacagucaaaugucuuaguauucagaaauacuucaccuuugguuucauuuauaaagcauugacuccuuuguauaagaaauuuagccuguucaucacaaaacaauuuaauuacuacucugggcugcucaagaugguuuguacauuaguauuuagaugaauuuuagaugguugcaggucuguaguuaguauaauauuugguaccaaaauuugaucagcuucaaaucaguaaauaugucaguuuuggaauuguuuguuuugcuuauauuaucuuccaagauauaaaggguaauaaucuguccuuuaugugcuuuuccuuuuauaugagauaucacucauauaaaaucauauaugagauaacacucauuauuuuucuggcuuauucacugguugcucuaguuaccaaaaggaaguauuuucucaggaaugaauacacuaccguauaucagaaucacauuuugauaaauuuagaaaugauugcaaaugaauugugcuuuuccaagucuugaagaaaauucuucaagacuuacguaaauuuuuaauuaaaaucuaaugcaaauucaccuguuuagaaaaaguacaacuauaaaaaauaaauacaaaagaucauauaaaguuaugaauuuuuucagaaauaaaaaguaaugaauaaaaacugugccuuuuaugcauuuugcuguguauauuuugucccaauuuuuaaauguguuuguaauuaguuuucuuauuuuuaugcauaaaauuuccauuguugacugucacugaacacuaucacuuuugcuagccucaauauuauucuuagucuauuugacuguacuucauucugugugcauauaugugaagauguaucuauacauaacuucuguguuaaacaaaagacguuuacucuugcuguuaaaacuuucuggcagauuuuggauaacccuccuugcaccacuugauaauaacucacaagcugcaacucuucugaauuccacuuccacaagcagacaaucuuuuuuaagauaaaaugucauguuuauuaugguauuuauauauuuccuaaccauucaacacauguaaagcugugcuacuguuuuuauuaucuucuuuaaaacaugucacugacagugcuucagcaagagaaggaaggggaugguauuagggaagcaugcaaaccuguacagcauguuaccauacugaauaguguaggcaguuuuaauauaauguuaaguauuuguguuucuaaauauagaaaaagaacaguaaaaauggcauauaaaagauuuuuuuaaaugguacacuuauuuagaacacuuaccaugaauggaguuugcagggcuggacguugcucugggugagucagugaguuaguagagagugaaugugaaggccuagggcaggguugucccaucuuuuggcuucccugggccaaaucagaagaagaauuauugucuuggaccacauguaaaauacacuaacgcuaaaaauagaugauaagcgaaaaaaaaaaucacaaaaaaaucucauaauguuuuaagaaaguuuacgaauuuguauugggcugcauucaaagguguccugggccaccugugggccucagguuggacaagcuuggccuagugcauuaauguacacugcuguaaucuuuauaaacaccauacacuuaggcuacacuaaguuaauuuaaaaauauuuucuucaauaauaaaauuaacuuuagcuuacuguaacauuuuuacguuauaaaccuuaaaaauguuuuaaauguuuuugacucguuuguuauaacacuugguuuaaaacaccaauacauuauacagcuguacaaaaauauuuucuucauauccuuauucuauaagcuuuuuucuauuucuaaauuuuuucuaauuaaaaaguuuuuuugccguaaacuaagagacaaacacacauuaaccuaggccugcacagucagggugaucaguaucacugucuucugccuccauaucuugucccauuggaaggucuucaugggcaguaauauucauggagcugucaucuccugugauaucagugccuucaucuggaauacuuccugaaggaccugccugaggcuguucuacagcuaacuuuuuuuuauauauaaguagaaggagcacacucuaaaauaacgauuauaguaacaaaguauaguaaauacauaaacucauaacaguuguuuauuauugucaaguauuauaugcuguacauaauuauaugugcuauacuguuguaagauuggcagcacaguaggucuguuuacaccagcaucaccguaaacaugugaguaaugaguuaugcuacaacaucacaauggcuacaucauuaagcaaaagggcuuuuuuagguacauuaugguguaugggaccaccaucauauauguaguuugucauuggcaagaaagucauuaugcagugcaugacuguauacagaugguccucaacuuaaugauggaguuacagccugcuaaacucauuagaaauugaaaauauuguaaguaaaaaauccauuuaauaugccuaacguaccauacaauauagguuagacuagccuaccuuaaacaugcuuagaacacuuaaauuaaucuacaguugggcaaaaccagcuaacagaaaaucuguuuuauaauaaagcauugacuacuguacugaaaaugaaaaacagaaucaucguauggauauuagaaauaugguuucugcugaaugcuuaucaguuucacaccauuauaaaguccaaaaaucuuaagucacaccguaaguugaacugucuauaucaacuuuuuucauuguaguaagaauacuuaacaugagcgcugcccucuuaauuuuuuucuguacaauauaauauuguuaacuauaggcacaauauuguacaauagacuuacucauuuugcauaacugaaacuuuauacccacugaauaucaucaccuccuuauuucuuccuuuccccagccccuggcagucaccauuuuacucuguuucuaugacuaugauguuuuagauaccucauaaguggaaucaugcaggauuugucuuucugugacucauuuacuucauuuagcauagugaccuucagguucauccauguugcugcauauggcaggauuuucuuuuuucaggcuaaauaguacuccauuuuucuuuauucuuucauccaucaaaagacauuaagguuguuuccgcaucuuggcuauugugaauaaugcugcaguaaacaugauaguacauauaucuucaggacucugauuuuaauccuuuuggauauguacccaaaaguaggauugcuggaucauauggucauucuauuuuuaauuuuuugaggaaccuucauaccauuuuccauagccagugcaccauauuauauagucuacaagaguuccaauuucuccacauccucaccaacaguuaccuuuuguuuuuuucaauaauagccauccuaacacgugugaggugauaucucauugugguuuugauuugccuaauuaaguguuguaacaccuugaaauuuucaaaaacaagcauuagaaaagaaccgacugcauguauaauaagauagagcuguaauugauuuuuuccuuuaugcaugaucuguugugccaguaccuuuuauagaauaguccaucuuugccuauuaguuuguaaugaugcuuuugacauaugucuucauauauaugugagucuggcucuuauuucuuuccacuguuuucauuggucuuuuuacuucucucuaugccaauaucacauuuucuuaaucacagcuuugacacuuuguaaccuugggcaaguuaauuucuguguguauauauacuccaucugaaauuaagauaauaguaccuacuucauuggguaaaugaaaauauaugaaugugcuuagaaguaugcacauggcucaagaguaaaacucaaauauuagugauuuuguuauuaaacuuaauaaagguaauaauuaaccuuaauauguuaauaauuaauaauaaauuaagcuuaauaaagaggcuuaguaaugaggaaacugagauuuccacuuuguuuuucuuccagacuuucuggggaaguggggagaggguuauggagggauucccugaagcagugacauuuaggcagauaugugaaagauuauaguuguuaacuaugugucuuagccccuucaggcugcuauaacaaaguaccuguaaguggcuuaaaaacagcaaauuuauuugucacuguucuggaggcugguaaguccaagaugacuagguacuggcagguucugugucuggugaggaggacacagcauacuuucugguucauagauggaaccuucuagcuauaguggaagggaugaggugucucucugggagccucuuuuauaaaggcauaaauuccauucgugaggacucugcccuuaugaucuaaucaccuccuaauucccuauccuuggggguuaggauuuuaacauuaauucugggggaggagacacacgcauucagaccauagcucuacauguugaaaagaauaagggaauuuucuagguagaagggguuaugaggcagaaaauggugugucaaggaaaugaaagaaggcucuugcagcuggaucugggcacaaagaaaaaugguaccagcugagucuaaagagguagcuagggauuagaucaugcaagaccuuuuagacaauguuaagcauuuuagacuucauccuacauaguuauaacuauuuguauugguugauauccuaaugacuuuaaguccauaaaagaaacucaaagugaaaauugggcuuaucuggacccuaauaguauauaaggauuaagaauaccauugagaauauaugaauucaggucuuuguucauuguuuguagucuuuguaaucuguugauuccguucuaguauuuuaucaguucagauugaacauugggaauuuuggcagauuucauagauguagaaguauaguuuuuacagugcaacagaucuauauaaauguauugaaauaaaaucuuuucauuuauuugucugugucaucuaaucuuaccuuucuuagucuucuuucuugucuacgucuucuaaucucaucuuucuaauauauaccuaacaacacuauacauuguuucuggaguagauucuccuauuuuucuuuuucuguuugcuuuuugagacagaaucuugcucuauugcccaggcuggagugcaguggcaugcucucagcucagugcaaccuccaccuccuggguucaagcaauucuugugccucagccuccugaguagcugggguuacaaaaguaugcgccaccacacuugacuaauuuuuguauuuuuaguggagacgggguuucaacaugugggccaggcuggucuugaacuccuggccucaagugauccagccaucuuggccucccacagugcugggauuacaggcgugagccacagcaccuggccagauucuccuauuuuucuacuuuccugauguuucauuaccauaaaauuguguagauagcccuaagagaaauauggugcccuuuuucaauugaagauaguauugaaagcaauuaaauaucaucaaaugggaaagucuccuaucauaauaguaucauuguacagaaagaagucacuacaagaucuaggaaagauaguugauacagaaauauaugacaauagacaguugacauagaaauguaugacauuauagaagguuuaccaaguauauacuuuuaguaccgcagucccuuuuuaucugcagaguauaaguuccaagacccucaguggaugccugaaccugcaaauaguagcaaaccuuauauacacugcuuuuuccuaugcuuacauauaauaaaguuuaauuuauaggccaggcacacuggcucaugucuguaaucccagcacuuucggaggccaaagugggagggcaccuugagcccaggagcuugaaaccauccugggcaacguagugauaucucaucucuacaaaaaauaaacaaaauuagcugaguuuguggcacaugccuguagucccagcuacucaggagacugaggugggaagaucacuugagccagggagguugagacuacagugagcugugaucaugccccacugcacuccagccugggugacagagcaagacccugucuccaaaaaaaaauaaauaaauaaguuuaacuuauaaauuagccacaggaagauuaacagcaacaauuaauaauaaaauaggacaguuaugacaauauucuguaaaaguuauguggaugugguuucucaaaauaccuuacuguacuguacuuacccuuuuuguaauagugugagaugauaaaaugcauaggugaugagaugacaugagguaaaugacauaggcauugugauguaaauggaagauuucagaaauaauuuauagguuuuaaauuacaugugugcugcauagcaugaugaaauacugugccauuccacccaaacugccuucaagcccucuugguuaucagguugacuguugcaguaucacaauccuuauguucaaguaucccuuauuuuauuuaauaaugacccaaaaugcaagaguagugagaguaccacaguugacaguuaacccgcagaaagugaaacugcagauaaaaggaggcuacuguauaacuguaaaggauuuauuaaguacuuugggagauaaaacucuauaucuuaaaaaugucuaaguaacuauaaauagaauuucuauacuuuuccacaaauuguuuuuaauguguuuuauaaaugauauuuguaacuguaguauuaauguuaucucaaguccauauucuauuuuuaauggauauggcauuagcuuuuuaagaaaacuaacgggaaauuuugcauuuccauuuuaaagggaaaaaucaguaacuaagaaaaauuaacugaagaucagagucuacccucccaaaugauacuauacuccccaguaguuuuucauacaaguaaaucauuaaggggcagauaacccguuacaaacuacuuuuguagauaguagaagaguaaaagcuauuccagguuuguucagaagaguacaggagaaaaagcuuggcaagugcagaaaauuuucaucaccuuuaacacuuagucaugauagucuaaacaaauguugaauagaaaggaacuucucuaaguucauaagcaguauuuaucaaaaaccuacagcaagcuaauaagcagcauuuaucaaaaaucuaccuaguggugaaacuuuaaauguugucauaaaaaaaaagacaaaaauguuugcugucucuucaccuauauuuuaggagcccuagccaagaaaaauaggcaauagacaagaacaauaggaauacaauuagaaaggaaugauuaaacacauuauuugcagcaacaguaugaguuuuuacauagaaaaaucuaagggaaccuacaaccagguaaaacuacuaagaguucaggaugcugguggauaucagauuaaucacuuaaaaaaauuaggcugagcacagugguucaugcuuguuauccuagcacuuugagaggccgaggcaggcggaucacuugaggccaggaguuugagaccagccuggcuaagauggcaaaacccggucuuuacuaaaaauagaaaaauuagcugggcaugguggcacaagccauaaucccagcuacucuggaggcugaggcacgagaauugcuugaaccugggaaguggagguugcaguaagccaagaucgugccaccacacuccagccugggcagcagagcgagacccuaucuccaaaaaacaaacaacaaauauuauuucuaugcaucaacuacaagcaguuauagaauuuaauuaauuggggaaaaaauguaaaauucacauagaaaaacugagguuucuaggaacgaauuuagcaaaacaugauuuuuauuggaaaaacauauaaaauuuauugaaagacauuaaccugaauaauggagagauacgccguggcuguggauaagaagacucacuuugguaaagauggcagugucccucaacuuuguaaguguaauguacuuccaaucaaaaucuuauuagacuuuuuuguggaacuuugcgaagaaagcaagucgaaugucugaguauaaguaaagucauugcuagucuagucaauauuuauuuuagaaaauaggauuuucuuaagacuuagucccucaauucuuuucucacaaaucuuaaauuccacaaugugugggggcuuucaauugcauaaucuugacagugaguucagaauacugguacauagauaauucugcauauccacuuuuagggaguuaaacucaugaauauucuuuaagaaaucugagguuuuguuagguuagugccuuugcuuuagcuauuuucggacguaacuguggguuuuuguucuuauagugcuauauaugguaagcauagaaaagaaacacuagaauggauaaucuucuaaaaagcuuuguuaccuguaguauuacacacaugagcuuuaaaucucucauuaaccuuuaucuuuaccuuugauucugcuugugauugaaccugguuaaaugugggagaaauguuucuagaaaaauuuaaaaucauugugaaccaaugacaaagcaguauuuuauagcaggcauacuguagucagaauaaauuuuuacaauguuuuagguuuuuuuuuaaugcuuucuauccuagugaacucuuguuuuacuuuuucugucauuggucaucugaugagaagcuaguuucuaggcagcugaaaauaagauggauauaguuucaguaauguuuacaguguuagcuguaucacacuuuugaaaucauucaaaaaccaauccugcuugccccauauuuuacuacuauaggaggaacagucagagauaguauuguuguuauuaacuucuguugguaaagaagcuuaauuaagguuuuaagaguugauuauacuuucuauuaauauuuuuauagauuuagggacuacaaaugcaguuuuguuacauggaugaacugcauaauggugaaguaagggcuucuaauguagccaucagcugaauaguguauauuguacucauuuaauaauuuaucaucccucuccugccucccacccuucugagucuccaaugucuguuauucacgcucuauguguauacaugauuuagcucccacuuauaagugauaacaugcaguauuugauuuuguauuucugaauuauuuccccuaagauaauggccuccaguuccauccauguugcugcaaaaaacauggcuuccuucuuuuuuauggcuaaguaguauuccaugguguuugugucuuuguguuuguguauguguguguguacaugagugugccacauugucuuuauccagucauccauuuauggacacuuaaaguguuuccuaagauaauggccuccacuuccauccauggugcugcaaaaaacaugguuuuauucuuuuuuauggcugaguaguauuccaugguguguguguguguauccauauaugcuacauugccuuuauccaaucauccacugauggacacuuagguuguuuccauaucuucacuauugugaauagugcugugauaaacauacaagugcaggugucuuuuugauagaaugauuucauuuccuuuggguauauaccuaguaguggaauuacuagauccagugauaguucuauuuuuaguuuuuugagaaaucuccauacuguuuuccauaaagguuguacuaauuuccauucccuccauucccaccauuccuuuucuucugcauccuugccaacaucuguuaucuuuugagcuucuaauaauagccauucugacugguauggaugcuuuuucacugugguuuuacuuguauuuaucugauaauuagugauguggaauuuuuuuucauauguugaccauucauauguguuaguuugaaauuuuucuguuuagaguaaacagacaaucuacaaaaugggagaaaauauuuucaaacuaugcauacaacaaaagacuaauaucuggacucuauaaggaacuuaauaagaaaaaaaacgcccauuaaaaaguggacaaagaacaugaagagaauucuccaaagaacacauacagacagccagcaaauguaugaaaaaaugcacaaaaucacuaauaaucagagaaauacaaaucaaaaccacaguaagauaccaucucacaccaguugaaauggcuauuauuaaaaaguuaacagauuuuagcaagauugcagagaaaagggaauguuuaauauguuauuggugagaaugcaaauuaguucagccccuguggaaagaaagcaguuuggagauuucucaaagaacuaaaaauagaaauaccauucgcucagcagucccauuacuagaaaauaaaucauucuaccaaaaagacacuuacacucauauguuuaucacaguacuguucacaauaguaaagacauggaaucaacccaggugcccaucauugauggauuggauaaagaaaaugugauacauggccgggcgugguggcucaugccuguaaucccagcacuuugggaggcugaggugggcgggucaccugaggucaggaguucgagaccagccugaccaacaugguaaaaccccgucucuauuaaaaauacaaaauuagccaggcgagguggcgcaugccuguaaucccggcuacucggaaggcugaggcaggggaaucgcuugaacccgggagguggaaguugcggugagcugagaucgcaccauugcacuccagccugggcaacaagagcgaaacucugucucaaaaaaaaaaaaaaagugauacauauauaccaugcaauacugugcagcuaucaaaaagaaugaaauuguauccuuuacagcaacauggaugcagcuggaggccauuauucuaagcaaauuaacacagauacagaagaccaaauacuguguguucucacuuauaaguaggagcuaaacauuggguauacacgaacacaaaauugagaacaauagacacuggggauuccaaaagagaagagggagagaggggaguagcgguuggaaaaaaaccucucagguaccguauuugcuacugggcaacaggaucauuagaagccgaaaccucagcaucacgcaauauacccauguaacaaaccugcauauguacccccugaaucuaauauuuaaaauaaaauuuaaaauuuuuuaaaacgaauuuaugauauaaaaauaaauuuuaaaaaucuguguucuuugcccacauuuaaaugaguuuuuuugguugccauuguugucauugaguaguuugaguuccuuguaaauucugaauauuaguccuuuguuggaggcauagauuacagauguuuucucccauuguuagguugucuguucucucaauuauuuccuuugcuguacagaaguuuuucaguuaaacuaagucacuuuugucuauuuuuguuuuuuguuggauuuguuuuugagauguuagucauaaauucuuuguguaggccagugaacagagaguuuuuccuagguuuuuuuuaggacuuuuauaaaaguuucaagaucuugaauacaccuugcguuaauuuuuguuguuguuguuuuuccaccuugaguuaaauauuuuauauagugagaaguaggggcccaguuucauucuucugcauguggcaauccaguuuucccuguaccauuuauugaauagggucuccuuucccagcgaauguuuuugucagcuucguugaagaucaguuggcaaagguauguggcuuuauuucugggcucucuauucuguuccauugaucugugugucuauuuuuguaccaguaccaugcugcuuugguuacuauaaccuugcaguuuaauuugaaguuggguaaugugaugccuccagcuuuguucuuuuugcuuaguauugcuuaaucuauugagauucuuuuuuuuauuucauaugaguuuuagaauuguuuuuucuaauucagugaaacaugauguugguauuuugauagaaauuacauugaaucuguagauugcuuugggcggggaaguaugaguuauuuuaacauuaucgauucuucugauccaucagcaugggauguuguuccacuuauuugugucaucuacaguuucuuucaucaguguuuuguaguuuuccuuauagaggucuuucaccuccuugauuagauguguucccuggcauuuuacuuuuuuuuuuuuuuuuuuugguagcuuugguaaaugaaacugacuuugauuugguucucagcucgauuguuacuaguguauaaaauugcuucugguuuuuguaaguugauuuuguaugcugaaacuuuacugaguucguuucucaaagaagucuucguggaaucuuuagaguuaucuagguauaagaugauauugucagcaaacagagauaacuuggcuuccucuuuuccaacuuggaugacuuauuucuguugccucuuuucuggcugugacuuuuaguacuauacugaaucggaguguguaagugggcauuuuugucuuguucccauuuuuagcaggaauucuuucaacuuuucuccauucguaugauauugguuguaguuucguuguuugugacuuuuauuauuuugagauauguuccuucugugccuaguuuguugcagguuuuuaucaugagauguugaauuuuaccagaugcuguuuuugcgucuauugagauuauuauaugguuuuuguuuuuaauuuuguuuagguggugaauugcauuuauugauuugcauauguugaacuuccuuugcgugccuggaguaaaacccacuugaucaugguguauuaucuuuucgaaugcuguuguauucaauuugcuaauauuuucuugaggaauuuugcaucuauauucaucaggagauauugaucuguaguuuucuuuauuugaugaguccuuguuuggcuuugguauccgggugacacuggccuuguagaauuagaaagggaagauucccucuacuauuuuggaacaguuucagugggauugguacaaguucuuuguaugucugguaguauucagcucugaaucuguccucuccugagcuuguuguuguuguuguuguuguuguuguugggagauuuucaucuuacugauuuaaucuuaguacucauuauuggucuguucagggcuuccaguucuuucugguucaguacaaucuugggagguuguauguuuccaggaguuuacccacuuccucuagguuuucuaguuugugcauguagugaugcucauaguagucucugaugaccuuuuguauuucugcaguauccguuauaauaucuucuuuuuuauuuccgauuguguuuauucgaaucuucucucuucuugguuagucuagcuagcagucuguccguuuuguuucucuuuucaaagaacuaacuuuucauuucauugaucuuuuuguauuguguuuuuggucucagugucacuuacuuuuccucugaucuuuaugucuuuucuucugucaaauuuggauuuaguucuuguuuuucuguuucauugggugugacauuagguuguuaauuuguguguguguguguguguguguguguguguguguguguguuuagacagcaguauaaacuuuccucuuagcacugcuuuugcuguaucccagagguuugguauguuguaucuccuuuuucauucauuuaaacauuuuuuaaaauuuucaucuuaauuuuguuguugacccaaagaucguucaggaacauguugcugaauuuccauguauuuguauagcuucaagaauucccccuugggauugauuucuagcuuuauuucacugugguuuaagaagauacuugauaugauuucaauuuaaaaaaaaauucuuuaagacuuguuuuguggcauaccauauggccuauuuuggagaauguuucaugcaugaugaaaaagaauguauauucugcuauuuggggcuagaauguucugcaaaugucugccaaauacauuuaguuuagaguccaauuuaauucugguguuucuuuguugguuuuguguccugaugaucugucuagugcugucaguggaauauggaagucccccacuauuauuguauugcuguuuauaucuuuucuuaggucuaguaauauuaguuuuaugaaucuggguuugggucuucugguguuggguacauauauauuuaggauuguuaugucuuucuauugaauugaucccuuuauaauaacuuuguguauuuuuuuacuguuuuugauuuaaagucagcuuuaucugaucuaaguauagcuacuccuacuuguuuuugguuuccguuugcauggaguaucuuuuugcaccccuuucuucagucuguaaguuucuuuaccacuaaggugaguuuauuguaagcagcauauaguuggaucuuguuuucuaaauucguccugccaaucuuuaucuuuuaaguagagcauuuaacucauuuauguuuaagguaaauauugauaugugagguuuuauuccuguaguaauguuaauuguuaucacauugcuuuguaguuucguugguguaauuauuuuacaagaccuguggauuuuuuacuuucuuacauuuuuaugauggcaaguauugacccuucauuuccauguuuagacuucccuugaucauuuuuguagagccagucuagugaugacagauucccucaaugauuguuuuucuaggaaagacuuuauaucuccuuuauuccugaagcuuuuucuagcaggauacaaauuuucagguugacaguuuuuuuuuucuuuaagccuauuuugaaaauagaaucccagucucuucugacuuguaagucaucugccaggaagucugcuguuagucugauggaguuuccuuuguagguguccaaaugcuuuucucuugcugagaccacacagucugaugacucuaugucauggugaggcccuucuugcaauguauuuuucuggguuucauugagccucuuacucuggaugucuagaucacuugcuggacaagagaaguugguuuuccaaacuuuuugcuuucuuuucuuuucuuucucgagaauaccuacaauuccuagauccagacauuuuauuguagucuccuacuucucaaaggcuuuguucaucuuuaacauucuuuuuucuuucuucaaaagaccugucuuuauguucugagauuguuuauucuccuugaucuaguuuauuguugaagcuuucaucuguauuuuguaaauccuucagugaauuuuuuauuuucaaaagauuucauuuauauccuuaauugauauucuguuucuuuguguugguuuuucacauuuuccaugaaucucauugagcuuccuuaaaaaucaauauugugaauuauuuagcauuucaguaauguugguuaggauuuauugcuagagaguuagugugauccuuugaggguaucguaacacccuguuuuuucaaacuuccagaauuauuacacugguucuuucucaucuggaaaaacacauuucucaguuugaauuaauuuuuguuugaacgagacuguuuucccuugaggaugugacuguaauguauguugaauauggucauuuggcuuugcuucugggugcuuuuaguggcaaagacucuauaugaauuuccugguuuuagauagccuuugguggcuuucucaaacaucaggugugauagugguauacuuggcuugugagcaggcucacagccuccuguaagucaggguagcagaggucucaagaaguguaucuuguucccaaauugugugcauuuauguuaccagauuggguugugcaguucaucuccaggccaauaaguagcauuugcagguaugagucagcuucagugguaacagugggguuuacgcuugaccuuuguuugccagggaaagcucagauauucugaugacuggcagaggcaccagcccugacaaggguggcaggggagaggggagucauugggccacugguaaaaugcacugaggucucuuguggagaggggugggaugggggggugugggccaggugaugagcugucuuagcacccuggccucagcaggcaggaaugugauguuucccucucacacuccuauucuggugcucagguuguucaguucucuuagacacugcuguuuaucuccaagcugcaauguagccuagaacuacaggagaugcuugccccauggcuugacaguacacuucugugcuaucuggaaaugggugccaugcagacucugcucccuccccauggcaggaccccugaaacucuaggcagagagugggacaggacccaccuuucucaugaaccugggcccagaggccacugccaguggaacugcaguugccccucacagcuucagauagccugcccucugguuucuugugccagcuucccaugggagcagcaauuacugugucugcagcaguggguggagggggaggagaaguucccuucucuaugucugggcucaagcacagaggccacuuggccagugguacaggaccuuacuccucacuugcagugcugagcagaguuugugucucugugucucugccaggagcaggcauucacuugcagccccaagcagagagcucuuggggggcgcuggaaaaugcaugcuuugguuuccuuugucccagaggcuguccuuuuggugcacugcacuuuuccuucucuuaaaaguagcacuccuugugggauagauuauugggaacccugcagcaccccgggucuaacuagcacugugccacugcugccugcugagugggugcuggggaaugucagcaagagcucccaggauguggaagcacaagggcugagguucccugggcaagauaaaguccccugauggauaugcucugauaaugaugccuugccacagaugcucgagucuaggauggugggaaggugagcaacccagcgugagcuugcagucugguguaacacccucaagaaaucccuacccauaccacagucuagguuugugagagcagaggagcucucccauagaucgcauacuagcacucugccacaggaaugaaggaucccaaacacucucgcuuacccuuuccgugcaacaccaagucccuuggggcucccagccacucuuuuuuggccucucacuuccuucuuuuucuaugccuaaauuuuuuccugugauuuuuguguacuaguauucucucucugauauucuguuagagcugugauuauguguuuguaauuuugguucuuuuuugagaccgagucucucucugucgcccaggcuggacugcaguggugcgaucccggcucacugcaaccucugccucccagguucaagcaauucuccugccucagccucuugaguagcugggguuacaggcaccuaccacuaugccucccaauuuuuguauuuuuaguagagacgggguuucacgauguuggccaggcuggucuugaacuccugaccucaacugauccacccaccucagccuuccaaagcgcugggauuacaggcguaagccacugcgcccggcuguaauuuugguucuuuuuucugaagagaacuggaacuugaugucuuuagucagccaucuugaaccucucucucugauuaugauuauuauaauuaaccuugcaacccuugauaacugguuuccuuuaccuccgaaacacacaauaaaguacauaaaauuauuugcaagcuucuuguaaaagaaccauuuuuucuauuuaccauauugcauuuuuaaauuuauuuugacaaauucuuacgguuauuuccauuuuuauucaaugagaagcauuuucuugaauacguauauuuguauuuuuaugucaguauuugucauuaaguaguauauauuuauagaacaauaggaauaauacuuuauacaaaugaagucuugucuuucuaauacuaaggggcauuacaguuuucaaauauccuuugaaguagauaugucuuuuaauauaaaaggaaauaucaaaaaauagauggcuguucuacuguuccuguauuuucagguauuuuccuuaaccaauuucuuuuauuuuuuagguaccuagucgauagucgcugguucaaacaguggaaaaaauauguuggcuuugacaguugggacaaauaccagaugggagaucaaaauguguauccuggacccauugauaacucuggacuucucaaaggucauuauuuucuuccuucagucaaguuguaaauguguuaaauuucauuauauaaaugucaguggguugaauuuggaaaauguuagcgcaaauaaguugauaaaguuuugcauuacagauuuuaccuaaugaacucauuauucuaauaaguuauuaaaaauuuuauuaguuauuauucuguaugacaaguuuuguuuuucauuuaugauguaauaagguuuuauuguuguuuaaacccuuaaaugaagaacugauuucuucauuuaaagauuucauuauuaaguaaucauuauuuaaugauuauuuauuacuaaauaauaagacucauuauuuguuauuaaauaauuaaacacugauuauuuugagaaaugcuaugucacauauuguuuuuccuaguggacacaugacauuuuuuaaaauuugaggaauaaucauauaugcuuaaguucuuaaauuuuugcauuagcuuucuacaacccucacuacuugccaguccuucuauauaccucuuauuauggguaaagggaacaaaacauaaguaccagaacuuccauuucuaacagugguucucaaaacacuguguaucaggcaacggaaaacagugauccuugagagaugcgaaacaaaauagguaagcccuccaacugccuucaguuuacugcauuaaaagagauuuccaagacacaacaugggaagaugaaacccaugcagacccuugcuaucucccuuaguugaggaaacagaguuugcagucuaggaaaaccaaggcuacaagaguccaggaaaauaccagaaaguagugaguagcucagagagagagagaccuagacccccccccauaggguugcucuuaagucuucaacuauuaaaccgcacuuugcauauaagaaaacugcccaaggucagacaagguaccacugaaaagaaggaacaaucaucgaggcuaauauaggauugggaaucguuuguguucucagcagccagaguggaaaaccacauaauuuagaguagacuucugagaacaguuuuacuuauguaauagggugaaauuaauuuuccugcucugcuaaccugaaagcaucaaacuauuucgaagaaacuuaacugcauuucagaauaaaacuugaguauuuauaagaauacaaaaauauccagcauacaaaaauguaaaauuuauaauggcuuggaucugaccaaauauuaccuggcaugugaagaagcaggaaaauaugaucaauaaugacaagcaaugucaaucuuaaaaacaaaucucccccacaagacauggaaaaaauuaauaaagaacagaugagacaaauacaaaauuaaaaguugcuagauugaaacccagcucuaugaauaaucacauuaaauguaaacaccucaacuaaagguagugagggugagacuagauuaaaaaguuaagaaccagcuauaacugccuacaagaaacucacuuuaaaugcaagaacacagauagauuaagauauggaacaagauaacaccaggcugugguaagcaagacuaacccccagugauccucacucuuguauaauacucuccccuuugaguguaggugaaaccuguaaauaggaugaagauaucacucuugugauuauguuauguggcaaaaagagacuauccuggugaacguaaucuaaucacacauacccuuuaaaaacagagaguuuucucugucugguggcaaaagaauucagagaugcaugaaagagggucaauaugucauugcugguuugaaguuggaaggaaucaugugagaugcaaggcaggcagccucuaggaacagagaguggccucagguugacagccagcaaggaaacgggaaccucaaacucacaaccaugaguaacugaauucugccaacaacugaaugggcuuggaagcagauucucccucagaccuucagauaagagcccagcaggggugauaucuugacuucagccuuguaaagcccuaagcacaaauccauuugggcccuccuuaacuacugacccacagaacugugaacuaauaaaucggugauguuuaagccacuaugguaauucauuauguaacaguggaaaacuaauaacacaugcuaacacuguuuuuuaaaaagccggagacauuaaguuucagaauaaagaacauaaucagggauagaaaaggucacuugauaaugacuaaugggaugggauaguucaucaagagaauauaguaauccuaaauacauaccuaccuaauggcauaacuugaaaauaugugaagaagagugaugucagcaggaugauagaauagaaagucccagcccccaacacccaacagaaacacugaaguaacaauggaccagacucuuuaugagaaacccaagauccaguuaagaauuuguaguacuccagaugagcccaaaacugagaacaacaacauugaaaugaguaagaacaauuuuauuuugcccacaucagccccuccuccaaggagucuuagcuuagucucaagagagauugucucagaucaggaccucucccuugggggaaaagagggagaucacgugcuuaauuuuccagcccuucaguguacuacccaacaggccaguuuucuaaaaaaaaauuuugaucaccuuacauagagugcugaaggaaccagcauaguucugaugccugggggcaguuaacaaaggaaagaggguaggugguugcugcagcuggaaggcucugagagauugagagaaggcuaagaaccugaggcuucucucccaggaaggaaggagaggagugggggcauccugcacugcccaugccuuucagugugcugcuugaggggccaguuucugucaugccuuauuguaccagagagcugacauaguucaaauaacugggggaaguuaacaacaaaagaaaagggauagguggcuugcugcagcugccacaacccuguaauauugggagaaggcauagaaccugagacuugucuuccaaggaagaggaaaaggaguggaguguacccccaguguuccagucuuucaggguacugcuugaaggacugacuucugucuuaccuuacccaguguuuggugggggcagauaggaacaaaggaagaggggcaaguggcuugcugcacucagcacagcucuacaagauuugagaaggcagagaacucaaggaagagggagacaagugggauguuccucuaauguucuggucugcaguaugauguaagauaccagaaggaggaagagauuauggguuucugaaaaaaaaggaaaucaacaaauccuucuaauuaggaaucugcaugcacaaguacagaaaagacauauccacaaaaaaaguuugagauguucucagaaucucuagccaggcuuuuggguggaagugaagcuauuugccuuucaaagccaguugauaaagacugggagagagguggcuguuucuucaguugcacaaacaccugugcaaagcuacaagaacucaaucagggaaacgugacacaaaaaaacaaaaucuccagaaacugacccuaaagaaauagagaugaauugccugacagagaauucaaaauaauugucuuauaaagcucacugaguuacacgaaaacauagacaacuuaacaaaacaagaaaaauaaaaauucacaaaauuaaaauaucaacaaggagcuaaaaauuaugaagaaccaaacaaauuuuggaauacgauaacugaaaaauucacuagaggucuucaacagcagacuuggacaaguagaugaauuggcaaacuuguagacggaucauuugaaauuaucuaaucagaggauuaaaaauaauaaaaaagcauaaaggaaguccaagugacuucugggacaccaucaaaugaaccaauuuguguguauggaaguuccagaaggaggaaagugagaggggcagaaagcauauuuaaagacauacuggcugaggccagguguaguggcucacaccuguaaucccagcacugugggaggccaaaguggacggaucacaugaacacaggaguucgagaucagcuugggcaacauggugaaaccuugucucuagaauaaauacaaaaaaaauaauccagccagucgcgauggcucacaccuguaaucccagcacuuugggaggccgaggcaggaggaucacaaggucaagagaucgagaccauucuggccaacauggugaaaccccgucucuauuaaaaauacaaaaaauuagcugggugugguggcgcgcacuuguagucccaucuacucaggaggcugaggcaggagaaucgcuugaaccuggaaggcagcgguucagcaagcugagaucaugcuacugcacucuagccuggcgacagagcaagacuccaucucaaaaaaauaaaauaacauaauaugugggugguggcauacaccuguagucccaguacuugggaggcugaggugagaugauugcuucagcccaggagacagagguuguauggagccgagauuguaccacugcacuccagcaugggugacagaguaagacccugucuugcaaaaaaaaaaaaaaaaaaaaaaagaaugagugaaauaauggcugaaacuuccugaaacugggaagggaaauuggacaucuacauucacgaagcccaaagaguugaacaacacuguuaaucaacuugaccuaauugaauuuuguaaaacauuccuuguacccauuaagaaucacacccuaucccuucuuugcugccaccccccacucuagacaacuacuaaucuccuuugucuguauguauuugcuuauucuggacaucucauauaaauggaaucauacaauauguguguuuuuuuguuuauuuuauuuuuugagauggagucucacucuguugcccaggcuagaaucucagcucacugcaaccuccgcaucccagguucgagcgauuauccuaccucagccugccaaguagcugggauuacagaugcgugccaccacaccuggcugaucuuugcauuuuuguugagaugggguuucaccacguuggccaggcuggucucugaacuccugaccucaggugauccauccgccucagucccccaaaguacugggauuacagguguuagccacugugccuggcccaauaugaauucuuuuauguuugucuucuuuuauuuaggacagcacaauguuuucauguuuuauccauguuguugcaugaaucaguacuugauuucuuuuuauagaugaaugauuucuacugaauggugcacauuuacuuuaugcacucaucaguugauggacauuugaguuguuuucacguuuuggcucuucuggauauuguugcuaugaacauucauguaaaaguuuuuggguagauaauguguuuuccuuucuaauggguagauaccuagacaugaaauuguugggucuuuuuaaacuucguuguuuaacuauuuuaggaacucuuagacuguuuuuccaaagucauugcauccuuuuacaucauugcuggcaguguaugaggauucauugcuucacauuauuaccaacacuuguucuugucuguccuuuuuauuauagccguccaagugggugugaagugguaucucauugugauuuuugacgugcauuucccuagugauugaugauaaguucuuuuuuugugugcuuguuauauaucuuuuuuagugaaauacauucagauccugugccuauuuuuaauagaauuguuugucuuuuuauuguuguauuuucaguuuguuauuuauuuaggaugcuagacccuuaucagauguaugauuugcaaaaauuuuuucuuauucugugggcuuuuuauauucuugauggugaccuuugaagcacaaaaguuuuuuaauuuuaaguccaauuugccuuuuuuuucuuuguugcuugugcuuuuggugucagagagcauugcugaaaccaagguugcaaagauuuauguaagauuuauacuuacauuuucuuuuacgaguuuuauaguuuuggcuguuacauuuacagcauuggucuacuuuaaguuaguuuuguauauggugugcaguaguguucuaacuucauccuuuugcauguggauauuaaguuguccaguaagcuuuuuaauagaaaaggauaagcugauccaaaaauucauguggaaauucaaaugacagaauggcugaaacaacuuugaauuuuaaaauaaaaucauagaaguuaacacuauuugauuucaauccuuauuuuaaagcuguaauaauaaauauaguugauauugauauaaagacaaauacaucaguugaccagauuagagaauccagaaauagaucuacacauauauagucauucagcuuuagaaaaagguaaaagaggaauucacuggcaaaaggauagucuuuuaaacaaaugcgccuugaguauuuggauaucuguuugcaaaaaacugaauuuugaugcauacauggcacuguauacaguauuaauccaaaauggauuauagaccugaauguaaaaacuaaaacuuuuaggaaaaagucuuugcgauguuguauuagccaaaguuuucuuggauaugauucaaaagcaagguugcuaaaagaaaaaauguaguugugucucaucaguaacaaaagcuucuuuaaaugacacuguuaagagaaagaaaagagaagccacagugugggagaagauauuuacaaucauguagcagauaaaagacuuguuuguagaauauacaguuuauaaaacucauuuugaagaaaacguaaagcccaauggaaaaaguaggcaaaagauuugaacacauaauucaccaaagaagauauagguuucaaaaagcacgugcaaaaaugcucaacauaauucauauuagagaaaugaagauuaaaaccacaaugagaaaacugauccauaccaaguguuggcaagauuguagaggaaguagaacucucauacacuguuucuaucgaugucauaucauaaaagcacuucagaaaauagucuggcaguuucuuaacaaguuagacauacguuuauuguagagcccagucauuccacuccuagguauuuacccagaauaaaugaaagcauuuuauccauaugaccgauuguacacaaauggucauacaguguuauuuguaauagaaaaaguugugaacaacucaaaugcccaucaacaccugaauggagaaacaaaauguagcauauccauacaaugaaaucccacucagcaauuaaaagaaauuaaguauugauauguaaaaacauggauagaucucaaaauaauuacauggcaugaacaaagccaaacaaaaaagaggacauacuauuuuuauguaagacucuagaaauugcaaauucgucuauaguaacagaaagcaaguacuguuuucauguacaagucuagaaaaugcaaaguagacuauaguugcaaaacacagaauaaguaacauucucuuaaucccucagguuuuuucucgcuucuugauuuuuauuguuuauaucuuauugggaauacuguguucucauuauugaaaugcuaccaagaacaauuuugcuuuccguaucuguuaauuaagacuaacuuaggacaagaaaaaucuccauuaaguuggauauaacucagugagauauuucuguuccucuuucugcauuuuaaaaauucacauggacagauaacaagucucagauuaggacugugauguagguaugguuccagaaauuucuucuagaucuguggccugucuuauacuaaauuuuuuuagucuagcuagaaauuugaaaguggacugugaauuagaaucacaucugaagaauuaccuccauuuuaguucuugggagaaauccagauugugggccuucuggaauaaugaaaugguucacaagaugcccauuugugauuucugucaugguuccuagcccgugugucuuggugucauuguaaaagguuguugauuugcuucugaauuuccuacaaaagcugaugcuagaaugaauauuguuaccauaugagggaucucugcuacucaaaauaugugggaaacacucuuuugucaagucucuugacuaacaguuacuccauaguauuuuuuaaagaaccuaauaaaagaauuauguuuuuaaauauugcuuuuugauuuaugguacaaacugaaaguuuuaaagcaauaguuuauuuugaaauauguauggcaggcuuguccaaccugcagcccaugggcugcaugcggcccaggauggcuuugaauacagccaaacacaaauuuguaaacuuucuuaaaacauuaugaguuuuuuuuuaugauuuuuuuaagcucaucaacuauuguuaguguuacaauucuuccaauacggcccagagaaacccaaaaauuggacaccccugauguaagggagcugaauugcuuuagagcuuaaaacuuguuuuaaauacuuaaauuagccuucaugaguuuaauuuguaauguguccaaacaaaguauuuagaguuagguauugaguuuauuuuuucuuuugcagauggugaugcccagucacuuaaggaacaccuuauugaugaauuggauuacauacuguugccaacugaagguuggaauaaacuugucagcugguacacauugauggaaggucaagagccaauagcacgaaagguacauuuuaauaauaacugacuauaaauauuauuuuucuugauuaguucacauuuuauuauuaauucaaugaauugugaaguuucaucacuuaucuuagagaaaaagccagcaaaauaaccguacacuguguuacaauaauggcaaguaacauguuaagaagguuuacuuaugcuagccacuauuguaaguauguauuauugauuaauccucuauauauagagagaaaacucuguaagguaaguaguaggaaaugaggauaaaaaguuaggaucuaguuauuuuagaaagucauaucaggauacagacuuuggcaaccugacccuguuuucugugcugcacuguuuuugauaaaacaauuagaaaacaaugaagaaacuaaaaguugaagcaauguuuuuuggaacauaaaaauuuuuuaaacuugaaaauguagauuuuuuuucauauccuuuaacauuuuaaaauuguagucuagaaacauuaagaauaaccaauuucguuuuuuuagggaacuaaaaagcaauaaguaaggguguugcuguaguagaauaccaaauauucaagguaaaugagugaaccuuacacauguauuugaucauuuauuguaggaggggugggaggcugagaagggaccaaaaucucuuggcauaauuuuguaucugguuugggucccccgacccuccccccaucccccgccacauagaaacaauuaaaaaguuggauuagguaacauaaggguaaaaaaaccucuaguagaccuaacuauauuugaauuuauuuggaauugaugcuacaaaguugccauguuaacaauuuguauuuguguauccaugguuuuagguauauuagaagcuaaccuuggaucuuauuuucugaauagaucuugaauguaccuuuuauuuauuuuuguuuaguuuuauuccuuaguuucacucagccacuucaaaauuagaauuucucuguuguaggaaugcuagccuuauagaucugugaaaugaucuaguugcuuuaucuauaguugcuggagaauugaguguuuugaucaaagguagccuauuuagcuguaaaacugucuagaauuauuucauuccuaggauaaaggaaaauuuguguccaaaauaucucuaaagguauuacacuguauuccuuuaaucuuaaugauacacuuuuuuuucuuauaaauguagcacauuauacacuagcggucuucaguaugauaaacagaucaacuaccaauuucauugccauuacucuuugaaauaguccucauugagaguucuugaaaccugugucuaauaacaaaguaaaauauaaucaaaaauuucacacaaguagaagaaaaaacauugacaaaucucuugggagaccacauacuuauuuuuaacaagaugaaugaaauauauucaaccuguaaaauaguuugcaaauguucaugugcuauauuacauugcguggaguucuuauuacagaugcaauuuccuacaacauuaaaucugcaguaaaauuuaauuaaucacacuuaaauuugggaauuucauuugcauuuucacuguggcccacaugacugaugcagguggaacucaaagaaguaaauagaccagcuuauagugucugaagcccaacuuucaauguuacccaucucugauugcauuaaagaaucuaggauuggugguuccccuagcuauaaugcagaaaccaaguuaaacaucuuccuguaccucaaagaucucuaaaaugcgucauuuauagugucaacacucaaagaauggacgaaaagaaagcaaggauauaagcagaaaauacgauggaaucaaaauccaagagaaacagcagacaauagaaacagacccauaagaaacccagguaauugaguuaguagauuuuagaauagugggcuuauuaugcuuaaaaaaaaaaaaaaaggcagaugagaaguagggcaaaacuauuaaagaagaagcaaauagaauucuaaaacuaauaauauggaaauuuuauggauuuaauguuugggaauaaaauuauuagaccaaacagaacugaagagaaaauuuguaaacuaaaugauuugucaauagaaaauauagagucuaaagcuuagagagacaaaagaauagaaaauacagaaaaaagcuaaggcauaaauggaaugcaguaaguaaguuuaacaugcauacauauaguuggaaucuuggagaggaaagaaagaguggguagaacuaauaccaaaggacguaauagcugagaauuuucccaaacugagaaaggugucaugcuuuaaagaaaugcuaugaaucccaaacugaaauaauacaaacaaaacuguaccuaguacaaauguugaaaagcaaaggcaaaaaaauuucuaauaauagccagagaaaaagacauguuaucuucaaaauaaggauaagacaaaauaaugauuucucaagagaaaccauggaagccagaaaacaauggacuuugauauguuaaaagaaaauaacugccaauguaggauucugugacuaagaaaauaauccuucagggaugaaggugaaaaaagccauuuucaaaugaaaacuaauagaauuuguuaccugcagacguguauuaaaggcacuacaaaauaaucuuaagaauggaaggaaaauuauuccagaugaaagcuuggagaugcaggaaaacaguguagacugacaaaauguaaauguugugaguaagucuuaagauggacuguugaaaacauuaauaauaauuuuuauggaguugaaaauguguauagaauuaacuacacaauaguguuagcauguaaguuaagauaauauucucuacuauguucccuggugauccccagcuccucauauccauauucuugggcacucuucuuccauguuguacugagguuggucuguguggccaauagcauauagcaguacucaugguacaucgcuuucgagauuagguuauaaaaaaacaccgcggcuuacaucuugggugcacacgcacucuagcugucucucuuucucauuucucacucggggaauucaacugcauauggcgaggacacucaggcagccuauggagaggcccacauggugaggaacugagaucucuggccaauagagaggaacggaggccugcaacaaccaugugagugaccuuggaaguggauccuuuaguucuaguuuagcuuucagaugauugaaaccccagccauaccuugagagcaaccucaugagaaacucuacaccaaaucaacccaguuaagcugcucccagauucuugacccucagaaacauugugagauaauguuugcuguguuaagcugguaaauuuugggguaauuuauuaugcagcaauagauaacuaauacuaaucaugguaccuguaaauaggugcugauaugaaaacuugaaauguggcguggcuuuggagcugacagugaauagagguugucagaacuuuaagaguaucaaugaaagcuuaaagggccuuaaacaaaccguuaguagauuacuagacuuugagauagcugccagugagaacuugaagugaggaaagucuuacuggaaacugguagaaaguggucuuuguuauacagugguagaguaaguuuagcaacauguugccugcaguaaacugaaagguuaaagauaguauuuaaugaaauuauaggucugccaaaguguuaaaaguacugccuaguuucuuuuuguguugguuauagucagaugugagagaagagaaauacacuaaagaaaggauuguucaauaaaacagagccaauauuuacuaguuuugaagauuccuagucccuccagauggcaaacggugcuaauacuaagcaguguuucugagcaaagauaaaacucagaguauucucagaaaaaaagugugaucuaaucuggcagccaagggugugacuguaaguuaccucagaaaaaucaaaggucaugccucacaguacuauucagacaaaaggcccuauaaaguauuuaaggguuaacuuagagguuguccugucaguaguaauauuaauuaauauuaagggugucuucucaauauguggcuucuaagaacaggagggcuucaagaagcuuacgggcaaccccuuagcuuucucagcauaaagccaaaguagagaggacuuauccuacagaacauuuguggauauggcuuuugucuaauggaaugaacuccaguaagauccaguggagaccuacauuguuuucgaauuaccucgcagaaccacugccauuuuggacugcagaagcaguauuaaaugaaagacgccuuugaccucccaaacuccaauaaguaggaaucaggcugaaaauuuacuuaacuucaagcaugugcuaaugcaugaaaaaaggaugacucagagaacagaaccaaauguuagauagaauaauuuucaggcaaggguagaacugaguuccagucaaggaauuucuaguauuuguccagguagauuucauaaucguuauggaccauugauuccuuuguacguccuauuuccccucuuacaaaacaggaauauuuaaaaggcuauguucugugugcuucauuguuuuauuuuggguguauggggggcagaaaacuugucucuuaguucacaggccuauacaucaagaggcacuacaguagucccccuuaucuaugguuuugcuuuccgcgauuucaguuaccugcaagcaaccaugguccaaaaauauuaagugggaaauucuggaaauaaacaauucgugaguuuuaaauugugcaccauucugaguaacaugaugccaucccacuccauguccuccccauggacacuauacacuaccuucccguuugucacuuaguagccaucuugguuaucaaucuacugucacagugcuuuguugaagggcauuaguagcauaaugcagcguuacaauguacaucauucacuucaccucuucucaucagguagacauuuaaucaucucauaucauuacaagaaaaagggugaguacaauaugauaagcuaccuugagagaccacauacacauaaccuuuauuauaguauauuguucuaauuguucuauuuuauuauuagcuauuguuaaucucuuagugugcguaauuaauaaauuaaacuucgucauagguauguauguuuguaaaggaaaaaacauagugaauauagggauuagugugcuauuuguaguuucaggcauccacuaggggucucggaauauaugucuucaaaggcuuauagaaaauuuauaauuugucaauuauagaugacaaauuucugaacuccagguugcuaaaaugaauugagacuaguuggggccuuuggaagaacugaguguauuuuguauuuugggggaaggaacugugaaucauugggggccaggggguagacugugguagccagccucaaagaugcuccccagugauugugaccucuuagaauccuuagucugguguaauccuuucccacauuguacgacaguuggucuaugcagucaguagcauguggcagaaguggugguaugucacuucugagauuaguccuuaauggaugccuguacuucuauugggagugcacauaccucccucauccccuccccucggaucacucacucugggcgaagccauaacuuugcccuuaacuuacccuauagagagacucacauaaugaggaacagaggcugccaacagcuacaugagugagcuuguaauuaagauuugaacaacaugauuaaccaccauaaccuaauugacauguacauuguacuuagucauugcagaauacacauuucuauuaaguggaauuuuuaagcaaaauugaccauauucuggguuaucaaaauuccaguaaacuucaaaugauagaaauuguucacuguauuuucugucauuagugggauuaagcuaaaaucaguaacaaagagauaaccugauuaucccccaacuaucuagaaauggaaaaauauacuuuuaaguaauccuugaggcaaagagaagaaugaaaauuagacauauuuuaaacugaauaauaauuaaaauacaacuuaaaagauuggcugaaauucucagaaggaauuuuauagcuucagugcaaauauuggaaaagaaagugaaaaucuauugucucaacaaguuaaggaaauugaacuuaagaagaaacauuauaauguagacauuaacaaaauagaaaacaaaccuacauuaaaugaacaaaauucagucauuguagagagcagugaaauuagaccaguaaaguaaagaugaguccuggcaggauuguuuaagaauaaaaagagaguaggcacaaauaaccuauauugcgaaugaaaaaggaaacaucauagcagagucuaaagacuuuuuugaaaagauuauguuuugaacaguuuuauguaaauuugaaaauuuagaugaaguggauaauuucuagacaaacagaacuuuaaaaugucaauacaguaagaaauaggaaacucgaauucaccuaugugauuaaagaaauugagucauugaaaaccuucccacaaagaaagcuucaggccaagaaagcuuuaccaguguauucuaccaaauauuuagggaagccauaaaccaauaccacacagauucuuucugagaauagaagcaguacuccccaacuuauuuuauaaggcuagcauaaacaugacauaaaaccugaaggacauuacaagaaagaaaaauuacaggcuggucucacucaugaacauagaugcuuaaguccuaaacacaauguuagcaagacaaauccagcauuauguaaaaaggacaaaaaugaccaagguggauauuuuucaaagaauacaauuuuaacuuugaaaagcauucauaauuuuagcagacuaaaggagaaaaauaaucucaauagagauacaaagaacauuugaugcucaacauccauguaugaucuuaaaaaaaaaaacuccuagaaaacuaggacuagaaaucgccuguaaauauuguacuuauugguaaaauauuaaaaguucuucccaagucaagaauaacuguguuagaaaucuuagccaguaugguaauauaguaaaaagaacuaaaagagugaaucuuguaaaagaagauacaagacugucaguguuuuuagaaggcacgauucuacagguuuaaaauuccaaaaauauguacugguaaacaauuagaauuaauagguaaauuuaacagguugccugauauaagggcaguauagggaaaccaguuuuuuauuggcaacaaauaaaguuuauuuuuauuuguacaaauuagugguguacaugagaaaaucuguuacauauauauaauaaguaguaaugaagucaggguauuuuggguguccuucacccaaauucaauacauuuuuguuaaguauagucacccugcucugcuaccaaacauugaauuuauuccauuuuacuguauguuuguacuuuuaagccaguucccuucauccuucccugcucccuuccuuauccuucccagugucuguuaucuaucuuuccacucuuuacuucaugugaucaaauuuuuuagcuuccacguaaaaguaagaacagaugauauuugucguuuugucccuggcuuauuucacuuaauauaacgaccuccggcuucauccauguugcucaaaagacaugauuucauucuuuguaauggcggaauaguacuccauuguuuauauauauauacaauauuuauccauucauccauugaugagcaccuagguugguuccauaucuugcuauuguagauagugcuacaauaaacaugugagugcagguaucccuuucauauacugacuucuuuuccuuuggguagauaugcgguaguaggauugcuggauucaaugguaauucuguuuuuagauuuuugagaaucuccacacuguuuucuguaguggcuguacuaguuuacauucccaucaacaguguauaaguguucccuuuucuccgcaucuucgcuaacaucuguugucuuuugucuuuuuaauaauaaccauuauggcuugguuaaggugauaucucauugugguuuugauuugcauuucucugaugauuagugauguugaacauuuuuauauaccuguuggccauucauuugucuuuugagaaaugucuauucauguccuuugccuacuuuuaaaugggauugauuuuuaccuguugaguuguugaguccuuguauauucuggauauuaauccucuguuggaugaauagcuuauaaauauuuucuacacuucaacagguugucucuuaauaaaguugaauuuuaaaauaacauuuacaggucaaaauacuuaggaauaaaccuaguaagaacuguguuuuucuauacugaaaauugugaaacauuacuggguaaaauuaaagaagacuuaaugaauuaauggaucuagccugaaggucuagaagcugaagauguaggagaaggaguaggucacuaauguuuuucuguaaagggccagauaguaaauauuuuuagcuuuaugcgcccuuuaguuucuuuugaaaugacuaaacuuugcugauuuaggcauaaaagcagcccuagauaauuaauaauuggguaugaaaguagccguaaacauaaaugaauggggguuguuguguuccgguaaagcacuauauacaaaaauagauugauggguagauuuagccaucuaaaccuaaguuuagccaaacuuaguucauaaguuugcccaucacuagaucuaggcauuggcuuuaaugucuaccagcaucacaaaaaaaggagcaacuagauguuugcauccuguucagagugaguguaugucaccaucuaugcaguggucuaaaguaaaaauuacaagaauaggaaagauggagaacuucuagguuaaaagacacuuaagagacgaauuagucuauuggcaauauauggaccuuauuuggauccugauucaaacaauacauuaaaaaugagacagaaggaaaaauuugacuuuugacuggauauuugauauuaauugauuaguuuuaauuuuuuaggugugaugaugguauugugguuauguuugagucuuuguuucugaauauucugaaguauuuguggauggaaaaucacauacauaggauuuguuucuuacacauuaagaacuaugauuucauaguuuuguuguauuuaucuacuucucugucuucaccguuaucuguucucacucaggcuccaggaucuaggucuaauuuaucugcaccaaauguagguacucaauaaaugcuuuuaaaaugaaugaagcuagcucuacaaaagaguaagucagucuguuagaggccugguauuaugaaauuguuuauauaguacuagauuuuuuuagaaauuacuuauauuucucuucccauuucagggagggagcauacuuggaaugaagguaaaguuuccaugaaacuuuucauacacagacauaaaggguagacuauauuagguuuauuuaauauguuuaauggccuuguaaaaaauacccuaaauauucacagcaaaaaaugaacaaauagaaauuauuuauuuuaauccucuguaaacuuauauguagcucaaauacuuaguaaagagacuuugccuucauuaugguuauaaauuaaugaaaauauguuuacauauccauaagucuuccauuuuggacaaggagccagauuucaucauguacucacuuuuuauuuaugguaauauaacaguguuauaauucacuuagaguaaacauuauaacuaucaucuauaauacugaaacauaacuaucacuucugaauaucccccuuccgaucuuauuucaaauacauauuuuaauaguuauaauaauuagguaaauaaaacuauacuuuuuuuauaagcuuguuucuuccuguuagucuucaugaccaucauuuucaaugcauacauuuuuaauuaagguaggaaggagauuuuauguaaacaaauaugaaggagauuauauaagcaaauaaucuacaugugaccauuacacauugauucguaaaugugcuaauuauuuuucuuuuuauggugcuguuauuuucaagcuuuaauaguacauauaguaugaccuuuucauauaaaaauaguuugacaacaaacucauauuuuuaaaaacaacaccuuguuaauacacuacuuugggaauuaguaaaauaaauaucuuauaaauauaguagcaguuuucugaguagugaugaugaagauuuuagcaauguaaaauguaggaaagaagaaaaaaauguugagaaaaauucugaaucccaguaguguggacuuugaaauauucuugauauuuuguuuucauagaucucacaauaacucugacaguuaagucaccagguucuuuccaggaaaauaucuauaguauuaugaaaauguauuuucauuuuuagaaaacuaugccuauuuagaaaguauauaccucaauauaaaucauaauggggguuuuguuuuuuaaccauacuuauuccuuuuccugcuuuguguuggucauuccauuuuucuuuuucuuccauaaaaaugaggccugcaguuuaccuuaguuuuaguuacuaccagugauuaguagcuacuuuaauguaguuuauuuuaggauuuuacucagcuauugagccccaguauagaaauuacugacugauaagaauauuugauuccuuguuucucuacuuaaauauaacuacaaguaaucuuauaaaauuaaauguuacuacauuuguaaccaugaaguaaaucagccuaagauguuuaaaacaaaucucaguaguuuaacauauugguuuuacaaaacaaauuacauuuauuagcagaaggagagguacaggcugcuaccuguuuaaaaaaauuguaacaaguaugauuaagaaaauauauaugacaaaguaucauaaaaauguguguuggauuagauaguaaauacuagaugaacugcauuugaauuuuuucaaugcagugaaagacaaguuuguaaaguccucuuuugaauugauguaagcuugugaguauaucccaacggucauuuggagccucccuuuugccauauuugucuaauggaucacauaucaggccuauuacuauuuucagaaacaguauucaugacugaaauccuacaguuaaccuuuagaagaucgaaaggaauuauacuuauuuaaaaggugaccuuaauauauacauauuuccuuuuuaugcuuuauggcuugcaugcuuaacagcuuucuuuuaauugcugcauagaauuacuaaguguguaguuaaaggucaaacaaaguaagucacuguagggugaaacuaacauaucaguuaccuagccauagcuggauauuuuggcaacagugauuuggaguuaucauuuuaauagauauauuuuaacauaacagugauaauauagccauuaaguucaaauuguauaaacaacuuuuuaaagguuuucugcuugggaucacuacuaaaagcuaagaaguauguuuguaucuucaaucagaacucuguuuauuuguauuauaauguauaaacagagaacguacauauauauuugcacauagucauuuuggguaaucuuucucauuauaaauacugaauauuaauuauuuaugguguacuaguguaucuucauagaucaauagaaugccuuuccaaacugucacuuaauguuuuaaaaucaugauuauuucuuucuuuuaaauaucaaaauuuccaaaaaguuuucuugcuuuugaaguuuuaacuauccaauaucuuuuuuuauauauauuggcaggcuuuaauagugacugguuuuucacuggagaucugcaguuuucuaaagucucuuuaaauguauuguuauuagagugaaauauauugauauaggugacacugauuuguuuuguuucauuauuuuaggugguugaacaggguauguuuguaaagcacugcaaaguagaaguauaucucacagaauugaagcuaugugaaaauggaaacaugaauaauguuguaacucgaagauuuagcaaagcugacacaauagguaaugcaagauccugucuuguuuuuaauccauugcuauuagauauuuaauuagaauuaucuuuguauaugcuacuuggaugauaaccauuuuaaggauuuauauauagacauuugauuuccagcuuugauacaaugucuuagaguuaaauuauuuauuguuucuuguaugcuuuugcauuuauuaaaugaauuuuaacauuugugcuguuuugcuuuuuuauaaaacaucaaauaauuauuguuuuuauuuagcaacuggugugucauuuguaacauagaccuuuaaauaaaaacuuaauuaaaacuugguaagguagcauggaaaaugacaauugguuauuuccuuuuuucucuuaguuuauucuuugguacuauaaauacagucaaguagccaaggcagcaggcuuagcguuauuuugacacauugauuuuucaaauuaaugaguagcguaagcaguuguaagucaaauauaaguggacuuaauucucucuauauauuaaaauauauauaaauuguuuucuuucuauuuaaaagacacauuuuuaauuuuagguaaagaauagauugaauaaaauguuuuuuaaaauaaaugauuaugaauuuaauaaaaauuacaugguuuuuguuucauaaaacucaagaauuuuuaaaguauuuaauuucaaaugaaguuguaaaacaagauuaaugguaauaccauugaucuuagaaaauacaaaugaacagugaagaaggacacauaacuuguagaacccagcuuggaaacagauuagccaauuuaugaauuauagcguggcauaagauuuccuuguuggaaccagucauuaaaguaaaugaaaguauuucugaauuucauuaacugcauuuggcuuucuuucaccacuuacccacuucacagcuggaaaauccuuuuaacccguauuuuuuaugaaauaguagcauuauucaaguacucagugcuugguuaauccuaauguuugcaccaaauaaaauacagcauuauguuaugaaucuuuauucuccccucuucauuuagcuagaacauuuauaaguucgagauuaaguuucaauaagcugauaguuggccggacgcaguggcucacaccuguaaucccagcacuuugggaggcucaggcggguggaucgccugaagugaggaguucgagaccagccuggccaacauggugaaaccccaucucuacuaaaaguacaaaaauuagccggguguagugggugugcgccuguagucccagcuacuugggaggcugaggcaaaaaaauugcuugaaccgggagguggagguugcagugggccgaaaccguaccucuguacucuagccuggcaacagagugagacuuuaucucaaaaaaaaaaaaaaaagcccauagagucaucuuucuaaaaugaaugcuuaaaagauaaggaauuucauauguaaguuuuauuauaauuauuauuacagauaaauugcuugacuuuugaauuuccacauuuguagaauauauucaggaaaauaagauauuucuacauauuaaaaacaaaguuuucaacauaugaaaauuauuuuaaucauaugaauauguacaugagaagagucuauaaauuuaauaaggguagucuguuaaaauuaauucagagagucgucucugaaguuuauagccaauuggaauauaaaugagaagcuaccucuuaaaauaauguuuucuaguuauuuuuaaaguuugguauuuucuucucucccugccucauuuugauaggaaaauuaaauaugagaccaucagagauauuauuuuagaacauuauuauacuagguauuuugaaacucaggaaaaucagcaacugauuuaauuucugaauucaaaacaagaauuauggguucucaugauaagaacuguguaagaauuugucacgaagauauguaauuuauaaaggaucacugcuucaaaaaguuuacaaucuagcauagauuuuaaucaacauauauacuaauacuuuaaaaugcuagauaaauuggauauguacuuuaacauuauauaugaacccaauuuuugcauagcuauaauuuuuuacuguauuaaaucauuguuuuucaaacuggauuguugauauuuuggugguucauuaaacaguuuugggaguaaagaaaauugaaugggagauauuagaauacaaaauaucaacauauauguuuauuuccugggucacaauuucuuacuauagcucuuaguuuaaaaaauuugaaagucugugguagaaugagucuucuucuuaagcaaaaagguuugcaaaaauuagucaagucaggaauuuuagacacuucaugguuaugguuauaguacagguuaacaguuguugaauauuuacuauguuuuaagcacuuuacaggaauuuucuuguuugaaguuaaacaagcagguaucuuccucuuauagauaaugaagcugagauuuagaaucuacuucaauucacccugguaccaagugguagagcuaguacuuuaacuucauaagcagagcucuuaaacuagagucucaucucucaauugcugccuuacacaaucuguguaugcuaaaggaauauucguuuuggagauauuaacugggcugauuuuguuuuucuaaaggaaguggguuuugaaacacagaauuuacauaaggaacuuaagauggauauguauuuuucccuuauggucuuuuaagaaaucuugauugaaaaugauuaaaauagcuauguaugugaaauacagcuguauaaauuuuaugaacagauuuaggaaauauaagugucuguuuucucuuguuaccaaauuaauaaaauauucuguuuucagcuaguacuaccuacacugauauauaguaaaaaugauagcaggccauaggccauaucuaaaugauuuaccuaucagggccaaaaucuucugccuucaaauguuuucugccaaaauugauauauuugagcauugagcauguuuaaguaagagauaaaauaauaguuuuauuuuccuuuaagauuaacuaccaaaaacauaaaacuucuugaaaaauaugauuuaauuucuaugaccuguauuaauauuuuuuaauuucuaauuuuugugaguaaccuguauuauuuuucuaccucuguaugcuuuucauuaacuggcuaguacaguugaauuaauauguggaaaaauaagcacacacugucaguccuuugaccauucucaacuucagugaucucaaccaucagccaagcucagccaccaauuauuacaguuaaacccuaggcuguuguuaucuguaacugcacuugccagaucucaauuuuagcauccugcauucuggccaccacuuucucugcucccauuuucucuugagcccacuacaugagacaucgaaaccuaccacucuguugguacuacuacugucauagucucucaugaccuugccauugacaaauccagugguaauauagaaaucuuccauuuuccugaccugccagcaaaguacaacacagauaaacuacuuuucuaucuagaagcacuuucucuucacuuggcuuccugggcacaguuucucacuggcugcaucuuguuggaguccuuuguaaaaccuucuucauauucuuuaucucaaaauaucagugucuccauauucucccagcccuccuuuccuuggugauuucuuuuguucuccuggcuuuaaauauuuuccauguguugauaucuuuuaaguugauagguccugcccugaagucucccauaauuccaguuugaacuaucccauaucuucauuuguauaucugacaggcuucucaagaagacuaucagauauaaaacuaagcucccuuucccaaaaaaccuuaggcucugucauucuuccuuaucuccauaauucccacuucugcucuuccaauugcuuaggccaaaaaucauuucugauucuuuuauuucucacccuucauguaaucuagcagcauaucuucuuagcaauuccuucagaauuuauucucagucagaccacuuaacacugcuuccauugcuaccacuuugguuaggauuguugcaguaaccuaguuucccaccuuugaccuugaauuaguccauucucgcacugcuauaaagaacuacuggagacuagguaauuuaugaagaaaagagguuuaauugacuuacaguuccauaggccguacaggaagcauggcuagaaggccucaggaaacuuaacagucaugguggaaggcaaaggggaagcaaccacaucuuaccguggcauagcaagagagagagagcaaagggggaagugcuacacacuuucaaacaaccagaucacaugagaacucacucacugucaugggaacagcaagggggaaaucugcccccaugauccagucaucucccaccaggugccuccucaaacacuggggauuacaauuuggcaugagauuuggguggggacacagagccaaaccuuaucagaccuucugcaguguucuucacuaccagcaaaagugaacauuuaaaaugucagucauaucaugccacuucucuucccaacuccucaauagcuuucucuuuugcucagauuaaaauauaaauacuuugauaggucacagaaguguauauaauccuacagaaguaccuuuauagucucauuucuaccucacuuauucuacuucagccacauugauguaucaggcuauucuaaaacaugccaagcacauuugcaccucaaggcuuuugcguuacuaccccuaugccuguaauguucccccauauguaaauuagaucacaaaacucaaugaagaggaaauuuccacauuuguuuauaacauguuauguacacagaugccuguauuaauagaaaaaacaucuagaagaaauaucagaaugucaacagugguuauaucuagguagacauuuuauuuauauuugucaguauuuuugguauuuuugccaaaagcaaaaauuauuucugcccucaggaaacauuuauucauuuuuauagaaagauuaaaacagcucccuuccuuggcuucuuccuuuauccucuuucuagguaauguuuuguuucuugaucuuggugcaauuuacauggguguguccacuuuggaaauuuaucacaagauacugaugauuagugcauguuucuguauacauguucacuuuaauaaaaagaacaaaaagaaaaaaauacaacccugccaaaguagaaagcaguacugauaaggcuuggcuauguguucccacccaaaucucaugucaaauuguaaucccccauguguuggaggaggugccugcugggagguguuuagaucauagaggcagauuucccccuugcuguucuugugauagugaaugaguucucaugagauacgguuguuuguguguagcacuucccccuucgcacucucuccugcuccuccaugauaagaugugcuugcuuccccuucgccuuccaccaugauuguaaguuuccugaggccuccuagccaugcuucuuguacagcccauggaacuguaagucaauuaaaccucuuuucuucauaaguuacccagucucagguaguucucuauagcagugugagaacagacuaauacaaguacuaacaguauauuuauuuuauguaauuauuuaaauauucugggugauuugcuuuaaguuuugagauaacgcuguugauauuuugaauuagugccuuuuuuuccuacugauuuaaugcccuuaucaaaaccuuacugacuacaagacuauuacaaaacauuagcugcuaaguagauaguauuauuggacuaaauuauguaggauagauguggguuuucauauuucuucggagaacguauauuauuaaguuuaauauuuuauaaauuuuuucaaaacuacaacuauucuaaaaucuaaaaguauucuguauucauauaucauaaaauauuuugauuacuauuuucuugaguugauuaggcaaguuauugaccagaacuagaugaaauuucaguaaauugauuuagaaaucagaaaaagacgugacuuuacuuugaaaauacuaaauuuuggugaauacagacaucccuucaaacaaggcacuuucuuuuuuauuguguccauauauucuagugagcuguucaguuuaauauaaauuauuuuuaaauugcuuaugugguacuuaaaaaauuuugcacacuaaaaaaaaucuguaacaucucuuaaucauacuuuaauuucuaauuccuacaucuccucagaaaauauuugaauuauaguauguuaaaauuuaaaguuuauccuguguagcauaaauuguauuuuaguguuaggugauugaacucuuaccuuuugagauuuuaaauuccccaaguaauuuguuggaguacaaauaccauuuuuuccauaaaaacuuggucuuaaaaacccuuuuguugguuuguguuuuauagauuuauuacauauuuagucuugauuuucuauuaguauuuuaaagaauuuuugugcugguaacauuuagcuguaugugguauauuuugaaauacauacuauauuuauauaucuuuccuccuuaaaucuagauacaauugaaaaggaaauaagaaaaaucuucaguauuccagaugaaaaggagaccagauuguggaacaaauacaugaguaacacauuugaaccacugaauaaaccagacagcaccauucaggaugcugguuuauaccaaggacagguauuguuuauuuuaagcauacuguauuauacaugaagguuuuuggauucacaaacuuuaauaauuauccuggcaauauauaaugggcuguacuguuucuggcuuccucuuucuaaacucaucucuugucuuuccuugcugguuacugacucugacuuuugauucccuccuugagcuugggaauaaucuacuuguuaaaaagaaaucauuuuuaauuagaaaaaaaucccagcuaauauuauaaggugggucagcaaacuuucugugaaagaccaaauaguaaacauauauggagcaucucuuauuuacacaguucuuuauuacaaauuacaguucucugcaggccauaaaguagcaucuaaaacauugccauuguaguacacaaaaacaagcauagaugauacaugaauaaaugaguauggcuauguucuaauaaagcuauuuauauaaaugugcagcaggcuaagugaacucuaguuugccagcccuuguugaaaggugucagcucccaauuuggcuuuuuuguuuguuuguuugagacggagucucacucuguugcccaggcuggagugcagugaugcaaucucggcucacugcaaccucugcuucccaaguugaagugauucuccugccucagccucuugaguagcugggacugcagacaugugccaccacacccagcuaauuuuuguguuuauaguagagaugggguuucaucauguuggccaggaugggccagaauggucucgaucucuugaccucuugaucugcccgccucagccucccaaagugcugggauuacaggugugcgccaccgugcccggccgguauuuuuuuaauaaaguauugagaaaugaagagguuuagucacugucagcaaguccuacugauucuaucuucuaacugugucuugaaguaaucucugugcuccauucucagcccuuaucuuucauagucucuuuacaaauuccuguaucuccaggcucuuguaugucuguucaaucuuucuuccuuuguuuuuuuguuauuagcagauaaccauaggacagucuuguuuuugcaagaauacucauucuaaaauguaaacuucacugucuuccuuucauaaacuuuuccugguuccuuaauaauuaaguccaggcacuuuaagccagcaugcaaguuaugguuuaaccuuguaccuacucuuccaccaucucuagauuaucuuuguuuugugguuuauacucaagcaguaccaaacugagcugcuuauaguucccugaacacacuaugcuauuccauauucuugugcuuucugauguguuauuccaucugccugaugauguaaacgucuuuggagucccuguauucauccagcaaaaaguccuuuuaaccauccauauaauaaaauuaaccaucccauaccaucauguaggccagccguaucagauuauucauccuucagguucuagcucaacugucacaucaucuauucagccuucccuauuucucucaauguccauugagguauaggauguuucuacuuuggagaaaagaauugcuuccuuaacuuccacaaagauguauguauauuuguuuuguaucguucauuauaugcuuuaguuauuuguauuuuaaucuccccagacuaugagguccuuguuuugguuagacuuuguacccuauuuuuauuuucagaaccuaacaugcccggugcucugauaaauggaagauuuuuuuguuuuguuuaaaaauuacuguuaacaucaauaauaugauucugaguuguggaaaaauucagauaaagugagggaaauuaauuuuuaguaaaugcccacuauaugucaagaauuguacuaggcugucaaaauacagugguuuucagauuuauuuuagucauuauauucuuaagagaaaucuuacaaaauccaauauguauuacaguuaaaagggaaaugaagcugauagaagcuugaaguguggaccuuggaaauccacugauuagccaacaccgcccuuuuauguagccagcucucucuuucugucuuccaguagacauaaccucucuccuugguuuucauccauuaggccuugagguagcuccaaaaguacaauuugaaaucuauagaauucuuuauuuaaaccuuuucagcaauccucugaaaugaguguuacucuuuucaucguguacauuagaaaacugagacucagagaaguuaaauaauuugauguucuugauagguauguauuuaucagauggcagaugagaaaauaauuuaauaagauuaaguauccuuaaggacuugaccuuuaaaaacaggaauguuucaaagaauagucauuaaauuuuucagacuuuauaauaauucuucagccagagaagauaagugacauaaacccucuccuggaccuuuuuuuuuuuaauacuuagauugaaaguauccuuacuagaaaauaaaacaaagacauauuauugaagaguuugccucccaaaaugugaagcauuucuucucuccuuuuuguguggguuuaauuuuaauuuugaaaucuuuucaaaaauauuuuuauuuggaguuaaaguuuuaacuauaacaaaauuuuaugcagaaaaugaugcacuugaauaaaggacugaauuuuaaucuuucugauggucuucagcauuaguauuugugguuuuuaaaacauggaauuuuaaguauaaauacuguuaggaauuaaggcauuaugguuaaauaauuauauuaaaugcauaacuuugaaaucuucuauagcuaaaaucucuuguuuuaaaacugauuuaaguccucaaaugauuguaaaguuuauauguauauuuauacauauaguuaauauguaacuguuacucuuguauaaauugcaguaaagcaaaacauucuggagaagugaaaaaucacucucuaaauucuacuuuguaaaucuucauaaauuuauaaaacuauaucagaaugaaaaucagaaaauugagacagugauuacuugucucuaguagguagggagaggaaggugaucaggaagggaucaguauauuagguacaugguacauuuauuuuuuauaugguacaaauacacuuuuuaaugugugaaauaauagauuuuuuaaagcuaacuuuaauauuuuaauuagcaucucuuuuaacaacaagauuucaugaauuuuuuuaaaaucaacauuuuauuguuacauauacucugaaacaugcuuacauuuuacauagcuaggcucuaaaugccaauuuauaaaugaccuggaaacauauaguucacaaaaauauauuacuaagugcauguagaguaguuuaugaaauugcaacuuuaagaaaaagacuuaaugaaacaguaaaugaaauguauucaaauuuauaaugccuuggauuuauuucacgucauauugucuguauuacaguuuuucaauggaaauuguagauuuuaacuuuuuauugguauuaucguauauuuccuuugcuaauuuaauuauuuuugcuaaguuuuucuucuuugcacagacuaauccauagcaaaaacuagaaagacuuauuagacuggacgauauaaggaaagauuuucggguguuuuaaaauaaaguauagcucucccuaagccuauacuuuuuauuuauuagaggugauuucugucugccucauccaugcuguaacagagaacuucagucugauucucauaaaugggacucuaucauuuguauauuuaaagauucuauaauuuccauugugauaauguaaauacacacuaauuucaaaaccccaaauaaauucuacauaaucuguaauuuggaauuaucugugucgcccuucgucugcauuugcauaaaaauaaguuacccaagauccuauguaaguauguuuaacaacugcaaacauuuauugaccaucuguuauuuacagaguucucuguucaaccuacaaauacaaauagaaaauauauucucuaaauucaaggaauuuauauucuguuuacuugguuuaaguuuucuuauacuuaauggaaccaauaguuucuuuacaguuuaucuucuaggauuccuucucacuaucauuacugauuucuuguuauuugaggucuuuuagucucaccugccuagcuuuggaaucgaaaugcagauuaccuguucaccuugucuacuguuuuccuuuaaauaaucacagaguuacuuuaguuucuuaguuuauccagcuaucuucuaaaguuauuuuaacuucagaguuauggaaaaacacccuuuuauugugucauauuugcagguauuagugauagaacagaaaaaugaagauggaacauggccaagggguccuucuacuccuaaguaagugcucccacuucuuauggcuuauuguaugauuuugaagcccuugaugcuagauaaucaaauccacaaugauagaagaaccuagauguguauugcagaaauucaugccuuguuuauauuugaguauuuuguucuuaguauacaagcuaucuaaauuugcucuuaauuaauauguuacuauuuuaaaagccuccaauucaaauaucuuaaggcauaguauaaauguaugguauaaaugagaaaguugcguugucugauacagucaaaucauuaaacauuuguuuaauuucuugaagcuuuuucgugguuuuuaaaaguaucuuaaaauauuucuuuaucaaaaugaaucugaugugaaaguaauauauuuauucaaaugaaaaguuuuagaauaaaaaagaacaaauagagguagaggaguauaugagguauuuuugaggguaaaugaaagaagaauuaggaaucuuuuuaucuguuuuagaacuaauagaucuacacuccauuaucaaaacacaaggccaguuguguuuaaauauacagacuucucaaagcucuaagaaguaauaugguacaugucccuccauuacuguaauguuucuguuucugcaaaaggacacuucuuuauaaucaaacacauuaauauuuuuucagcaaauauucacacuaagugggauaaauaaggacuauaaauagcauuauaucaguucagguuagguugccaccaaaugaacugugaaaaaauuuuuaaguuuuuggagcuuuggaauuucacauguucugauaagggauugugaacauauauuuugaaauucuuaaaauaaugauauuuuuaaaaaacuaauaacaauuuaguacauuuuaaccaagugaauaaaaaaaucugcuacuuuauuugauuuaaaacuacaaugcccuccgggugcaguggcacaucccuguaaucccagcacuuugggaggcgaagacaggcagaucaagaggucaggaguuuaagaccagccuggccaacauggugaaaccccaucucuacuaaaaauacaaaaauuagccaggagugaugaugcaucccuguaaucccagcuacucgggaggcugaugcaugagaaucacuugaacccaggaggcagagguugcagugagcugagaucgugcugcuguacuuccagccuggccaacagaaugcgacuuucuccaaaaaauaaauaaauauaaauaaauaaaauaaaacuacaauguaccuuuuauaagugguuuucuauccuuuuuuaucuuacgugaaauuuuuuuuucccauuuaaaaauaucaugagaaggcaccuaaauauguuaauuacauggaggugauuuuuauucuuacccuacuuaguuggaugcaguacaaggguagaacuuaguauaaaaguagaacuuuuaagaagauguuaauauuaaaagcauguggguugaauuauggagauuucauaacugaugaagguuuagauaggaauauuuuuugugaacauuuacuuuuagucuucaaagcagaaccacuguuguuuccuaaauguuuagauugcuauguacuugcuauaucuuuaaguuauuuuugaaauuacaaaauuguuuguggauuaauauuaaaaaaaacccaugaguucuaaagauugagaaaucuuuucuacuuaaaaugacugauuuuugcccaaaagaugacuaauuuuauauuuucuuuuauucccuaauagcacaauaucauuuuuauuuauuccaacaacuuuaguacuuggcuuugugugaaagaaaacagaauucccuauguaauacccaacacaccauacucaugcaauaaauauuggugaauacaggugcuguacuagagaugacaaaaguacaauuaagaguccuauuuuucacuggaucuacuaguugaauaaggaugccauauacuaaagcauagaaaaguuaaauauccauucccuauaaaaucuaagaaauacuaugcaguaauaugucauaaauugccaaauaauaauuuacuguaauacagaaaaagaucugcaccuauguaugaaaagauucucagaaaacuaagaauaaagggaaauucuaacuugauacauccugugcaccucaagucuauagcaaaaguuacauuucauugagaaauuuugagcacaauuuaaguaagaggagaagauaagaaagaagaaauaaaguucacuauucguauaugauauagucauuuguauaaaauccaaaacagcaaacuacuagaacugagaaaauucagcaagguugucuaauauaagauuaauuuauaaaaagcaguuguuuuuucuauaccgagagaucagcaaucuuuuuuaaauguuuucagcuuugugggccauauggucucugucauaacuauaacugcugauguaguaugaaagcagccuuagacaucaugucaagacauggcaaugccuguguuccaauaaagcuuucuuuguaaguagauggcaagcuuggauuuggccugugagccauaaauuucuaaccccugccauuuaucaugagaaacccacuuagaaaauagucuaacaaaaauuaacuuaauuaaaaacgcauaaaaccuucaugggaaaaaaaaaaucuaaguuuauuagaaaauaaaagauuguuaugugauauauggcuuaaccuaguaaugccuguuuucuuuaaagcacaucagugucuccuguucaaaauuuuuuuuuuccuagaaacuugacaaauucauuuuaaaguuagcauagaccaauacagguccagaauuagcugagucaguuuugacagaaagaggaaggaaggaacacuagaccuacaagguaaaugagaguuacuguaaaauuauacuaauaaaaacaacauaaugcuagcaaaagaaaggcaaauagauugguauaaacuaguaaucucagaaagauucauguauauuugacaacuugguauaugauguggcacaacuagguagugagguugcuuaaagaagaugauuauuuagauuuaguaggaguacuggcuauuuggaaaaaaaagcuagaucccuacuuucaacuuuauaugcaaaggcuaacucuugaaggauuaaagaccuaaauaagaaauauaacacuuauauuuaaugaauucacuuauauuuagugaauauucacuuauauuuagugaauaguaggcugggcaugguggcuuaugccuguaaucccagcacuuugaguggucaggaguucaagaccagccuggccaacauggugaaauccuaccucuacuaaaaauacaaaaauuagcugguauggugguggacaccuguagucccagcuacucgggaggcugaggcaggagaaucacuugaacccaggaggcggagguuuccgugagccaagaucgugccacugcacuccagccucggugacacagugagacucuaucugaaaauaaauaaauaaauaaaugugaauaguagaaauuuuggagaauaacuacaucauagggaucauagaacauaauguucaaauuuaguagaucugauuacaucagaauuaaagauuucuguuaaaagaacuauacacagaguuaaaagucagaugucagcuuuggaacuuuuaaaaccuaaagggaauaauaccuguaauauauuaagaacuccuaaaaguuaacagaaacaaagaacaauagcuuuuaaaaaaauagguaaaagauacuaacagacaauuuaaauaaaggguagcuaagugcuaacagguagaugagaagauagacaaacucacuaguaaucagaaaaaaaugaaaguaaaugagauacaauuuuucacccaucaaaaugacaaauauuuaaaaguuuucugaugccaaguauuggguaugguguagauaucuguguacuuacgaugugaguguaaacuaauauugucauucuguaaaccagucaauaauuaaaucagaaguguuuaaucccucugacccagcacucagaggaauuuuuaaacagaucuuugaggauauaaucuuuguagcugcauaguuuguaguaguggggauuuggagauagccuagcuaaauauccaucacugguaaauagagcaaauaagaaaaaugaaaugggaguaacaauggugagaucuuuaaaacuagaugaaacuuuaaaacauacaguugagagaaagaaacaaugagauucauaaauauuuaagaaaauagaaaaagcacaguagaaggaaaucggaguagagauaauaggaggaaagaggaaacaaguuugaggaaauaucacuugcuaaauuuauuuauauuauauuucuauagaugaagcaaggaugauacagauucuuuuuucuggaugaagccuggcuugaaaaaaaaacaaauggggcugggcacaguggcucaugccuguaauccuagcacuuugggaggccgaggcaggcagaucauuugaggucaggauuucaaaaccagccugaucaacauggugaaaccccaucucuacuaaaaauacaaaaauuaggcaugguaacaggcgccuguaaccccagcuauucaggaggcugaggcaaggagaauugcuugaacccaggaggcagagguugcagugagccaagaucacaccacuacaccccagccugggugauagagugagacuccaucucaaaaaaaaaaaaaaaaauagaaugccucuguguucauugaaaagcacauuuuaggcugagcaagguggcucacaccuguaauccuagcauuuugggaggccagaauaggaguaucacuugagcccaggaguucaagacgacucugugcaacauaacaagaccccgucucuacaaaaaaaaaaaaacaaaaauuagccaguuaugguggcaugcaccuguagucucagcuacuccagaagcuggggugggaagauugcaugagcccaggaguucaaggcugcaaagagcugugaucacacaacugcacucuagccugugcaaaagagugagacucugucuccaaaaaggaaaaaaaaaaaaaaaaacagaaaagcauguuauaagcacaugauguuagcuuaggcaaauuuaacuccagcacagaacacguaauuuuaaguccuuaggaaggacuucaagauauuaagauacagaacaguuuauacuccucaaaauucucacauuugccagaagacaaccccuggccuucaagauggcaugaaaaugcuaguucugauauauaucacuaaccuggaauuuguccauaauguugcauagcacauaaccaguuccuagcuagggugucaaacaccaaagaaagauaauuaaagcuguaauauggugauagaaagaagaaucacugguagaauuuauuaaaacaguuuccugggccccauccucagaauuucuuauuaugucuggguguggcucauuucuaauaagcuugcaggucacaccaaugcuguuggucuaaggaugacacucagaaauuuuguaggugauguuuauugacauuuacuaggugaaccacauaguggcauccaggguucccaccccagaccagcaaaauauaaauauaguuagccaaggaauuugcauuuuaaguacuucauaugaacaagaaaauagaagaauauuaccacaaguaggcacacgugaaaccacauguuaguauuuugucuguucuauacugcugaaaauagaggaaccuacuuagugcucugauguccuauuguauuggccccauuuugauuaguuuugaaacugugucuucagcugaagcauaaauuuuugggcuccuugagaagaaaugcuaaauauucaaaaaauguuaaggguaaaauuuaauuuaaaacauguagucauuuaguuacaaaaaaaauauguguauaugcuuuuaaucagcaccuaaaacaacucaaagucuguauuagagaucuaagaaccuacccaaaaaauacucacucaaaagucuucuguucaagcacaguggcucacuccuaugaucccagcacuuugggaggccaaggugaacggaucacuugaggccaggaguuugagaccagccuggccaacauggugaaaccccgucuccacuaaaaauacaaaaauuagccaggggugguggcggcgccuguagucccagcuacucgggaggcugaggccggagaaucacuugaaugcuaaaggugaagguugcagugagcugagaucgcgccagugcacuccacuuuggguagcagagcaagacucugucucaaaaagaaaaaaaaaaaaaaaguuuucuaacugaauuuuucuacuagauaucaacaaagaauuugaaauuuuuauuuuuauguucaugcugcauuuuuaacacuacuuguuuuaucaggauuugcauuucuuaucuaguuuuuaaguuugauuucuuaaacagccucuuaaaaacaugaucuuuucuaaugauaccuuagaaaaaguuuuccccccuaguuuuaaaaauucuguaaaauuucauuucuuuuuuuuuaaggauguuagcauuggguggauaaucuaguuguucuauugcagacguguagcuaguaaaaucuuggauuucuaaaaaaugauuuuacaguggagucauuauagaaaccuggggguuccuaaagagaaaauuugauuuaaauuuauucauuuucauugauuagucaaaaaguauugucaaaagauaugugcuuaaguauuggguggaaaaaaaauaagagucauugaugauuuugaagaggugauuuuucuuggacuggaaaacauccagagaaaaauguacuaucguccagaauaggacaugaguggcagaaagaaaaaucaaauggaaaaccaugcuaauagcucuuacucauacacugucccucugccauuugugguguucugauuaagggaauuccaaauugaugacugaaacacuauaaacuuaauuucaugacacaauaguauuuucacagcacugucuucuugagugcucugcuuggagagaggaagaacuuuauaaauaaaaccauugcauacuacuuuuuugguugagacagauaguaagcacuuaggugauucugcaauauucuguuuuuauuuuuuuuacacuaucuuaaacgucuuuagaaauuuuuagagaguauucaaucccuguuugcauuuauaacugcgaagcagcuaaauggauuuggaaaugaugcauagacucauuugguuaaaaauuauuaaaauacauguuggcuguagccauucuuuauuccuugucauucagccaguucauacauuucaguaacaccaaucuucaauuugaaaugcaaucugugaaccauaaaucuagagugauacuccaaaaucuauaauuuguuguuguuguuguuuuaagacaggaccucacucucauuacccaggcuggaaugcaguggagcagucacagcucacuguagccucaaauucccaggcucaggugauccucccaccucagccucccaaguagcugggacuacaggcacaccaccacaccuggcuaauuuuuggguuuuuuuguucuuuuguuuguuuguuuuguuuuguuuuuauaaagaugggguuucaccauguugcccaggcuggucuccugggcucaagcagucugcccacuucagccucccaaaguguugggauuacaagugugagccaccaugcccagcuguuaucuuuuuaaaagacauuuugaauccuuaaauuuccuuuuaugccuuuuuuuauguuguuauucucauuaagaaacagauguagaaugguguuuucugagacuuuaaaguuggagguaaugaaauagccaaacaaaaaugcuuagguuacaauuaaagggaacugcaguauggaguacugagaacugcagguauggagucauauuccuauaaaugggaauauaagcauauauaaauuaucuaaccaaaaauguagagacaacauaccaaaaccuuaaagagcauccugagguaaugaagaaggacaguuggcaucaaauagaauaaucaugaaggcucaggaaaacuugugcugauuaaaacaaaaaaucccuuauuuuuuagggauacauacauacuguuguguuuucaggugaaauuaugggugucuagaauuugcuucaaacuacuccagcaaaagagggggucggagggaagcugaagggauuauagaaaaaguaagaaugguagaauguuaauuuuugaauaccauccuuuuguaguggccauacuaaucuucucuguaucguuccaauuuugguauaugugcugcugaagcgagcacuagaauguuauuuuuaaagcuaaguuucugauauuagguacaugaggguuaauguauguuucaaaauuucuguaauaaaguuuaaaaauggguugcaaguuuuggugcuuagauucauaauuggcugaaaaaauuauuguaauuucauuuauuuaaaauggaacauuuuguguuaucaaauauuauauguaaaaguaagcagucaaaauaaggaaaaauagagcuaugaaaaacaauuuauauauaguauaaaucuacuuaaacucucuuuuguguaucuuuaaguaccuaacacccuaccuggcauauaggaagcauacaguaaaugcuguugaacugaacuaaucuguaucuuacaacaguaaaaguguuuaauuuuuuaggagauuuagaauuuucuuuuucuuucagaacuugucuuagaauguugauuagaaauggagaguguaauguuggucuuguuuuaguuacuaagcuaauuuuuguuuuaugauguuagguuguaugaaguuacguuguuuuacaauguuggguuugaaaauauaaaaaucuuuaaauaacuguuuugcugucucaacguucagacuuaacuucucuguauuuugguugcuuaauauggugguagauuuccaugaguguuaaauguuuaguugacuuacuaaaagcaaguuauguuuuucuauugaaguaagaggcucaacuuagccuugaauugcauguuuuuaguugaaacauauugggcauagggaaauucagauacuacaaacuuccauuugucaggaguaaggcugaauuuucugucuucaugaaaccacuucagcuaaauggaagucuuaccuuuuucugucugagggcacgauauguuacaccuagcccaaacuggccaaaauuaguuuaauucuagguaagugguuugaugucuaguuaauguaugauauucuuagcacuuuuuuuucuccuuuuucuagaaagccacuagagcagaguugcuagugaacaguuuaauuuccacauacgucacagaaagagagcuaaagggcucugguuaucauccacagacugaccagucaaccccuaaauaaccugauauuaacuccacaaauguuagcuagauuggaccauguguaaucugagucagaagucggaaucagaagagauaaaugaugcguuaucacucaacaguaaugucugcaacaguauuguaaaauuguuguacuuuaccugucgaccacauccauccuuagcucucugaucaccuuacuauuuaaggacagucccucuacucuaccuguaguauuuaucucaaugcuuccugguccuugcuuuuucuuuuauuaucuccucucuccuacauauauaaaugccuagcauagugccacacauaugguaaacaccaguuuauuauuuuuauuucuuuucuaaugucaucuucccccucagccuaugaauauaaacacaucuucaucuuuaaaaccaaaaaccauauacuuccuccauuuaccauccuuaagcuuuuuuuucuuugacagccaccuacauuuaaaaggcuauacuuaauguugcuugccacccauucaggauuuaacaaaguucuuauuugucuuucuuuuaaccuaguuuauuugaccugucuuuaguauuucuuuuugauaaccaucuucuaaagaaauucucugaauuugaaugcaugauacgaccuuuuaugccaaggacuuugccucucugaccaguccuuugucugucuagcucgguuccucuuuaggguugccacauuuaguuuugcaaauugugcacagcucuaggaggcaucauucauaucauauguagucuaugugauaggcccuccuuggcacggugcagugcagcuucacuaacuguuugcagcagcucuacucagaccuuaaaugcauugacauucacuaaauuucugucagaagaccucuuuuaucauaccauaguagguguucaaaauuaggugauucuaugcuaauccucucccccagcucaaacugacacaaaauaugccauucuguauuucuagacuagaccacuuuucugaauuccagauuuuucauaaauuucauguaggacucaccaccucaaauuaaaccaaaucuuuuuaccccuccuucucccauccccucaaccuaaacugucuucauuuccuguauugccuauuucaaguaccauccaagagccauccugaguuccuccuccagccuuucuucucuugucuaguuagucagcaagucuugcagauucugccuccucaccugaaguuuucaaacaguaccccuuuacauucuugaaaauuauuaaagauccaaagaacuucuguuauauggguuauagcuguuaauauuugucauauucgaaauugaaauaagauuuuaagguauuuuaaaauaacaguacaaaaccauuguauuuugacaugaauaacacuuuuaugaaaauaacuauauuccaaaacaauaaaauuaccaaaaaguugcauuguuuuuuauuuuugaaauuucuuuacuaucugacugaauagaggacagcuaaauucuuguauauucuucugcauuuaauuuauuguaauacaauguuuggguugaaguacaugaagcaaaaucagccucacacagauacauaguugaaaaggaguauuuucagaucauuaauacuacaucaaaacuugacuaguggugguuuaagucuuaaaguuaaaugauagaaucugaaaccauaucaaugaaccuuuuauaguauuaaaaucuuucaaauguaaauuucaugcauuuuggucauuugggaaauauucacggaguuaugcagaucuuccaaauguugacacauuuuauucuacaauuuuuuucaaaucacauuuuuuaaaacaucaccuaucuuaugagaaacgccuaaguauugggaagcugucaacuuuguggugucagagucaaguuuuccaagauucuaauucuucaucgaaagcccaaauuuuaucauuggcugcaaauacauuguuuuccuuaaagacacagccuuccuucauucauuuuucagaaaaccucugcuugauagcuguauuaguccauuuucaugcugcugauaaagacauauaggagacggggcaauuuacaaaagaaagagguuuauuggauuuacaguuccacauggcuagcgaggccucacaaucaugguggaaggcaaggaggagcaagucacgucucagagcuugugcagagaaacucccguuuuguuuuguuuuguuuuuugucuuuuuuaaauuuuauuuuauuuuaaguucugggauacacgugcagaaugugcagguuuguuacauagcuaugcaugugccgugguaguuugcugcaccuaucaacccaucaucuagguuuuaagccccacaugcauuagguauuuguccuaaugcucucccuccccuugcccccaccccccaacaggcccugguguguguuguucccccucccuguguccauguguucucauuguucaacucccacuuaugagugagaacaugugguguuugauuuucuguuccuguguuaguuugcugagaaugaugguuuccagcuucacccaugucccugcaaaggacaugaacucauucuuuuuuauggcugcauaguauuccaugguguauaugugccacauuuucuuuauccagucuaucaggauggagauuuggguugguuccaauucuuugcuguuguaaauagugcugcaauaaacauacaugugcaugugucuuuauaguagaaugguuuauaauccuuuggguauauaccuaguaaugggauugcuggggcaaaugguauuucugguucuagauccuugaggaaucgccacacugucuuccacaaugguugaacuaauuuacggucccaccaguaguguaaaagcauuccuguuucuccacaucuucuccagcaucuuuuguuuccugacuuuuuaauaaucacuauucugacuggugugagaugguaucucaucguggugugauuugcauuugucuaaugaccagugaugaagagcuuuuuuucauauguuuuuggcugcauaaaugucuucuuuugugaauugucuguucauauccuuugcccacuuuuugaugggauuuuucuuucucauguaaauuuguuuauguuccuuguagauucuggauaauagcccuuugucagauggauagauugcagaaauuuucucccauucuguagguugccuguucacucugaugauaguuucuuuuccuguguagaagcucuuuaguuugauuagaucccauuugucaauuuuggcuuuuguugugauugcuuuugguguuuuagucaugaaaucauugcccaugacuguguccugaaugguauugccuagguuuucuucuagguuuuuaugguuuuggguuuuacauuuaagucuuuaaucuaucuuaauuuuuuauaagguauaaggaagggguccaguuucuguuuucugcauauggcuagccaguuuucccagcacuguuuauuaaauagggaaucauuucccuauugcuuguauuugucagguuuguguaagaucacaugguuguagauguguggaguuauuucuggggucucuguucuguugcauuggucuauauaucuuuuuugguaccaguaccaugcuguuuugguuacuauagccuuguaguauaguuugaagucagguagugugaugccuccagcuuuguuauuuuugcuuaggacugucuuggcuauacaggcucauuuuuuguuucacaugaaauuuaaaguaguuuuuucuaauucugugaagaaugucaaugucaauucaauggggauagcauugaaucuauaaauuacuuugggcaauguggccauuuucacaguaguucuccuugaagagguccuucacguccauuguaggugguauucguagguauuuuauucccuuuguagcaguuaugaaugggaguucacucaugauuuggcucucugcuugucuauuuucgguguauaggaaugcuugugauuuuugcacguugauuuuguauccugagauuuugcugaaguugcuuaucagguuaaggagauuuuggacugagacaaugggcuuuucuaaauauacaaucaugucaucugcaaacagagaccauuugacuuccucucuuccuauuuaaauacucuuuauuucuuucucuugccuaguugcccuggccagaacuuccaguacuuuguugaauaggaguggugagagggcauccuugucuugugcugguuuucagagggagugcuuccagcuuuugcccauucaauaugauauuggcuaugggucugucauaaauagcucuuauuauuuugagauauguuucaucaauaguuuauugagaguuuuuaacaugaagggauguugaauuuuauugaaggccuuuugugcaucuauugaguuacuuaugugguuuuugucauugguucuguuuaugugauggauuacuuuuauugauuugcauauguugaaccagcuuugcaucccagggaugaagcucacuugaucaugguggauaagcuuuuugaugugcugcuggauucgguugaccaauauuuuauuaaggauuuuugcaucaaugugcaucagggauauuggccugaaauuuucuuuuuuuguugugucucugccagcuuuugguaucaggaugaugcuggccccauaaaaugaguuagagaggagucccucuuuuucaauuguuuggaauauuuucagaaggaaugguaccagcuccucuuuguaccucugguacaauuuggcugugaaucagucugguccugggccuuuugugguugguaggcuauugauuacugccucaauuucagaacuuguuauuggucuauucagggauucgacuucuuccugguuuagucuggggaggguguauguguccaggaauuuauccguuucuucuagauuuucuaguuuauuugcauagagguguuuauaguacucucugaugguaguuuuuauuucugugggaucaguggugauauccccuuuaucauuuuuauugugucuauuugauucuucucucuuuauucuucauuagucuagcuagcagucuaucuauuuuauuuuuuuccaaaaaaccagcuccuggauucguuuauuuuuauuuuuugaaggguucuuccugucucuaucuccuucaguucugcucugaucuuaguuguuucuugucuucugcuagcuuuugaauuuguuugcucuuccuucuuuaguucuuuuaauugugauauuaggguuucaauuucauaucuuuccagcuuucugauaugggcauuuagugcuauaaauuucccucuacacacugcuuuagcagaaucucugguacauugucucuuuguucucauugguuucaaagaacuucuuuauuucugccuucauuuuguuacuuacucaggagucauucaggagcagguucuucaauuuccauguaguugugccauuuugggugaguuucuuauccugaguucuuacuugauugcacuguggucugagagacuguuaggauuucuguucuuuugcauuugcugaggaguguuuuacuuccauuuaugugauugauuuuagaauaagugccaugcggugcugagaagaauguauauucuguugauuaguggugaagaguuuguagaugucugugagguccacuugauccagagcugaguucaaguccugaauauccuuguuaauuuucuaucucauugaucugucuaguauugacaguaggguguuaaagagucccacuauuauugcaugggagucugagucucuuucuaggucucuaagaacuuguuuuaugaaucugggugcuccuauauuggguccacauauauuuaggauaguuagcucuucuuguggcauugaucccuuuaccguuauguaaugcccuucuuugucuuuuuugaucuuuguugguuuuaugucuguuuuaucagagacuaguauuucaaccccugcuuuuuuuuuuuccuuuccauuugcuugguaaguacuccuccaacccuuuauuuugagccuauguaugucuuugcaugugagauggguguccugaauaaagcacaccaaugggucuugacucuucauccaauuugccagucuaugucuuuuaauuggggcauuuagcccauuuauauuuaaggcuaaauauuguuaugugugaauuugauccagucaucaugaugcuagcugguuuuuuugcacauuaguugaugcaguuucuucauagugucauuggucauuauauuuugguguguuuuugcaguggcugguaccaguuuuuccuuuccauauuuagugcuuccuucaggaauucuuguaagggcuaccugguggugacaaaaucccucugcauuugcuugucuggaaaggauuuuauuucuccuuugcuucugaagcuuuguuugccuggauaugaaacucuggguugaaaaauccuuucuuuaagaauguugaauauuggcccccacucucuucuggcuuguaggguuucugcagagagaucugcuguuagucugaugggcuucccuuuguaggugaccugaccuuucucucuggcugcccuuaacguuguuuccuucauuucaaccuuggagaaucugacgauuaugugucuugggguugaucuucucauggaguaucuuagugguggucuguguauuuccugaaugggaauguuggccugucuuacaagguuggggagguucuccugaacuagguugaggaaguucuccugagaguucacgucucucugaaguguguuuuccaacuugguuccauucuccccgucacuuucaguuacacuaaucaauuguagguuuggucuuuucacauagucccauauuucuuggaggcuuuguucauuccuuuucauucuuuuuucucuaaucuugucuucacaccuuauuucagcaaggugaucuucaaucugugguauccuuucuuccgcuugaucgauugagcuauugauacuucuguaugcuucucugauuucucgugcuauguuuuucaguuccaucaggccauuuauguuccucgcuaaacugguuauuguaguuagcaguuccuguaaccuuuuaucaagguucuuagcuuccuugcauuggguuagaacaugcugcuuuagcucagaggaguuuguuauuacccaccuucugaaaucuuuuguuaauucaucagucucagucuccauccaguuuugugcccuugcuggagaggaguugugaucauuuggagaagaagcauucuggcuuuuggaauuuucagcguuuuugugcugguuuauccucaucuucaugauuugucuaccuuuggucuuugaggcugaugaccuuuggaugggguuuuuauuggggggucuuuuuguugauguuguugcuuucugcuuguuuguuuuucuucuaacagucgggccccucuucugcaggucugcugcaguuugcuggaggucuacuccagacccuguucgccugguuaucaccaguggaggcugcagaacagcaaagauugcugccuacuccuuccucuggaagcuucgucccagaggggcacuggccugaugccagccggagcucucccguaugaggugucugucaaccccuguugggaggucucucccaggcaggagacacgggaucagggacccacuugaggaggcagccugucccuuagcagagcugguacgcugugcugggagaaucccccuugucaggaucagcugcucucuucagagccagcagccaggaaagauuaaguccacugaagcuacacccacagccgucccuccccccagugucucugucccagggagaugagaguuucaucuguaagccccuggcuggggcugcugcauuuucuucagagaugcccugcccagugaggaggaauguagagaagcagucuggccacagccacuuugccacacuguggugaauccugcccagucaaaaccucccagucuccauagcacugucaggggaaaccaccuacuaaagccucaguaauggcagaugccccuccccuaaacaagcucgaucgucccaggucaacuccagaccugugcuggcagugagaauuuccagccagugguuccuagcuuucugggauccaugggagugggacccgcugagcgagaccacuuggcucccuggcuucagcccccuuuccaggggagcgaaugguucugucucgcuggcauuccaggcaccacuguaguuacgagaaaaacuccuacagcuagcucagugccugcccaaacagccacccaguuuugugcuugaaacccagggcccuggugguguaggcacaggagggaaucuccuaaucugcagauugcaaaaaccaugggaaaagcguaguacccgggccagguagcacagucccucauggcuucccuuggcuggaggagggaggucccccaacuccuugcacuucccuggugaagcagugccccacccugcuucugcucacucucuguggguuguacccacuaccuaaccagucccaaugagauggauaccucaguuggaaaugcagaaaucaccuaccuucuccauugaucucccugggaaccucagaccagagcuguuucuauuuggccaucuuggccccuccccgaaacugccauuuuuaaaaccaucagaucucaugagacccauucacuaucacagaacagcauggaaaagacucgccuccaugauucagucaucucccacaaggcccaucccacaacacaugggaauuacaggagcuacaagaugagauuuggguggggacacagagccaaaccauaucauucugccccuggccccucccaaaucucaucucuucacauuucaaaaccagucaugcccucccaacaguccccuaaagucucaacucauuucagcauuaacucagaaguacacaguccagugucucauucaagacaaggcaagucccuuccaccuaugagccuguaaaaucaaaaacaaguuaguuacuuccuagauacaaggaagauacaggcauugggucaacacagccauuccaaaugggagaaauuggccaaaacaaagggucuauaggcccagugcaaguccgaaauccagcagggcagucaaaucuuaaagcuccaaaaugaucuccuuugacuccaugucuugcaucugggucacgcuggcacaagaggugggcucccacagccuugagcagcucuuucccuguggcuuugcaggguguagccccacuccuggcuguuuucaugggccagcauugucugcagcuuuuccaggugcacagugcaagcugucaguagaucuaccauucuggggucuggaggacagcggcccucuucucacagcuccaguagguggugccccaguagggacucucuaugggggcuccaaacccauauuucccuuccuggcugcccuagcagagguucuccaugaggaccccgccccuacagcaacuucugccugguuauccaggcguuuccauacauccucugaaaucaagguggagguucccaaaccucaauucuugacuucuguacacacacaggcccaacaccacauggaagcugccaagauuuggggcuuccacacucugaagcaacagccugagcuguaccuuggccccuuuuagccauggccagagcagcugaaacacaggguaccaagucccuaggcugcacagagcagggugguccugggcccagcccauaaaaccaucuuuccuuuuaggccuccaggccugugaugggaggggcugcugugaagaccucugacaugcccuggagacauuuuccccauugucuuggggauuaacauuuggcugcucgguacuuuugccggcuugaauuucuccucagaaaaugggauuuucauuucuauugcauugucaggcugcaaauucuccaaccuuuuaugcucuguucccauuauaaaacugaaugccuuuagcagcacccaagucacauccugaaugguuugcugcuuagauuucuucugccaaauucccuaaaucaucucucccaaguucaaaguuccacaaaucucuagggucggggcaaaaugccaccagucucuuugcuaaaacauaacaagagucacccuugcuccaguucacaaguuccucauuuccaucugagacuaccucagccuggacuuuauugucuauaacagugucagcauuuuggucaaagccauucagcaagucucuaggaaguuuuaaacuuucccacaucguccugucuccugaguccuccaagucuccaggaaguuccaaacuuucccacauuuuccugucuucugaguccuccaaacuguuccaaccucucugccuauuacccaguuccaaaguugcuuacacauuuucggguaucuuuucaacaacaccccauucuacugguaccaauuuacucuuuuagucaguuuucauacugcugauaaagacauacuugagacugggcaauuuacagaagaaagagguucauuggacuuaacaguuccacguuucuggggugggggggccucacaaucauggcagaaggcaaggaggagcaagucaugucuuacauggaugguggcaggcaaagaaagagagcuugugcagaaaaacucccauuuuuaagaccaucagaucuugugagauucauucacuaucacaagaacugcaugggaaagacccgcccccgugauucaaucauuucccaccaggacccucccacaacaccagaggauuaugaaagcuacaagaugagauuuggguggggacacagaaucaaaccauaucaauagucaaguucacauaaccacacguagucguuuccuaacguaaaagagaaaaaagaguggugucaugaaaacaaugacugguuccacuuguaguucaugcaguucaaauaacuacacaagcuuuuccucaugacagccaugauacuucaguuuguagcagauaugcuuuaugcaaacuucccaguuugucagauaauauuaaaaagaaauauaagaguuaagauuuaauaaaaucaauaauuuuuuauuuuuuucaauguggauauucucaagugaaacuuuuuuacugugaugugaaguauagguuagugcuacuccuuugauucaugcuaagguuucagcaguuuuauccaccauugcuuuugcacuaucagugccaauauccacucagugaaagaggucaaauaacauuuaaauaacacuuugauauuauuaugaaaauaguuuugaccucaccaauggacaccuuaaaaagggucuugaugacccccaggauccauggacuauacuuugagaacugcuuccuaaacauccaagauauguugcccuugcccacucuacuuucuuaacuccaccccuuauuaauucuuaccuuuguuguuuuuauaguucccuaacuggucucccaaucuucagucuuuuucucuuccuuaaaaguuccuagaauagaaaucugauuuuguugauacacuauuaaaaucuuuccacaugcuccagcacaauuggauaaaauccagauuucuucauagaauauaaaagacccuuuauuaucauaccuaccuuaguaaccucuguuccugucaguacuuccuagucuuucagccaagcugaauuuacugguaauucccugaacacaucaugguuucuacaugauuucuacaugcuauucuuccuaacuguaauacucuuuuacuucccaccuaucccucuaauuguacgucauuuuuaaaucaccuuaugucaccaccuacaaaauuuuauauuagaauuuguuaucauacuuguauuguauuauagucauuuugcuuauaugucauuuuuuccuauugugagcuguuugaggucaggaacugugucuuucuuuguauucccaguacuuaucaagggugaggcauacaguagucauuuaauaaauguuugaguguuuaaaugaacuccauaaaaacugaaaauacaaauuaauuccaugguauuucauuuucuuuuccaauauaguucucagaguugcuaauuaauaauaaaaaaggccacagaugagaagaaaaagaaaaaaguguguguguguacauauauauauguacacagacauacacaguguguguguauauacacaaaguguauacacugugcauauauauuauauauaauauauaugucucagucacuuuauuggaugaagcaauggaucuuuauuuccauaauuuuuacuauaagauucaggggaacauucgauuuauauauguuuuugaaaaguuguaaugaauuacauuuuaaaaaauuaaccuccuuaauuuauuauaacucagucucuaaucaauuuagacguuuuuuccuaauuuagaauucuuaauguggaggcaaaaaugccaggauauuuccauuuuuauuaauauuuuaaaacuacuaucugggaauauuaggauuauuaaaauuacuuuuuaaguguguucuauacauuguuuuaugagaaaacuugguugauucuauuuuguuuuugaguuuaguacaguaaaauaaaaucuuguuaaagggacuucuaucagaaggguacguaacuagaaaucccacuuaacagaauccaguaauauauaucauuuaucagcuaaaacaaccucguugaaaagaaaacauuuuuuucuaagauuuuauaauguauaaaacuuuaaaaguuaaauuaggccuggugcagccuguaaucacaccuguagucccagugcuuugggaggcugaggcaagaggaucacuugaggccaggaguuugagacuaggcugggcaauauggugagaucucugucucugcaaaaaaaauuuguuuuuaaauuagcugggcacgguggcacacgccuauaguuucaguuucucaguaggcugagauggaggagcucuugagccugggaggucaaggcugcagugagcugugauugugucacugccccccagccugggcaacagaacgaaacccugucucuaaaaaaguaaauaaaaaugaaauuuaaaauguacauuuuuuuauauuuaaaaaauuuuauugcccaccauuuguucugcauaaugcauuguagauauauauauuuagauaaauccaaaucaccuaaaagcaaauuuuguagauuaugcuuuucugccuguugaccauuucauuguucguuagcauaauauuuaaaagugaaucauucggggccucacugauuuaaaauuuacaaugacugagucacuggacugaagccuagcuuuuuacagccccuugccuagauguugccuaguaaauuaaaauaacauguuuacaaaauuacaaggggaaauaaaacuuuuagugaccuuuauguacuuaaauuauugcuguauuauagauuuguugauuauaagucaugccuuuaauacauacuuguugauuaaaaaccaauaguaauugcaguuucuucaaaaagauucugaauuaauaagguauguauacuauagucagauuuaugacuuuucccuuuggccaaauauagcauauugggauuaugcuuggaauuauuuuaucuauuuuguccccauugccuuaaauuuuuaaaaauuggaauguucucugaucucugugucaguguuguacauaauuagaaugccaugguguaccagugagaaacaaaguagaauaguuuaauuccauugacugauggaaauugaucguaaaauguuaaaaaugguuaccuaaacucggaaauggguauauguaguuaguagauuuauaggaauaauagcaagucgcauauuuaauuugauaaauuuuauuugaaaauaguucccuuuuguacuuuuauguuuuuauaaggaauaauacauucaaaauugaaaaccaaaggauaauagugauuuugcucauaaaucuauuuuucagcauucauuuacuacaaacauugucaucuguucuuuuauuucauaauuaauuuaaaaauucuucauuuuuuuaucuaauuuaacauuuucauauuuuuaaagguccccaggugcauccaauuuuucaacuuuaccaaagaucucuccuucaucucuaucaaauaauuauaacaacaugaacaacagaaaguaagcacugaaucuuaaaaacucuuuguuuaauugaucacccuauuaugguugcaaaaaaucucuuguaucuaaaauuuaggauaaaagucuuaaugcauuaaaauugguuuucuuuuaaauuaccggucaguucuuccaugaguaacaacaaaaaagaaagcaauuaaauugcuucuugauuuaauacauauacugaaagaaauaaaacacuuaaauuuuauauacuaaacacuaaucauuaaaauauauuuagaaguuuguuagaacacaacuuuuuaggaagaauuuaaauucagaugucauuuuagaacuagauguguaaucacauauaauaaaguauuuuuaaaaaguguguaucagugauucucaaguggaaagcacacaauaaauuuuuguuuaugaaaaaggcaaucacuuuuucuugagaaguucagaaaaacaauuuccuuaccucuugccaaauaaaauuuagaaucauggaauuuauaaaaauuuuauugaaguguguguuauauugcuauaagaaaaacaguugaaagucaagguuacacagcuucacucugaguguauuaucuuguauugacucuuaguguauuaccuugaacauugacauguuuuuuuaauucaaaaaggaaaaaagaaaaccuuuauuauuuguaauuagcccaaauugugggaagaacauugaucuagagaugauuauccuuuuauuuuuuuuugacauguauagugccuuuuauggauuagauugaaaguauuuagauauuugcacuaacauauuaguauuagauauuuaucuaauacuuauacuaauuauguauuacuauuauacuaaucaaaaauuuuaguauuuagauuuuuuucaguuucuaaauggcaucugauuaucucagugaguaaauucuaaaagacuaaagcuauuugugaaauaaucuuuaaaauuaaaacaccaauaauuaaauuaaaacaccaauaauuaaaacaccaauaguuaaauuuauuuucuaacagcucagaaacagaucuuuguauaaaaagaauuuaauaugaucaggaggcauuguagacuaauacgaaugggcagauuauccaggaaauaugguugagaaaauuggcucauaucugagaauucuucucuggaauuuuaaauccaagauaauuguuaagcauauuuaaaaaggaaaaauaaauggaaaaaagaacuuguuacaaaugauaaaggauuuauauucuaaauauaucaagcucauaaaaaucagaaauuuucuaagacagucuuagaaacacugggcaauacaaguaaaggaauuaaauaagggacaaacuuuuuuugagguaggaucucacccugucacccagguugaaguacagugucacaaucacagcucccugcacccaugaccucccaggcucaagugauccucccaccuuagccucuugaguacuuggauuacagcacacgccacuacacccugcuaauuuucuuuuuauuauuuucauagagacagucccacuauguugcccaugcugguuucgaacuccugggcucaagcaauccuccugccucagccucccaagugcugagauugcaggcaugagccaccuugcccagcugggauaaauauuuuacauuuucacauucacuacugauuagagauauguaaauuaaaaccaugaaaaaccccauuugcuuucccuuaccucagucacauugggaaaaauuaaacaaugacauguauuuuuauaaugauucugaguguuuggaguacuagaauaauuuuuucuagcaaaauuguuuaccaauaugaaucaagaacauuuaaaacauuuacauucuuauuucaguaauucauaaaaagauaugugcacuauguguaauaauauuacaacauaguguaauacuaaaauacugaagacacugaauauucagaauuacacugcaguaucuucucuucuauuuaaaaauguaugugcacaggccaaaaaaaaagagugaaaauaaccccucguaauuugguuuguauuacaugagagcuuuaaguaaacuuaccaaaagucauuuuuucauacuagauaaaauauuacuuaugauuuacucauugcagauggcucucauacuuacuguaagagaauucauuuacagguauuuacagucauucuuuggagagauuuuuaacauuguauauagacuauguugaauguagacuauauuuugaccagaauuaccauauugguaugaguggucugguguguuucugguuuuguucuguuugcauucuuaguaaauacgugacaguauaaucuaaucucaaaaccucugacugcagaaacuauugagagaaauuagagucuuaaguuugaaugauucuaucauaugacuacauuauauuuuuagcuauuuauauuuuuuuaauucaaacacuaaaauagcccugucauauuauggaauuuuaauagcgaauagucacugagguaccaugaagcugugaaccauuuugagcuuaaaaauacauuuuuauguaaggauuaucuuucuuaguaaggaacagaacuuaagcauucguaaaauggaaaguuuuuuuuuuuuaacuuuaaaaaacuugaauucuaucguauuuaaacaacuguuuuacauacaauuuauuucuugaauuuccauucagcuugugggaagacuucagauagaaauagcauaguuucuuuaaaaauauguaaaauagguaaugaccuuuuuggauuaaguauguuuuugaaaccuuauguauguggaaauagucuacaaguauaaguaauauauuaaaaucaauaguuuaugaaauuuauuuauaaauucaagauuuaacccuacacugauacauuucuaagauauaaaauuuuuauuuccagaaauaagaauauuguuauaaaauaauuccaaguaauaaaguauacuuggaauuauuucauuuaaguuuaauaaguuuuuauuaaaaaccaguauuaugaaaaauccauuacuguaauauaguuuguuuaccuugugucauaauuuuaccuauuagucccuuguguauuugguuuugccucaguuauaauuuaaguacauuuuuaaauaucugucagauugucuuucugguaauaguucuauaaccuguauuuuucugcccugcuauauuugcuuugguauauuacuaauacugccuuuuaaaaauauuuuuaacguguuuauugucucaauuugacauuccaaaugcagaacacuuuuuuauuuuucuguuaauucauuuauaucuuuuucuuugaaaugaaaaugacucccuguaugagauugagccucaacaggaacugugaauuuuggaaacuaccagagcuagccaucuggcucuugauaaauuuguuagcuaaaagcaucauuucauuaacugaaaaaugggcauaauuauaguuuugaggauuaaauuauauauuuauaaagucaggugucagugcuaguuuaaaagucaaucugacaucuuuuauggaaagguaagguucaauuucacaaaaaaaaaguguauuuuuaguguauuuuuauuaaagaaggauauaauacagaauuaaucuaauauaauauuacaauucccauuacuauuacuguaaauuuauuuuugcaaaguagcauagccuuaaaagaugaugacuagcuuaagaucuuuaggaaauaauuaguagacauagucaugaaagguacuagaggcuaucuuuagggcccagauuuucauauauuuuuugaauuauauaaacugcuaguuuugauauuuuccaugacaagccuuaauauuucauuuagagcacacauaauauguggauuauaagugaccgaucaagauauuaaaguaucuuaaauugauugauuuucauuaucauuuugagcaucuagacuaucucaaucuuugagcaaaguuguagauauuauuuagggauuuagauuuuuuuaaaaacaaaaccaaaaaacugcuuugcaaguaaguuuuuuguucaguucucaguaaauagcaauuucuaucccaucaaauuccaucauguugcugcaaagaagaguagagcuuccagcaucccuuuguguuacacguggggagagacaggauaucugaauauauacuuauggaaugagcauguaaaugugcuuuuagucuuuucacguguguguguguguauaggcaugaccaugcauuugggcauacuuuccugugugcucuggcugcuuaaauuuuacuaugauuuuacagccagaaguuuuuucuucucuguaauguguagaauguguagaaaaugaaagccuugcuuuuuuuaaaauaauauacagcagaucuucauuuuuagcacuacuuaaacuuauaaaagaaaaacaggauuuuuuuuguacuucagcuuuuuguuguguguacccaaaguuagauucaauaauccaauuaugagcgaaaauacuuaaaauugcuaauaggcgcuuuguacuuuauuaguuacuaggaauaugaaauaaaaugugaaucaugggcuaaugauuugccaaagaaagaugcaugaauuauauuuuuuguguuuuguuuuaguuuaagucaaguaaauagcuauaagucuagcaauuccgaauuugaauugauuaauguuacauuucuuuggcgccugcuguuuuuaucucaggguggauuauuuuuucagaguugaggaguugaccucuuuuguuuguagaagaaaggaguguuuuuuaaaaaaugcaaaaacauuaguaggccaacauuguauguguaauuuuagguugguuugguuuuguguguuuucucuggggguggugugugugugugugcguguguguguguguauguguguuuacuaaagacuuucuuagaacagguaguauaguucacauaaacuuuuauaauaauaaagugagagcguccuauauggaauaauaaagugaaguauuuaaaauuauaagaaaaaacuacuuuaaaaaaguaauaccaggaauaaauuauagccaguugugaauugcuagagauacugauuuaucaugcucauuuauaaagcuguucuauuuauagcaucauuugcuuuuaggaaagaucucauucagguuuuuucuaauuaauaaaaacagauugaaagcaugcuuuugaauuauauccaaaauauucaucauacauauuuuauaagauaaccuauuaaaaaauaagaaagaauccauucuuuuucacaaaauuauuuuuuauuauaugccaaaggaagagggaucguuuaacuuauuuucuucuuucuaaaaauuauacugauuuuguaacuuuuagaauauuacaguuuuuuaauauuaacauuuaaaauaucuugagguuauauuuaucugauuaaauaaacuacauuguucugagaaaccaaaagaaagaaaaggcaaauaacacugggauauacuugcguggaaucauuuuugcauuccuguucacccaggcuuuuuucugcauuugaauacuaguuuuugcuggucucgcauagaaacuauaaauggaaucuucagugcaucauaacagugaggucacaguggccuuggaaaucucugcucuuaccuguaacuuuuuaaagcauaacucuuacuguuucuaccauuuuuacucuauuacaauaacagaaugcaaagggucauaaaggagaugauuuguugcugcgggugguauuuaaaaucugaauguuuuaaauuugauggagcaauggggaauggagcaaacuguaaagcugcucuaguuaaucaaagguaggaagauauaauagugcuuuguauugguuggugugguauaugagaguuauuuuguugauuggauaaggaguaucuuaauucagggugaguuauuuuuuugagguucaagucuuuaaaaaaguaucugaguugaguacuuuauaaaagaaauguaaugaucaaccacauaucucauaaauaggccuaaaguacucuuuauuauaaauauguuguaauauaauuggcugcauuaugaaaauuuuuuuucuuccagugugaaaaacucaaauuacugucuuccaucauauaccgcuuauaagaacuaugauuauucggaaccuggaagaaacaaugaacagccaggccucuguggccuaaguaacuugggaaauacguguuucaugaacucagcuauucagguaggucuuuguaaacaaaaugaaacucauguuucauggaaaucuguaauacaagaagauaaaguuggguuuuucaugccagaacaugaguauauguuuugaaaguucauuuuucauggaagauuuaagcauacauauuugacuuauucauucuacuacugguaguggaauauauguuucucaauuaggugaccugugauugauuaacauaauguacaagauuauauaucacuuugcaaaaauauaauaucagacagaaaacuuaagcugucuaaaaagggagggaaaaaaaagcaaaacuaaugaguucccuccauuauucaguagaagucuguugcacuuuuuuuuucuuuuuuuuuuuuuuuugucuuaaugggaaauuaaaauuuuaaaaaggaaaaucuugggaacuucuuuuuguauacauacuuuaacaaaucacuuucccuuaaaggucuuuuaauuuggggauauaagagauaacuacuuuuccccugcccccacccccuuuuucuuuucuuucugcucuagucuauauccucaacuuguuaaauauuuaugucuuugauugauucugaaguaaugagagagauauauuuuuuaauaucacuguuacuguguauaaacuuagggcugguuauuuuauuccccuuuuacagauaaaauuucuguguuuauaaaagcucagaauaauggcaaaccauuuuugauauuugaauuuuaaccuuuuuuucgucagucucuugugaauucuggauuuuuaguuuuaaaucuaaacuuuucuguucucuauucuuauuuuuuuguugaaucuccuaugcccaggaggcagccucaaaagauauagauuaaaugcaggguauagauugauaaggacauuauuagacaucuuucucacuaucugagaaaaggaugacucuucaccauucaguauucuaagugaaucuuuuuguacaucaucauucauacagcuguuuccuaaauuaaccauugccuuuauagcauucuuggaaauuagaaucugucauacacuauaggccaggaguuagcauccuuuuagaaauugaauagggaaggcauaaucgauuucugguauuuugcuuuagaguugaaccacuugggaaguggccuaucugccuaagcagauagguuaauauauagguuaauaaacucuuccuuuaaaucuucaaaugaguaauccugcucauaguauagugugaauuacuuuauucaaaauaguuuuucaagaauucuagcacuaguuagacauagagacaauuuaaauuuuuaucuuuauuuuucuagaugaggaagaaagccaaaauguauuauuauccuaauaguuaaauaacaaaguaaaguacaugggugcuuagcuuucagagauaggaaugggacagacaaauuauaauaucuguuggaccaucucuggaacauguuuuauguaaauuguguuuauaccaguacuagaaaacccuguucucagaucaccaaguuauauuaauuuuuauguaccucuuuauccuugaacugccaaaauuacuuugguuccagaugcuugauaucagcuagaguuuuuuuuccuaguuuagaaaaccaaucuuggugcuuuuucauaaauauuaauaaaauauuucaacaacauagggauucaaaauuugaaucugucaggagagcacaagaguuuguguugaugcuaaucauucaugggaggcuugggccagcauucagacuaaauuccuucuaaagcaauacugcauccuaguuuucugugccuuugauacaucuguuuaguauugucugcauaugguuaacugcaauuucucagaaauagguauucaaauugaaucuuuuaaccagcuagguuaagcuagauuuggcaucguuuagcuuucuugcauguuauguuuaaggugugaggaucuucaguuuauucauuuuugcuucuauucaaaacuauuuuauuagaauaaauugauagcucuauugcagacacuccuaauauauuuuaccaucacguauuccauuucaucugagacacagccgugagcgugaugguuuauaauuuuaugguaauagccauaaaauuuuuugacaaaaauuuuagcagugaguauuuuaagcaguggauauuauuucaucauuauagcuuuauuuaguuggaaacuauauugucucuaaaauaaaauucuucaaacaauuuggagaagagaaaaaugaguuuuuacuugugcggcuuuagcuuuuaguucacaucuggaauuagaaaagcuaggccuuuaguuuuauuuucuuaaaacuuccaugauuuuuaauugauuaagaugucagcucucgagcugaaaauugacuguaagagggaguacaaaaugguggcaguagccuuuacuccucuauuucacaaaaauucauguaguucauagauccaaaaauaaaaaggguaauagauaacuaauagaauagauucuuuagguuuugucagauacuauuucuucaguaugcuuuuuucaaguuuccuuguaacuucuuugaaauugaagacguucaugaauuuuagaaaauauuaucaaauauuaucucuacugacaauuugaauuuuaauguaaccucuuaaauuaauucaguguccuccaaauuuaagugaucauuucagcacaucaggugguauaguauuaacauauguuaaaaaaaaaagaguguaaaaaguauacuuuuuuaauguaagcguggguuauacuuagcccaucaguagccuugagauagugaaaucuuuugaccacacaugauuaaaaacuaagcagcaccaaucugagugugauuuaacauuauuacuguuauuauuuaauuuaaugauauugguacuuaagauuuucugauguaaugguaugaguauuaaccuuguuuggugaauaugguacugccauauagcacaguaaaaaauaacaauacaacaguuuguccaggcauggugacucaugccuguaaucccagcacuuugggaggccaaggcgaguggaucaccugaagucaggaguuugagaccagccuggccaacaugaugaaagcucaucucuacuaaaaaauacaaaaauuagccgggcaugaugguggacaccuguaauccaagcuacucgggaggcuaaggcaggagaaucgcuugaacccgggaggcagagguugcagugagccaagauuacaccauuacacuccagccugggugacaagagcaaaacuccaucucaaaaauaaauaaauaaaugacaauuuaaaauaaugugaauuuuaaaacaaugcaguauaacaauuaacauagcauuuacauuuuauuaaguauuauaacaaaucuagagaugauuuaaaguauaugugaagauauauguagguuauauacaaauaacaacaccauuuuauaucaagaacuugagcaucuguggauuuugguauccccaagguggagagggggcuccugugaccaauccccuguggauaccaagaacaacuguauauccugaccuuaugaagauuauagccuagauauugugauuuucaaacucuuuguauuuuagcaucaaaacuuuuuuuuaaguuaccguggaaaguuuaauuguauccccaauauuuaaguagauaugguaaaauugcuuugguugggugaaguucccagaaccccaucugcuuuccuuuacuuuccacaauggccccagaagcuuucucauggaucccaggacucugaggaacaguuugaaagccaaagucuggcuugaaaaaaaaaaaaaaaaagaaacacauaaaaaacuaauaauacagauuaagaucacaguuuauggaguuacacuacuuggauuaaaaacauggccuuccugcuuauuauaauaacuguauuucccuagacaaguuaauuccacaauucauuuuucucaucgucugacaagaaaauaauaguacccuaucuuaggaguuuuguaaggguuacgugaguugaugguuuuaacucguaggaugcugacuggcacauuauaaauacugaauacauauuauguagaaauuaucucaucuuuuuuuaaaauucaacaaguuaagcagaaugacucuggaaagauucuguucuccauaaccguucuaucuguccucuuuucuugagucuuuuuccacguggaccuuaguggacuaagaagaaauaauugaguguacuuuuauuuuucauauaguguuauuguaggaaugguauuuaucaacccuuuaauuucugaacuaugcuaauuuaacucuuccuaggcaagcugauaaggaagggauauaauagcauagaauuguuuaugaauauucuaucuguagggcacuaggaaauucaaaauuguugaguuugguuaccccuagccccugccuccugaguaguuaugauuauaggcauauaccaccaugucccauugguucaaauaauauaauaagauaguuuucuaguucccuaaaucuguuacuccaucuagagaaugcccaguuuuuaaauuuugcauuauuggugauaauuuuaauuagcauuaguucaguagauucaagagcacuucaacccuugucuuuuucauugucaaggccuaccuaggaggcucaugguuaguuuccuggaugaagcaucuccucagauggauuugaagcaggggaguaauguggucuuuuccauuggaaagcagcauggcauaagaugguuauuuucaaaauauuuacuuggacauaauagagcuccuuagauagauucuaggaagucauugaaaaaaaugauacuaaucaaagacuuauucauuauuccugucauaauauauaaaauaaauugggauuucaagcauuuuuaaggucagcuuuuuuuucuaugaucuguuuauuaggaaaaaacuuaauuucaaaaauuuagaagaauguuaaauagaaaguuuaaacuuuuuuaaagauuuaauuuaagagaauaaguaauacuacacagaaauaacauuuuuaagaaacuagauagaucuucauuacauuguaaaacagagaaaaaguuauuucugaagcuguuauuucuauguuacauuacuucaacuagccuacucuuaccuugagacuuucuuuuugcauuuauuggaacucaguuucuuagaaguccaguuuaacacuaaaccuucuaguuuuauuuaaauuaccaaccuuauauuuaaaugaauauacuuuucaucguaaaaggaaaaaccucacuucugagacacaaaacacuuuuuaaaaaauaguuuaggaucuuauauuuguucugauaaacugagaacguggcuaaugaaaaauuuaaaacuacuacuuucuaggucagguuuucauccuaauccaggauguuaaacucaauuaugugaguuccuuucauguuaugugccagaaauuacauagcaaauugucaucaaaaauauauucaauccucugucaaaugacaacucagucaggucaucuauccauuuugauaaaagcaaaaaaaaaaaauguaaacaaccuuacuugcauuagaaccauucauuuuucucaacaugaauaccaauguuuuuacuuuucccuuuggacuagaauagcccuuccuuuuugaaagagaacagaggugggaaagaagaaccuacguucucagacagauuauuuuaagaaagaguauauaugggauaguucuguaaaaauuuaguguucacaacuaggggaaaaaugguaucucuaaaagaaugccuugcacuuguguaacuuggcuaauaaugauuuguuaugaaaacaugccuuucuuaaucucagauggagacaugagauuugauuugucgcuguucacauucuucucagugaauaagcaaaauucccuaagauuagugccucuuucugaauuaaguuuuuauguguuuaucugucccuaauucuguaguaggaaaaugacauaauagagaucuuagagaaauagagagguucuuuuaaagaguuguaaauuauuacaucuaauucuaaaauacaaagugguuuuacuauccuggcuaggaaaggccaacaccaauuuaauaauauacuuauuagauaguauuguagugacuacaucuuauaacagaaguuauuaauguaauuaggcugaaguaucuuguaucaauuauuauaauuauuucaaggauuuuuuuuguaauuaaaagcaaaacaaaagaaaugucaaucuguagucuguaaugggaacuacagauuugcucccucccuccaagaaaauaaaaggaaagaaaaaccuauuucagauuuacuucucuuacuuaaaaucaagcagcucauuuuuuugaugucaaaauguuuucuaaaaguuuaccauuuacuucuuuacaaugauuuauaaacuauucugggcaggggagagggucagugaguugguuacuuaaaccauuguucgauuaauaguaauaucuaaaucaauuacuaguucucauauaaacccauauuaaaacauuaacagcccuguauugaaccugcagccucuguuaagagugguacccuucuuugcauaaugcagguuauuuuuuuauauuguuuuucacuuaauuuucucuucacagaggucugugaguuagggcauaagaaucucuauuccacuaaugaggaaauugaagcaaggaaaguuugauuuccagucacuaagacaaguuauuaugaguuguuauucaguacauuuugagauaauguauuuuuuugaaauuaugccaaucaaccuauaagaaaugcuuauguuuuguuuuuugugguaaaauauaacaauuugccaguuuaaccauuuuaaguguauaguaacauuaaguauauucacauguuguacaauuauuaaaaauguuuuuauguuuaguucaaaugauuggcccccauaauacaagaugcucucauuaaguagcauuaauguugugccauuuaaaacaguuucccuaggaggugauauacacacuuacucauucaauguucagaauguuaaaaacuauucaaguacuccuuuuggaauugcuuuuauucuucugaguaucacugguggauauuuuucauccuucaaugacaaaguugauuuuugaaagccagaaguuauucagagcacuauuuucagaauauuguagauuaucaagcuggguaauuuuuuucaaguaauucauaaguaaugaaugacugaugaagucauuuacucagcaaauauuuauugaaggucuauuaggugacucucacucucauaaucacuaauuaugccaugaugaacaaaacaguuuuuucccauggaguuuacagucuaaugagggagacaaauauuaaaucaaucaugaauuaugauaaguaucaugaaagagaaaguagagugcuaacaggaacuuggagagcaccuguuuuaagcugggugucauauuuacgaaaaguaacaugagcuuugaccaaagaauauguaugaguuuggcaggugaaguuagaaggaccaaaaacaugugcaaagccacuaagaagggcaaguuugaggaaucagaaguguaguuuguggaauaauguaugaaggggagugagacaaaaugaguuugaaggaguaggcaaaagccagaucauauagggagaauuuagauuuuaauguuacaaaggcacuaaagguuucaggcuacuaucuucuuaacugguucauuccauuugucugcuagcugguuucuuugcuucuauccuuacccuccacaaucuguucuuaaaagaacagccagcaauucguuucaaaccuaaggcauuuucuauuacuuaggcaauaacacaaaaugccuucucauuucacucaacgaucaaugaaagccagaguccuuaaaaaaaaguacaaagcccuguaggaucuggccccaugcuagcuuauuuccuaucacuuaccuccaugcuuaccuuguuccauccucacccucacaugugccaagagcgugccugccuuagggucugugaacuugcaguuuccuauaccuguaauguucuuccucuaaauauauauauucuugcacucucacuuccauuaggucgcuauuaucuaucagugaggugcuucuucagucacccuguaaaaaauaaugacugccccacauuccacacaguacucauaaccaucuggcauguuuuauuucuauuaggguuuuuugcuugucuguguaucuuccccuacucccaacacagacacccucuccccgcguccccaccccgugcucucucucucccucucucccucucucccaugacugcuggaauuuuguuuuagucacuguuguagccccauugccuggaauagugucuggcauguagaaggcacucaaauuaaugaaaggugaagggaaucacaagugucucucuaguuuuuggcuuauauaucauaaugauagauguaaccauuuaaugaaauuccagaguaguaggaagaagaacauaguaggagaaguaaauuugggguggggaggagauuaugaguuaauuuuaggcauguucaguuugugaugucugugaaacauccaagcagauagaucauagacaguuggauauucuaguauggaauguagaucagaggccuaagcuggaaauaaaaaucugcgugucguagguggugguuaaaaucauggaaaugguuguuucuaaaugaggguaucuaugaaaaagacguccgagaacuaagcccugcaauacauuugaauggaggaaugagacuucguuugcaauaggaggaaagaaagggauuacggaugcaagcaaugucuagauucucugacggcuuccauuauccccaaaauacaagacuagaucauuagcuaagaaugaaaggguaagaagauugcucagcaguauugaggucucauuugauauuggagaucaucaauucagaauaguauaaauguauucacuugaaauuuuuuuccaacaauguucaguugcauggugcauaaaacagaugccuagauucaucuagaguuggaaagagaaaggggcaaaggaguuauuaauaaaaagcaaccaaacuuguuuucuuguuuguauuuauuuauuuauuuagugaauggaauuauuuuuuuaauuuuucuuuuuuaucauauuauuauacuuuaaguucugggguacaugugcgcaaaaugcaguuuuguuacaaagguauacacgugccaaggugguuugcuguacucaucaaccugucaccuucauuagguauuuauccuaaugcuaucccuucucuagccccccaacccccaacaagcccuggugugugaugucccccucccuguguccauguguucucauuuuucaacucccacuuaugagugagaacaugcaguguuugauuuucuguugugauaguuugcugagaaugaugguuuccagcuucauccaugucccugcaaaggacaugaacucauccuuuuuuauggcugcauaauauaccaugguguauaugugccacuuuuuuuuaugcagucugucauugauggacauuuggguugguuccaagacuuugcuauugugaaaagugccgcaguaaguguaugugugcaugugucuuuuuaaucaaauaauuuauaauccuuuggguauauacccaguaaugggauugcugggucaaaugguauuucuaguucuagauccuugaggaauugccacacugucuuccacagugguugaacuaauuuacacucccaccaacaguguaaaagcauuccuauuucuccacauccuuuccagcaucuguuguuuccugacuaaugaucgccauucuaacugguauaugagaugguaucucauugugauuuugauuugcauuucucuaaugaccagugaugaagagcuuuuuuucauauguuuguuggcugcauaagugucuucgaguagugucuguucauauccuuugcccacuuuuugaugggguuguuuguuuuuuucuuguaaauuuguuuaaguucuuuguagauucuggauauuagcccuuugucagauggauagauugcaaaaauuuucucccauucuguagguugccuguucacgcucaugguaguuucuuuuccugugcagaagcuuuuuaguuuaauuagaucccauuugucaauuuugacuuuuguugccauugcuuuugguguuuuagacaugaagucuuugcucaugccuguguccugaaugguauugccuagguuuucuucuaggauuuuugugguuuuaggucuuacauuuaagucuuuaauccaucuugaauugauuuuuguauaaguuguaaggaagggguccaguuucuguuuucugcauguggcuagccaguuuucccaacaacauuuauuaaauagagaauccuuuccccguugcuuguuugugucagguuugucaaagaucagauugauguaaaugugugguguuauuucugaugccucuguucuguugcauuggucuauauaucuguuuugguaccaguaccaugcuguuuuggcuacuguagccuuguaguauaguuucaagucagguaacaugaugccuucagcuuuguucucuuugcuuaggauugucuuggcuaugccggcucuuuucugguuccauaugaaguuuaaaguaguuuuuuccaauucugugaagaaagucaguguagcuugauggggauagcauugaaaguaaaucacuuugggaagcauggccauuuucacaguauugauucuuccuauccaugagcauggaauguuuuuccauuuguuuguguccucucuuauuuccuugagcagugguuuguaguucuccuugaagagguccuucacaucccuuguaagugguauucguagguauuuuauucccuuaguagcaauugugaauggaagugcacucaugauuuggcucucuguuuaucuguuauugguauauaggaaugcuugugauuuuugcacauugauuuuguauccugagacuuugcugaaguugcuuaucagguuaaggagauuuagggcugagacgaugggguuuucuaaauauacaaucaugccaucugccaacagagacaauuugacuuccucuuuuccuguuugaauacccuuuauuucuuucucuugccuaguugcccuggccagaacuuccaauaauauguugaauaggaguggugagagagggcaucccugucuugugccaguuuucaaaggaaugcuuccaguuuuugcccauucaguaugauauuggcuguggguuugucauaaauagcucuuauuauuuugagaugcauuccaucaauaccuaguuuauugagaguuuuuagcaugaaaggguguugaauuuugucgaaggccuuuucugcaucuauugagauauucaugugguuuuugucauugguucuguuuacgugauggauuacuuuuauugauuugcauauguugaaccagccuugcaucccagggaugaagccgacuuaaucaugguggauaagcuuuuugauguggugcuggauucgguuugccaguauuuucuugaggauuuucacgucgauguucaucagggauauuggccugaaauuuucuuuuuuuguugugucucugccagguuuugguaucaggaugaugccagccucauaaaaugaguuaggguggagucccucuuuuguauuguuuggaauaguuucagcugcucuuuguaccucugguagaauucggcuaugaauacaugugguccuggaauguuuuugguagguagacuauuaauuacugccuugauuucggaguuguuuuuuuguuuguuuguuuguuuuuuguuuuuuugagauggagucucacucugucgcccaggcuggagugcaguggcgugaucucagcucacugcaagcucugccucccagguucaugccauucuccugccucagccucccgaguagcugggacuccaggcgcccgccaccacaccuggauaauuguauuuuuuaguagagaugggguuucaccaguuagccaggauggucucgaucuccugaccucgugauccgccugccuuggccucccaaagaaauuucagacuuuuuuaugggccuauucagggauuugacuucuuccugguuuagucuugggagaguguauguguccaggaauuuauccauuucuuccagauuuucuagguguuuauaguauucucugaugguaguuuuuauuucuguggggucaguggugauaaccccuuuaucauuuuuuauugcgucuuuuugauucuucucucuuuucuucuuuauuagucuggcuagcagucugucuauuuuguuuaucuuuucuaaaaacuagcuccuagauuucauugauuuuuuugaaagguuuuucgugucucugucuccuucaguucugcucugaucuuaguuaucucuugucuucugcuaucuuuugaauuuguuugcucuugcuucucuaguucuuuuaauugugauguuagggugucaauuuuagaucuuuccugcuuucucuugugggcauuuagugcuauaaauuucccucuacacugcuuugaaugugucccagagauucugguacguuguaucuuuguucucauugguuucaaagaacaucuuuauuucugccuucauuucauuauuuacccaguagucauucaggagcagguuguucaguuuccauguaguugugcaguuuugagugaguuucuuaauccugaguucuaauuugauuuuacuguggucugagagacuguuuguuaugauuuccguucuuuugcauuugcugaggaguauuuuacuucuuauuauuuggucaauuuuagaauaaguacagugaggugccaagaagaauguauguuuuguugauuugggguggagaguucuguaaaugucuauuaggucugcuucguccagagcugaguucaagucccgaauauccuuguuaauuuucucucucauugaucugucuaauauuaacagugggguguuaaaaucuuccacuauuacugugugagagucuaagucucuuuguaggucucuaagaacuugcuuuaugaaucugggugcuccuguguugggugcauauauauuuaggauaguuaguucuucuugaugcauugauccuuuaccaguauguaaugcccuucuuugucucuuuugauccuuguugguuuaaaguauguuuuaucaaagauuacgcaaccccugcuuuuuuuucuugcuuuccauuugguugguaaauauucuuccauccuuuuauuuugagccuaugugugucuuugcacaugagaugggucuccugaauacagcacauucaugggucuugacucuuuauccaguuugccugugucuuuuaauugaggcauuuagcccauuuacauuuaaggugaauauuuguuaugugugaauuuguuccugucauuacgauaguaacugguuauuuugcccauugguugaugcuguuuuuucauagugucaauggucuuuacaauuugguauguuuuugcaguggcugguacugguuguucuuuccguguuuuuaguagcuaauuuauuuagcugacucaacaagcauucauugagucucuacuaugugccaugcauuauucuagacauuggcauacccaguuuuaaaagacaguacuuguccucuagaaguucauguuuagugaaugagguagacauauaaauaagauauaauauguuauauaauagaaaacaugaucagcaaaaugucauggaagcaaaguucuuucuuugagucuaugggacauaagugaggcuguaucaggagggugaaauuugagucacauuuuuauuucauuuauuagagcacauuacuguccauuauaacuuauauguucauuuggucauaaaauagagaauuaccagggaugcaaauuaaaacauuauagcuuaugcuaguuucuacauuuuuuucaccucagaaauucccguaucagaaauccguuuugccacagcaaaaacacauuguucacacacucaauaaaaacauauuggaauccuuuauaugccaacugguuuuuuuuuuuccugcuaccugauuuuuuuauuuuuucaugugccagcugucgaugcuuuuucacacaugugccagcucuaaaaagaggaguaccuaaaauaucuugagcaauauauaaugcuuauucuuaaugccucaauuauauaccggauuugguguauaccacauaaugcugcuucuguuauuuacuauauuugauacguaauugaggcauuaugaauaauuucuagggcuuuucuaagugcaguuuucuauacuuugccaggagaagacuucuaauaaguauuuuuaaaaugaaacaaauuugugacaaaaauguuacuuuuuuaaauaaggaaauccuuaauauuaauaguagaaugaaacauacauuuagcuuccuuuuauacuuacaguaguaucauuguauaauaacauaccaaaaauauaugugucaucaugaugauaccuggaaccccucuuaccaucccugagaccuguucccuuguuuacucuuuguuuuauucuucuuuuuuguuugguuuuuugagacggagucucgcuguaucaccaggcuggagugcaguagcgcaaucucagcuuacugcaaccucugccucccggguucaagcgauucuccugcuuuagccucccgaguagcugggaccacaagcgugcaccaccacucccggcuaauauuuguauuuuuaguagagacagggugaucugcccgucucggccucccaaagugcugggauuacaggcaugagccaccacgccuggccuuguuuuauacuuuuaaccucaccucuucacugucuuucuuccuuucagcguauauacauagucaagucuuuuuucaucugggaaguagagugagggagacccaugaccuugaacaggaugaucugugcuuucccccuacuuucccaucucccauucaauaguccuuaucucaccauagccugucagcugcuuagcaugguaggucaaagcauggauuuuggaacuagacugccuguauucaaauccuaauucugccacuuacaaguugugugaccuuggauaagaaacuucguaguuucuucaucugugaaaugaagauaaagugcuuaggaagugcuuggcacauguaaacauauaaaaauaucaaauacuguuaucauuacuguugucaugauaccacccuauagaaauugcuuuugauuagcucacucuugaccuccuguuugcuagguuccuuguacccccuuuaccuuugagaauuugacauccaucuauauacuaauauccaaaauuucccucauccguaauucucucuucugaauuucccuccaauauguaacuguuaaauggacauuccugccaaguuaaacuacauguaacuuaaacucaagaugccuacuuacacuaaucuugauuauuuuauuuccuacacuuucuuauagguacaacccaguaacccaagucaaaaaccgaagacuuaucccaaguccuguucauucuacuucuuauauagcacauauuuuucccuuuccucuccuguuacauuauuucaaugcuuaagcaucuuuuuugugaacuaucaaaauauaucugugucaucucuuuguuccaucauuuguccucuucaaauccauugaauacagugcuuccaaauuuauuguuuuauaaggcaaauaugauuauuauguguuuaaaaccugugccccaucaccuaaaggauaaaauucaaacuggauucugucuaccuguuuagccaaaacuacuuucaauucuuagaauuuauuauguuucaaaacucuuuguauauacuguuaccgcuucccuacuugcguuuuucauacuuucucucuuucuucuauccauuucucauggacaaauacguauuauguggugagaauugugaaagcagaggcuaucuuugguuuucuuuuauauccccaguguuaguauaguaccagauaaucguaagcacaguagaacaguguuuuuuacaaugugucuauggacaagauaauucuggucaacaauaaaauaagcacagaaauuguaagugaucaaaagucucuauagcaauuugauaggguaauuuuauaucaaguuuaauaauaaaaagcaagacuuguuuuuuauaugaguguuuuuaauuuuauuuuucuagcgguucauuuuuauuauaucuuacacaaguaccaaucugugguggaauuuuuaaaaaauuaguccuuuccauguaauuauugcacuuucacacccacaauaaagcuucuaccugaagugccuucuaggucauugagaaacauggaaaauuaucuuccauauagauuuagaggaaaguguauuuugcuguggagcuaaucauuugaaaacugggaauagcaucaggagguaaaaauagcucgagcggaaauauuuggguuuguauauuagcucugcaacuucuucugugugugugaguaagcagguuacuuaucuauuccaagacuuaguuucuucagcucuaaaacaggagauaacgcuuacuaaauuuacuuuucagagcuguugcaagaauuagugaaauguacaucaagauguauuuuaauaaaaauaauguguucgguauuuuaaaaaaaauuaguucuuucacacaccugguuugcaaaacacugcauuagaaaaaauuauuuaccagagauauuugaaacuugaccugagcuaucuaaauucccaaagauugcacaguaauuuuaguaagaauuauagcacauaauauauauauuuauuucuugcaacuggagggucagagagcuaccuauauauguauaauaacucuuggaccauauacgguccugcaaaugcagucgaucugauagcacuugaauugagcuggcauguuagucacagcugggcagaucauaucaguaccaccauggaaauaguuccuugaaagauuucagugaaugauaggaaaaaaauucuuuuagaacauuauuuguauacuuacagagacucuugaaguaaugaucucuuaauauuuguugaacaauuaaaguuuuuuuauuacaaaaauggcuuguuucucuuaaagaauguaacaaaucaauaaacuuuaaaaaaaaauucugcuguccuuuccuguaugccuuugcagaagaacuaagaucaguaaacucacacaauucuuaauauuuauuuauucaaaauuguuucuuuacugaauauuaugugcaagggacugaacacauacaaaauuauaaagaaccauuuuuucauaaauccuuugacugucuugcuugccuaaaaaguuaauucuuuuaaauuucauugugagucaguuuugaauuauuaaugggauaggaaauaacguaauuuaacauuaaaauugaauuccauucaauucuucuauuuaagcuuccauucuuuaaaauaaauauaacuuacaccaacauuucuuaauguuauuagaaccuucugguuuuagcauacuucccauaaagugaauauaugaaaaaguuuuaaaauucacgaauagccuguuacuaaaaauaaaauaaugaagucagacaacugcugacauaaucuaguauuaauaguuucaaaaccuuauuuaaaaacaacuuguccuagucuucuagccuuuuugcuggugaaauaauuaucacagagacuuccacuuuuaucugugucauaagugaauccucuauccauauuuuuuuuggcuuucaauaugaaaauuaauggucuucacauaaucauggcuuuuuuaacauugacaucuguaguuacagaauuuacucacugcaaguaauaggguagucuuuuugacaaacuuagaguuuuccuuccuugguccuguguagaugagggcaaaaaaggauugacauuucuuugcuagccaacaaaauguuucccaucagugucaguauuuauacuuccuagaacuuugauaauucuucauugaauucaaauaguaugugaagaagaaauaccauagaauuucaaagaagggacaacaguggggacuuuaaaugaaguuuaauuuuauucaugucuuaagcacagggaccagauuaaugauauauauucaaguguuaggacaacauccuuguccaguucaaaaaccuugccuuuaaaacuaccuuuauuuaacauuuuaauauuuuaaguagaguaugcuaguucucucuucacugacgggggaaaaaaagcaguuaaaagucuuaaaaauauaagaggaaaauuauauccauuucuauuuuacuugccuaaguuuguucuuuuuuuaaaguugaagaaaaauggagauauaaaguaaaacagagcuguagcuguauugcugucacaaaauaugugaucuucagaauugaucucucaaauuuaaugagauuucccuuucuuagaaaaaauauaacaaaaauaagaacaucaagugacuuaaaauauaucauuuuaaaaaucugcuugaugaagaaacaggccuauauuuguaguuuuuaauugaaaaaguuuaccucaaacuuugcuguguuauccacuuguguagcauuacagaacuagagccaauaucccaauauuaguagauugcuuuggaaucauacaguaccuuuucagaaugcuuauacuauugucaugauuaauuagaaaacaauugacauggcgaauaugaaaauucuuuuccaucuaaccuuaaaauccagaaaaaaacuguuuaaagguauuccaagaugacuuuaaccauggauuacuucaaguuuuauuuuuuaaaucauaacaaacuaagaaugaaucccuuauuuuauuuagaaugggcuuuuauuuuuaguacuggucaguuagaagguauagccauuuuuuuaaggguugugagugguauuaccuuuugauuaguuauagaaugaguuacacaacucaaaagcuuuagguaaucaaaaauuaaguuuguuuucuuuccuguucuaguuaccgguuuacuaaaauagugagcauacaugaucacuugagaauugggcuucuggagcaccugaacagaaagggagugguucauauucagcauuacaaaagacaacuuucucuuuuugaaggggauuacuuuggcuauuuuccagguacuggggaaauuccaaaugcauuacaaguuauugggauggcuauuaauuauucauuuccuaaaauauguugacugaagacuugagauuugguuauauaauagaacauuauuugacuucaucaauuuauaaaaaacuuauguagaaauuuagcaaaauacaaaauugagacucuuacaugcagcaguuauauuuuuucagauaacucuagaaacaucaggcuuauuagucagaacauacuuaguagaaguacuuucugaaaauaauggaagagcaauagaauuugugcauguguauauaaagaaaaguuaugugcaaugcauugcaucuuuccaaguaauuacauaacaaaagaaaaucauauuuugcauaauauuucaguuuuaggauauuagguuaaggaaggguauuuauaacuagagaguuuuuaauagagaauuaguacuuuaauaaagaaugcauaaaccauucaaauauuuuuauaaauaauucuucaagguguaauuaauggccugaauauauugaaccauaucacagaguguccauuggaugagacauuugauuauuuagaauaauucuucuuuagaauuuuuaugucugcuucgagguugaagauuuaggggaaaugaucuucauaaaaauauauuuccaaacauauuuccuuugcauaccuuuuccuuacggauuuaucuugauaguuguuggggaaaucauaaggguuauuuuccuucauuaggaaaaccucuuuaggcaucauuuggacuuuuauuuuugaacauggagaacuuugggcugcauuugaauuauaacagagugcaauucagaucucauuuuagucaaguuuuuucucacugcucuaagucucucuaaggacuacuucuaaucuuucuacuauacaaguucccauucauuccacauaccuguuugagugugcccgauauugugauagacccugagguacaagggugaauaagacauagacucugcucucaagugcgguguaacggaguucgagguaucaaguuagcccagagaaaggaauauucguucuuccuugauacacagaggaagauacgacauuuagaagagauguugaaauaaguguuuaagaauaaauaggaauuucuuauaggggaugaauauucuaagaaaggcaagagugcaugcagucucaauacauuaaacuaaggaauaugucuuaagacgccuaauucaaauucgaguacucuuauuacuugcaguuucccauauaaaauauauaugaaggcacaaguagagaaccacaaagccaguucaaaaccacaaaaccacuuagcagucauuucucacuaaauaauugucuugcacauacaauagccauuguuaccuuuccuuguggaucagcuuuucauaauagcucauguccuaaacuuuccaacagucauuauaucauagugaauuccaaaagucuaccauauauuaaauaugaaauuuaguuuuuuaaucauuacucauggaucaacuuuucauaauagcucauguccuaaacuuuccaaccagucauuauaucaugguuagugagcuccaaaagucuaccauauacuaaauaugaaauuuaguuuuuuaauccuuaaauuuucaaaugcuguugucaguuuugugugcuaauaacuuacauaggagcauuugaaaauauuuaaauauaaaaauaaccuaguuaauaaguacauuuacuuguuaauauaaauuuuuuucuuuuucucuuuuucauuaaaaauuggaacuauuaguacaaagucuuuuucuuuagucuggcuauugcuuuauuuuuaacauauuuaaauucuacccaauuuuaggaccaacaguagguaccauuaugauauaaacaaaaauguggcuuaagaaauauguuuuaugaucagucacauagccucauauuuggaccuuguuauauuagugauaaauuuuaagaucuaguucuccugaaacacugaaguuuuggcauuuguuaaugucaggcaguugaacuccaauaaauuaacaggggcauagcuccaaauggcaugagacugguagacaugucacaaaacuuauaaguagccacaaaaauaacauacuaacuaauacuguuuauauaaucucuuucauuugucaugauacauucauauauauucucaguuuuuauuaagaacaaccauggcuguugcagaaaguuuuguccuguuuaacaguccaggaagcauugagaguaagagauauucacguaggcacaacacauauccgauuuuuaguccauauuauaaugcaucacucaguaaagugucuuacaggauaaaagggaaguuuucuacugcuaccuacacauggaagauuuuuaaaacauauaugucuuuaagaaaagaauuguuuugggauagucucaucugauaggaaaaugauuuuuuuauaguagaagaaucuucgagauagauacuucagaacugauuauuauuuuaauuaccuuauaaaaauuauacauuuuuaauuuuauguauuuuuaauuuuuauggguacauaguagguguauacauuuaggggguacaugagguauuuugauaaaggaauucaauguauaauaaucacaucaggguaaauuagguauccaucacuucaagcauuuaucccuccuucauguuucaaauaauccaauuaugcucuuuuaguuauuuuuaaauguacaauaaauuauuguugacugaaaauuaucuuuguucauuaaaacaugguauuuaauugcagccaguccaaguaacuaguguucuuauaauugucaaaaauguucauguucuaagauagccucaugugaaaauguuaaauaaugaauugcauaaaguaauuacuaaucaaacuacauuaugaccaacuuuaagaaacuggcuucagccaggugcgguggcucacgccuguaauccuagcacuuugagaggccaaggugggcagaucacuugaggucaggaguucaagaccagccuggccaacauggugaaaccccgucuccacuaaaaauacaaaaauuagccaggcaugguggcacgugccuguaaucccagcuacuugggaggcugaggcaggagaauuucuugaaccugggaggcagagauugcagugagcugagaucacgccauugugcucugcacuccagccuggacaacaaagugagauuccaucuccaaaaaaaaaaagaaaccggcuucuuuuuucugccagaaugaugacauugaauacugauauaacaucacguggggcguggcaauauuuuuaauugcuugauuuuuuuuuccauuuaugccuugaaauuuagcaaaaauuaugagaacuuuuaauauuuuaaccggucuuuaugcuauuuuaagaacauacuaacucaaggucuggugcaguggcucaugacuguaaucccagcacuuugggaagccaaggcgggcagaucaccugaggucaggaguuugagaccagccuggccaacauggcgaaaccccaacucuacaaaaaauacaaaaauuagccaggugcgguggugggcgccuauaaucccagcuacuggggaggcucaggcaggagaaucgcuugaacucgggagguggagguugcagugagccaagauugugccacugcacuccagccugggugacagagugagacuccaucucagaacaaaaaauaaaaugaacauauugacuccuaaugguauuuucaagaugaggguggaaaggaugguauuuuuaugagggagaaauaucggacaucaucuuaguuuuuaaacuaauaugauuuguguauuaguagaacaauuauauugacuauugaauuuauguauuuauauguguuuauacaacuuguuaggaaguguagcuuguuagaauauauguuuaacaaauagaauguuuauuugggcccauuuaggacuaaauagcuuaaauuuaaauauugguuaugauaucuucacagauaacacaggcaaauuaucauuaaaaugauuuguguuuuguuguuauuuguuaacauugaauuauaaucaguuugaaaccagcauguaucacugugaaaauaaaugcuggucucuguuucaaggaguuuuuaaaaaucaaagcagaggaucauuuacaaagcagauaguagauugaaugaaaaaucagacaaaggggcagaaaaauuuguacugcccguaugguuuaguauuagguagaaguacuugaagauauuuuugagauuauucuuuagaaauauauuuuuccuccauuuaguaaguaguauuucauucaacaaaaauuuauugaacccucuaugccaaacauugaaggaaaagaguaaaaaucaagaggauaaaugcauuaguaaauacaggcaaaaauauuuuuaguaagcauacauuuauugugaacaugaucagugcuacgugacauagugcucagugcuggaaauauaaauaagaauacccugguaccugcuuucauggaggucucaguucauuuggcaaaacaaacuaaaaauuaaaguuacaguauauuaucaaauaagugcuguaauaaaaguaagcaguaagcauuaaggaaacauacaggagaaaacacuguaaggaaaucuaagggaggcuucccagauaggaugccagaaucuugauggauuuauagaaguuaguaaggccaaaaaaaaaaaaaaaguacauuuccaaguagaugaaguaauguugcagacuuucagauugagagaguauguggaggaaugacuaauuaaauaaagcuggaacaguugaaaagaaaaggguauugacaaaggaugaggcuacauagaugagcaaaagacagacccuucuaagaauuugggcuuccaaucuguaagcagggagagccguuaaaggauuuauagcaaggaagcaacaugaugagauguacauuuuagggagagcacucuggauacuacuggaaagcuaaaaaauguucaguuauaccuuuaagcucuuuccaagauaagaguauaugugaauaauuaaguuauaacaaaguuuaagaauuacucagguuugugcaacuugguucuuuugagauauuuguaaauuagguucuuuauauaauugcauuaacagacaauaauggaauguuacauucuuagcauaacccugagcugaucaaauauaagaagcggaaaacuauugauaauuguuggaaauuccuaucugaccuguccuuugucugacuauuuaauguugaucuuauuuuguacuaaaucagaugauacuaagugauggcauuuacccucuguguagcuaugaugcauucuaaauugccuggaucucccuuuagugcuggguuuauaauuaaaaggacauauaauacaaaggaagaagagaaacugaaacucaaaaggaguauaagauuaugagagagguugagaucuaagagguaaaaaguuagggaagcauccuuucucuuaauugccuccuacacuguagcauaccucucuuucuccugcucacauauauuaaaaaguucuacugcugaaaauauguauaugacucuaaaggccuauauagcucacuccaaacauuuuagcuguuuuuauuauuuucguugccuaagaauuauauaaucguaaauuccaugauauuauaaccaguugucccuuuugccuugagguaggggccaggcuagcaauuuauaauaaauaauauuauuuuuauuauauagaaaguuucuaaauagauauuauugacuacuucaguaaacauguugauuuauaauugaaaccacaaaauugaguaccagaauuauucuaaaaaacuaaguaaauguugacucugcuuauuuuggaauuuuagcuaaacaaugcauaguauauagucguaguuuauggcauguaaguuaucugugugaauucaacaggcugaaccuuucauagcuaccaaaccugucuaacuuaauacaaaugacuauaagcaagcuucgaaaaacucugauuuccauuaaugugaauccaggcucucauaagagugaguuucuacuauuuuccaugcaagcaacuagcuuccuugcagcacuuugccacuuaauuccaacacaaauaucauccuacagcaaaaaaaauuuacuuaugugaccauaugucuguguuagucguugcauauuauagacaucuaauugauaauguaauacuggguuuguauugaggucaaauuauauggaucaucaccuuaaaauuauuccaacuugagauaaaauguugaaaaauuguacgucugccauguuuuauuuuaaauaugaaauuuuuuaauucggaauuggaaagaguuggaaaauuaacuuauuuauaguuuuuauuuugccauaaaggaaaauuguaucguuuaugaaauuaaagagcuggaagugagaacacacuuaccagaguucacauacuaaaguuuguucucucaggcucaaguaaucuguacugucucuucuaaaaaugguugaccauauggaagguuuaaaggcugcucuuucaugauaaauaauugacaauggaagcaguaaauaccucuauuaaguuaauuucuugcuugcacucuaucucaguuuuuaccuacucaggcuaauuugcaggugccugggaugaguagacaauccauaauuucuaccaaucaaguaaaagaaggaaagaaaacugagcuucucucccaguuaccagguaguuugcugugguuaaaauuaaugcagauuuuacagcagcggauauuagcauuuuuauuuauuauaaguaauuauuuugaaauuugggaaaugaauaguugaguacaucauuugaguguuuauuugaccaguuauuagugcaagaaaccaucauuuaaauguucucuguguuauagcaaaucaauuuguuucucucuucauauuaauguguuuuaagaaaaauucauuaugauuacuuuuacuugaaaauauauuuuauuuuuugcaguguuugagcaacacaccuccacuuacugaguauuuccucaaugauaaguaucaagaagaacugaauuuugacaaucccuuaggaaugagaggugaaauagcuaaaucuuaugccgaacugaucaagcaaauguggucuggaaaguuuagcuacgucaccccaagagccuuuaagguuagugugguaaaugcauuuuagcaaggguaccugcaaggguacaaaaguugguucuuggggauagggggagugaaaaauaguagcuauuacaaugguuuguggcccuccaaaggaacacaguacauaaauagauauacaguacaucugugauauaaaauuuaggugggagggauauggaacaguuuaucuguuuuguuuuuguuuuuguuuuuguuuuacaucuaaaucuggaauggagagaauaaugaaaaaaaguugaaaaacacuggugugguacaagaaugaguauagagacagcaaugagcguuuguauaguuguuuuggaauauaguacaucucuggaaaaccuaugugaauauucuauacaaauguaaaagacuaaauuugggcauguuacugaacucuaagaacccauuuuacuuugagagucauuaugaauuugaaaaauuaucaaaaugaaaauagucugcaaaccaagcauuaaaaauuaaauguacuuucaauauaguucuuaaacuuuuaagguuauucacaugugugaauuguuacuuaucaaauaauuuauuguucaaauaagaauugagcugaaauuuagcuuuauggcugaaauuuagcuuuauauuguuaaaaaaaugccuacuuaauuauauaggugaaacuuugagaaguuuuaaacuuguagagagaauaagcaguuuuaagucguuauuuauacaaguaauuuaaauggcauugauagaggacaucuacuggacaacauuuuuuauuagcuauauacuaguucuuagaaaauaaaaaaccagcaaaucaaaaugccucuguauugucuuccuuaacauucuaaacuuuggacaaacuaguccagacaaaccaucucucagcucuuacuagcauucuaauugguuuuauuuugguagauuuucucucuuaaaauuauguguaaauagguucuuuaugugugacuuuuuuucugucagaugaugauucauacuauuacauuuauuuucagucucauccaaaaacaaaaauacuuagugaugaaagauuaggaaaauugaauaugaacauuaauguuucuguuaucucugugauacucauccuccuuuugcgcauagaaacuaagugagagccuagaguaguuaucuuaaaaaugcuuucagauacguaauuaucuuuaugugguaauauagcaaggaugagaaccugccucuuccugucuaccuaccagacauuuauaggaggaggcaauaggaauaccuaaagcuaagaauuaaggacaucuggaaaauccuuugacaaauagugaaacaacaauuaaugacaaugaaaucuaugaccaaacaaagaucaauacauuuuuauauauuaaagauuacauguguugaucuauuuugucccagauaagcuuuguugagugcuuacuaggaaugcaaaacaaaauauaauucauauauauuccuguuguucguguauacaauuuuuauuauucacaggaguuauguucaaugaagcugccacaaacacugaaauaacaacuacugaaccauuacuccuagggaaacuauaggguuugauuccuccaagccuuuguucacaacauuuucgucaaccagacaauguauaacuuuguuuugcauguguuucuguuuaaaaacaacuuguuuaauauauauuguugaguccuuaacauugaacucacagcaaacagugcuauaacucaugucuuaaugaagcauaucuaacacauacuuuuucuccauaaagcacaucacagcuuucuugcauuuaggaacacuagcuggcauguuuguacuucauuuagugaccauuuuaaacacugaaauuaacaacaaaacaaacaaaaaugugaaaaaacauaacacuaaauaaacuacaaaggacacuuguuuauagauucagagcugaaacaacaagccaaagcaucaccuuguucaaccccagcugguaacaugcauaucaggugacucaaauuuuuugccacucugaaaauaucuacaaaugaccaugaauugauuuugggguuacaaauacauuuuagaaagcaggcaaauucacaaauguggaauccaugaauaaugagaaucuauuguacauauguuuaaaaaucaacccuguuccuagaacugauuugaugguuuugcauuucuuacagacacagguaggacguuuugcaccucaguucucuggauaucagcagcaagacugucaagaacuguuagcuuuccuauuagauggauuacaugaggauuugaauagaauuaggaaaaaaccauauauacaauuaaaagaugcagauggaaggccagauaagguaaauuucaugauccuauugucaccauuguuauaauuuugugauaccucuuucuaauuugugucuauuauccuuguaggugguugccgaagaagccugggaaaaccauuuaaaacgaaaugauucuaucauaguagauauauuucauggccuuuucaaaucaacuuuaguuuguccugagugugcuaagauuucaguaacauuugauccuuuuuguuacuugacacuuccauugcccaugaaaaaagaacgcaccuuggaaguuuacuuaguuagaauggauccacuuaccaaaccuaugcagguaaaucauggguugguuuguuuuguuuuuuuuuuuuuuuuuuugcauuuguuauuuuuauuaaaaaauuaguguugaguccuuauuauaaaaauuaaguauugaauuaucaagcccaaucaauaauguuuauuuguauaagagauuuuauaagcugaauacuuuggaaaucaguguaacuuuuuacagucuugaaagagcaacgugugucuuauaaaaaauucucaaaaggcuuuuuauagagguuuauuuuuauaauauuggggugaauauuagcuuaugaagaucaacauaauauuuuuaauuuuuuuaaacuucaacuuucuuuaguguuaauuguaauuuuuuuuuacuaguggcuauuggaaguaaagcuaauacuuuuaauucauagugugauaguaguguauuuaaauaccuguaauuuuuaggcauuuuaggaacuuaaaagaaaguagaaauucaguuagacuaaaaauauuuuguucagugauguucucuaauuucuaauacuuugaaguaucacauauuguuuauucugugcaaaaguccugugguaagucuuacugucaaauugucugccugauuccguuaccuaguguuauaauuggauuauuuauauuuuguggguaaagcacuaucuuuucucccuuauuuauuaaucaguuaauccucuucugacacuugacccaucccagugaaaguaacuucuucuuuuucuaccucucuuucccuaaauucuaacacuuaacuaauuuuguuauaacuuuuggcuuacuuuuaucuuuuaucccuagacuacaagucuuugaagacagagaccuuguaaaccuuuguauuuccagcuuuuguggcugguaaauauuaaugcacaagaaguauucaaaaauuuuauucaucaagauacuuaacuaugcaccuacuaaguauaaagcucuuuggcuaaacaaaaaagauaugauuccugcuuuagaagauuguuuucuguaaauuuuuagccaaauagcucaguuuguuagugcauaauagucacgaugucuauaugaaagcuauauuugaacaaaauuaugaucuuaccauucagggauguauuuggguuuauugucaacaaagacaggguauauguaguguucauaaacacacaguccuuuuauucaaaguaauuaaagucuaguagauacuagguauguacucaguuaugcaaauuuaagcaauuuguuuuucugcugcuuuauguuuucuuuaugaacucauugaacacaaugcccucauaucaguauuucacuggagagugcuaaguacuaucccuuaucugugagcagagccaauaaagaccugcuuuuacuuuuggccuggggaauauguguucacauuuuuaaaguuauauccuuuagauauucacuuauucacucguuuauaaguacaagauugucaacauucuuuucaauggugagaaacuauaacagugccaaaccacauccuuaccucucuaguuuauaacuuugcagauauacaccaaugaguguaauggagcaagagagcguagaauaauaaguauaaauuuacugcaacaaaaaauaaauguagauguuuuauuucucuacagcacauuuguuagagauaauauucucccaugccaauaauauaagguaaucuauaucaauaguggcaaauugcauuaauuuacacauuaguccauaagguauaugauaagugcucuuccauaaauugggcucuaaauuauuuuuccagcaaugugaauuucauugacuuaucacuuuucucauuuggugacaauaauauaaauuugcggagguuagagccaugguuagcacagagaaauucguuuguuuuuguguuuuguguuuuuuuuuuuuccuuuuuuccauuuagaggcaguaacaacucaaauacaaaaugaucaccucauuucauuaacacuaugcuuugaccagcuuguaagaaaagugaaauuagcugaguuucccuauuuguugaguuuucccgucauugaaguugauuuaggucauggaagcuuauuaggaaaaauauugaauauauauuauaucuuaggcucuuaugcugugcaaggugcuagaaauauaaugguguuucuaguccuuguucuucaagaagcuugucauacagugugaaaauugcucugacagggugcugcaagagaacacagaguaaccuacccaaacugguuaugaggccugugauaaauucugaaggacaauuagguuauaagcaggugaaaacuagaaauaaaagcauuauaggccaagauaauggcauguacaaagaacuuaugggagaagaggacauggcccacuucuguaaucuacaguaguuaauauggcaagcaggagcuagaucacgaagaacuuugaugccaguauaggaaguuugaacuucauccuaaaaacuagggaagccauuaaagacuauuaaguauagauauuauauggccacaauuauguuucagaaagaugauucuggguagcacagagaucaguuagaaaaggcuuaguacuaagaccagguaagaagcuuuuaaugaucagacgacagacaaaugacaaacacuucaacucugucaggauggcaguuugaagaaccaguugaauguaggaagugaaaauguguaaguauauucaaagaugaugccaaguuuacuugacaggaaaagaggagacagcagugcuguuuuaguggaauauauaggaagaacaaguugaagaaggaauccauuuuaguauugaacgugguggccuaacaugacccaaaccuguguuuaguauuggauaugcugacuuacagaugcaugaggaacacuuagguagagauauccaguaggcauugaauuuguguaucuagaccaaaggagagagacugcuuuagcuauaaauuggacaaucagcucuaugaaaaugauaguguuuuagaaggaugagauuacuuaaggcuaaggugaccccgugauuuaucaucuaaacaagaacucuugaaaauagaagggacugucauuaauaauuauacuaggauagcaggcuaauccaggacuggccaaagcaaaucaggagacacuguugccucuuccaaggagagcauauaaaauugagaagaaggcuaaagacaacacucuaaagaacaauguaggagaacuucaaaagaggaauaugaucacagcaauagaaaagaauuaaaaguagucguguuauaaggaaagggaauuuuuuaaggagaaaguggucagcagucauauuacaaagaggucaauaaaauaaagacugauaaguuguacaacauuauuggcaaccuuggaaacaaguuaaauaaagaggcgaagacaagccagcaagaggguugagaaguaaaugggagauaaggaaguuaugauaauauagauaucauuaauaaaguuauuuauaaaauagaggagaaggggagauaauuagagggaaagcaaugagguacccuuguuuuuugagagacuuuauauuccaaugcuuaugcaagaguugagauaaaauggaagaaagaauaauugcuugguuuaggucccagagaaagcagaagagcaugggauuuagaacauagacgcuaagguuagcuuugaauaagaagagagacaucuuucuuuccauguguugcaagagacagaaaaguaccuauguggauucaaagaaguuaguagaacaggaaguuggagauuuucccacccaguaguuucuguuuuugagaugaaauagguauucugcugauauuaagggagcaguagugaaauaggaagccuaaagaauggugaagauuuuuuuuuuuuuuuuuuuuuuuuuguuaaugagacagggucuugcucugucacccaaguuggaguacauuagggugugaucucagcucacugcaaccuccgccuccugggcucaagggauucucccgccucagacucccaaguagcugggacuacaggugugcgccuccgagcccagcuaauuuuuuguauuuuuguagcaacaggguuuugccauguuauccaggcuggucucgaacuuucgggcuuaagcgauucaccugccuuggccucccaaaguguugggauuacaggcgugagccacugggcccagcccaaugaagauuuuaaauaguuauugagauaaaugagagaauaaccacaugugugauaugcagaauuauuucugaguacugucaaaggaucaauugauauugggcacuguggauuuguagcacaccagccucuaaaauugggaaauucucuucagcacaugugaacagcucugagaaaguuuagcaagaguggaaugaauagaauugaguaacaaagacauuaaagguucgugauaaagcauguagggccuggauggaagggcuagaagacaguagggagcugguaaacugggagaaaacaagaguuaaaaggaauagaaaucucugugcaagacaagaagagauaagaaugaauuuccaggagaagcaagaaguagugguuagacaguaacccgaguuuaagauacuaaaaguggggccgggugcaguggcucaguccuguaaucccagcauuuugggagacugaggcagaaggucacuugaauccaggauuuugagaccauucugggcaacauaaugagaccuugucucuaaaaaauaaaaauuagccagucauggugucacacgcauguaguccuagcuacgcaagaggcugaauucggaagauggcuugagcccgggagguugaggcugcggugagccaagaucaugccacugcacuccagccugggcaacagagugagugagagccugucucuaaacaacaaacaaaaaaagauagcaaaagugggagcaguuucaaguaaugacaggaucuaauaaguugacugagguugaauuaaugcaagugucuuugaauugaggagccaaggaaugauaaaacuaggacaaauuauccaugugggcauugucacacaggacccaggauaguggcaagauuggagacaaacacuaauccaaaugccaaaugaaugugagauagcaaccaugaggucacucucauuuacugaauuuuuuuuccaaaauaauaaauucauuacaauuuuuuuuguuuuuuaguacaaagugguuguccccaaaauuggaaacauauuagaucuuuguacagcauugucugcuuugucaggaauaccugcagauaagguaagauguuucugggguugaaguauauaaguugguauuuaguuucucagugcuguaaaaccagcuuaauagaaauucguuuccuuuuagaugauaguuacugauauauacaaucauagauuucacagaauauucgcuauggaugaaaaccuuaguaguauuauggaacgggaugauauuuauguguaaguauaaaacucauugugcaaaauauuacuugaaaaaaaauuaauagaaguaacauaaaauuuugagaguuuauggucaguuuuguccuuguagguuugaaauuaacaucaauaggacagaagauacagagcacgugauuauuccuguuugccuaagagaaaaauucagacacucgaguuauacccaccauacugguucuucacuuuuuggucagcccuuucuuauggcuguaccacgaaacaauacugaagacaaacuuuauaaucuccugcucuugagaaugugguaagugccagacaauucuacauugacaaaauaaauaugggaauaaaauauaaaauagcuaauaaaaauaaacacauaagguacuauuggaauauaauuauucaagucuguauuaucucaauuuuguucauagucagauuauaguccuaauccacuuucuuauucauguaaaacauauuauggagguaauuucaaacccaggaagcacgaagucuguagcaguuuuaaaccaaaaguuuacaguuagaaggacauaggaauuuauguuauaauaauuauguguuacauguucauucugugaaaucauaacaaaugucaaaugccauauguuugcacugugaaauaacaaaugucaaaugcuucauuucuuuauauacauuaccaguucaugauuaauaguauuguaaggcagccuauuuuuugccuuccugaauaaaucccuugauuugaauuaugaaguuaucaagaaugucauuugaucccuuuuauccuugaaagcugguauauuuaguauucuuucuugcauaucuaauuauuauaguuucauaacccauauauaaagaucacauuauacaaauauaaguguuuuuagcaacaauauauaccaucuaaauaggguaaguugagaaauuauuugcaacaaacauuuaacauuuaaccuaaaagguaacauauuaauuauuuuuauaaagaugagcaaaacaaauuacuagucaguuauacuuaugguacuaaaaguuugaauuuaucuuugaaucuacuaagugaccacuguuacugcauuaaaaaguuuuguuuuacugauagaaggaaaacuuuuuaaaaguuuuuaucuuuguaguacugaacuuguuugauuuuugauuuuacuuaagccgauaugucaaaauaucuacugaaacugaagaaacugaaggaucccuacacugcuguaaggaccaaaauauuaaugggaauggcccaaauggcauacaugaagaaggcucaccaaguaagacuuuucuguuaaauuguacaaauguuucacuuagauaauugccucagagaaaaaguuaagaaaaugggaauuaaagaacuaaaaaauaccuggaaaccuaggauuaauaauauuaauaauuuaaaaauauagcauuggguuuauuuaaagcucucuaauaucuaaaauuaggugaaauggaaacagaugagccagaugaugaauccagccaggaucaagaacuucccucagagaaugaaaacagucagucugaagauucaguuggaggagauaaugauucugaaaauggauuauguacugaggauacuugcaaaggucaacucacgggacacaaaaaacgauuguuuacauuccaguucaacaacuuaggcaauacugauaucaacuacaucaaagaugauaccaggcauauaagauuugaugauaggcagcuuaggcuagaugguaaguauuugugaaaaauggcuugaacauuaaacaagccgagcauguuauuuuuuuuuuaggugaaaaccaugaaauucagcucugucaagaaauauaccauuuacuuuucuaucucaaauuuuacaugaaaggacuuaauaucuaaguagacuaaaauguguguuuguguuucauaaauggagauugaacucaugcuucaguuuucuaucuuuuuuuaaacucuuaaauuauuucaauggcuuggaaacugcuguuugcccuaaucaccaguacaaguagaaaagauugcuguuuguuuauucugguguauauccuaacauuaaaauauacuuuaauacuaagacauauuaaauuuuaaagaaaaaauauguuuuccaccuuagaaagaucuuuucuugcuuuggauugggauccugauuugaaaaaaagauauuuugaugaaaaugcugcugagguaagucaucacucacucacuuauuuaccuuuccuugauuuacuuuaugugauuaccagagauaaucauacuguuguguuacacucuuugcuuccaccaaauauguuuauuuugccaguaaaaaauuggucaugaacuagaaaaaaaagucuuugcaaaaauaccuuuuuuuuuuaaagguucagaguucauuuugaacguguuuuggucauccauauagaaguguacaggaauuauuuagaaguauauaaaucucaacugaaauaagcuuuaugauucuuuugagaaaguuuaggaguuuucauuauuauucauaguaagaugguaucacuaaaaugaguuuuguuucauuuguucucuuaacucaagaaauacuucucuuuaggacuuugaaaaacaugaaaguguggaguauaaaccuccuaaaaaacccuuugugaaauuaaaagauugcauugaacuuuuuacaacaaaagaaaagcuaggugcugaagaucccugguaagagacaaaauuaaauaauuguuuuuguuuucuuuaaggauuuauucugagauaugugccacaucaaguugaaaaaguaauuacuaaauucucuuugauguuuuaaauaguaaaggauucuuuauauaaguuguagccuauuaagagggaugggaaugucuuaaaaaauacgauuacaguguugccuuaauuuuauuacuguguuuuucauaauagccauuauacuauuaauucauuuuaguuaccuuuuuuccaagaaauuuuagcuauguaaucauuuugagagaagcuuuuuaggaaaaauguagugauauauuuugugguguuauuccauuagagcccagauuugagauuuucuaauaccugucuuccagcacagauuugugaccuaugucuuuuuugcauacuaaaagagaaauaaucuagcccucauuaugucuuuaaguauuuauuuguauauuaauuuguaaugguuuaaccuauuuggaaaaugucuugaaaauaaaaauaauaagaguugcuuucaaccugguacauauuaggcauacuauaauugcccacugaauaaauguagaacuuuccaaacauuuuuguuuauuauuuucauuaauggggguuguuuguaccucuaucaaguguuaaauacuucuguuuauucuuagguauuguccgaauuguaaagaacaucagcaagccacaaagaaauuggauuuauggucccugccuccaguacuuguaguacaucucaagcgauuuucuuacagucgauacaugagagacaaguuggauaccuuaguugauuuuccuaucaaguaagcuuuaauuguacuuuauaagcauugggcaacucuucuuucaaacuuauuugaugcuuuuuguuauuauccuuuaguaaacaucaggugccauuggacccaauuucagcuuucaaguuuguuuuugaguaguucuaacaguuuauaaggaucaguguuucaaaauuuuuauuuuuucuuagagauuuuccaaagaucaaagagaaaauauacuuuaaaaaaauaaaaacaauaaaaauccuucuguguuauauuaccuauggguuaauuggucucauuuauaaaucuaagauacuuuaugguacuuagugauuuuguuuauccuaggaauuacuucaucauuacucaucacuuacuccuaaauauguugggguuuuuugguguuucuuuuguuuguuuuuugagacagggucucacucuguugcccaggcuggagugcaauggugcaaucucggcucacugcaaccuccaccuccuggauucaggugauucuccugccucagccuuccaaguaacugggauuauagccacccgccaucaugcccggcuaauuuuuaguacagacgagguuucaccauauugaccaggcuggucucgaacuccugaccucaagugauccacccgccuuggccucccaaagugcugggauuacaggcaugagccacugugcccagcccuaaauaugcuguuuucaaaaagacuaaaauaaaacaacaauggaauugcuuagaaggauaacacaguagugaaauaaaucaucccuauugcauuauccuucaguuuuccuauugccauuauaugacaucauauuuguaaaaagauauaucuauggccauaccaccuugaacguacccugaucuugucuguaaaaagauacaaagaagucuguauacaucuucacacuuuaucucucuuuuuuucuuccccugcuuuuaacaguugagaauucagaaugacaaaaagggaacauuguauuccccgucacuuaguuauucagcagaaggacuucaucacacaauauuuuguacaaguacuugguacuaucccauuuugcaaaaagaacuuucagcgguauuauuucauauccugugauauuuguacaccaaaauguacuugauacaguuaguaaguagacaauugcuaaaggcagguguaucuauaaagguaacuagaaggaaauagauuacauaaaacaaaauauucacuggauuacucauucuaauugguggcuauaaauuuaaaauuuaaaauuauuuguaauuauugagugaaaaaaagaucauuuucucuuuaacaaaauagugagccauaaguuuucaagaauauagcauuuggcaauguaaguauaagaaaaagaaucagggcugggcacaguggcucacgccuguaaucccagcacuuugggaggccgagguggguggaucacaaggucaggagagcaagacuauccuagccaacguggugaaaccccaucucuaccaaaauucaaaaacauuagccgggcaugguugugcgcgccuguagucccagcuacucgggaggcuaaggcaggggaaucgcuugaacccaggaggcggagauuucagugagcugagaucgcgccacugcacuccaggcugccuggcgacagagcgagacucccucucaaaaaaaaaaaaaaagaaucagaaguaaugacaaacuagaaucuaucagagauguauuuaaaauuuagaaucauuauugcuuuuuaaugaugcaaauacaagaagaacaaccagaaauaauaauaagcuauuuacaagaagucguuuuccagguucuugaaugauagauuuugauuagucaguuacauucaaaggauguugcccauuucggguauauaggucaucaaagacagcaaauguagaauaaaaauuaagguuugauauauuaauauuuuuuaaaacuucuaaggaaguuuucacuauuccuguauuuuucuucauauaaaucacuuccucuuuuuuaaucucugacccugcccauaaauuacuuucuaaaauugacuguaaaauaaagaucuacuggacccagauggucaauagugaugacuguuuuuccugguauacugagaguuaaauguguuagcaugaaaacguuuaucugaaugacaacauuccacauuuuuauuuuauuuuauuuuuuuauuuuuguggguacauaguagguguauauauuugugggguacaugagauguuuugauggagugugaaauagucacauuauggagaaugggguauccauccucucaagcguuuaucguuuguguuauaauccagucacacucuuaguuauuuuuaaauguauaauuaaguuauuauugacuauagucacccuguugugugaucaaauaguauguuuuauucauucguuuuuuuuuuuaacccguuaaccauccccaccuuacaucuccccuaccuucccaccacacuugucauccucuaguaaucauccuucuacucugucugucuaugagcucaauuuuuuuuuauuuuuagaucccacaaaugagaacaugggauguuugucuuucugugccuggcuuauuugauuuaacauaaucuccaguuccauccauguuguuggaaauggcaggaucucauuccuuuuuauagcugaauaguacuucauuguguauauguaccagauuuucuuuagccauuuaucuguugauagacacuuaguuccaucaacauugcaacacauaguuucgucaaaucaacaagauuugguuguuuccaaauguuagcuguugugaccauugcugcgacaaacauggggagugcagauaucucuucaguauacucaaugaagcauuuuaaaauuuucaacccauaaacaaauguuugccaaaacauuaauaucucagagguacauguaugauuuguuuuguaaguuauuugacucaugauaauuuccuuagugagauauauauauauauagauagauauauauagauggauagauauagauauauauauguaugucaaacaacaauggcagaagggaauagaauucauugcauuuagggacaacauaaaaauuaacuugguuucuuuuuuaaacagugacuuggauaugucggaauucuuaauuaauccaaaugcagguccuugccgcuauaaucugauugcuguuuccaaccacuauggagggaugggaggaggacacuguaaguugacaguuugccuuuuuacccaaaucaugguguuugaagaacuccagacuuuuuucuuuaagauauuuauuacuucuuaaggauaaaauaucagaugugucuugcauauaguaguucaguauugauuaaugaaugagucagcuuuugaaccuuuuuuuuuucacauaggguauagagaauugaguucaucauacuccucaguucaaggccuaguagggaauguugucccauuuagagugcauuucccuccacguucuccuuccccuuugcuuucuaacauguuugaugcauauacucuuguaaaucauuaauauuuauucauuuauauaauugguacugugcuguagauaucacuaggucucgacacuuaugaagacuuaucuguguugcuuuguguccauuuagucaguuguuucucacugcuuaugauuuacaucugccauauuuuaucucuccacuuaccucaugauagacaucuaaauucccuuucacuuccuaccacuguaagacugauaaaccauuguuuaugguaucguauguaagaauuuauuugggcugcgugcccaaaagugaaauugcugaguuuaagugaguaaguguugccagauugccccccaccccccaggauggcucuaacacucgacacucugcaagcaguugauuuuucuguugaacaguauuuacauuccuuggauauauccuacuuaucauuauauauuuuuagacacacaguuggauucagucagauuuauuuaggguuguuacaauuucauucauaagugaaaugguuuuguaaguuuuuuauauuuucauuaucuuaguuuggaauaaagauuagagucauaaaacaagcugagaugcuuuauccuuuuucugguuuuuggaacagcuaguacaauauaggaauuaacuguucaucaaagucuaguagaauuaaccuguaaagccaucuaggcuuugcagccauaauuguuuuuauuuaugucaugcauauuggucuauucaguuuucuuuuuccuuuucuguauauuuugauguucuguuucuaaaaauguauccauuucauuuagguuuuucaauuuauuuaagaauuguuguuuauaaugcuuauauuacacuauuuuuguccuuuuuucauucuuuuucucuuuuuuuuuuaaaucaaccuuccuggccaggcacaguggcucacgccugugaucccaacacuuugggaaguggaggcgggugaaucaugaggccaugagaucaagaccauccuggccaacauggugaaacccugucuguacuaaaaauacaaaaauuaguugggugugguggcacgugccuguaaucccagccacucgggaggcugagguaggagaaucacuugaaccagggagccggagguugcagagagcccagaucacaccacugcacuccagccuggcaacagagcaagacucugucucaaaaaaaaaaaaaaguaucagucuucccagauuucuaucuuguuagucuuuucaaagaauuacuuuucaucuuauuaaauuuuuauuuuuguuauuguauguauuuauacuuuauauuauuauuauauuuuauuuuaucuauacguuuuuuuuuugagacuggcucucucucugucaccaggcuggagugcagucgcaugauauuggcucacugcaaccuccaccuccuggguucaagcgauccuaccaccuuugccucccgaguagcuggacuacaggcacaugccaccacacccagcuaauuuuuuuguauuuuuaguagcagugggguuucaccauggugcccaggcuggucuugaacuccugggcucaagcgauccuccuaccucagccuccugaguaucagggacuacaggugcaugccacgacaccuggcuuguauguauuuauucugucuaauugauuucuucccuucccuucauuguaugguuccucuuguuacuuuggguuucuauguuacucuucuuacaacuucuugaauugaaugcuuagcuuugcuuuucauuguuucuccuauauugaaggcuguaauuaaaaggcuauaaauuucugcuaaguacugcuuuagcuguacuucagauuuucauuaucuuucaauuguauguauguuuuaauuuccuuuaugauuuccuaauuagcacaaugucauuuaaucauaugcuuaguuuucaaauguagagaguuuugucacuucauucuuaccuuuauuacauagcaguugagagcauugucuauauuaaucuuuaggaguccgaaaguuguaacaugucuuaauacauggucaguuccuuaaacguguguaugcuuggaaaaaaauauacauuccccauuuagauacagaguucuuuauaucucugauaauuuaagcuuaucaaguguauucaaaccauuacuaucccugguuauuuuuuguguucauuuuauuccugagaggaauuugucaggacuccuacuaaaguguugauugaccugcuucucccagcaguuuuauuaguuguuauuaauauuuugcauaauuauacuuauguucauaauggguagcucuucuuucucuguuccuuuuaacaccaggauuugacauucuuugccccuuuuuuuuuagguauuacaaguguuacucuagcuuucuuuuugguaucauuuaauuuacaaacucugugccuuuuuguugaaugugucucuuauagaucacacagaucuaagugcagcaucugcucugcacugaucuuggguugagaucaacaaacucacagcacgcaaaagcauucacccagcaccagguuuacuuagauuuaagaaaggauacaggucaagaaacaauacagcaugcacagcaacagcuuagcagagguccuguguagcuggaaggagagaaaauagggaaaagugugcucaaaggaagcuguucaucccauggcuauuuccuuccacuccucaccaaggcugauuuuuaaccagaguucaugggguacagucauauuaguugucaaauauuuuguuagcccaacaggacuuuuaaacagcaauaagacucugauucagguagccugaguauugcugauuucugugacaaaaauugaagcaagaaauuuaaacgcuuucuucuagauuguuuucucauuucugccuccauccauucugucgcauucuucagccauguugcaugcacacaaauauucuugaguucauauauugagaacaggguucucaauuuuuuuuuguuaguuccuuugacucuaacuuccaucucuuucuacgguuucucuccaugguugauauuugaggagagggaaccaacaacagauagaauaugaaacauuucuuccacaugguaguuacucaguaaaauuguuaaccaaacaacuuagaguuuaaaccauuauuuuauugugauugguugguugguuggcuggucgguugauuggcuugucuuuugaauuaucuucugaccgccaguggaguuucaccaaagauaaugcuuaccuuacuuucaaaguauugccauucccucugaacaucauccaaacagguaacuuaauagaaagagaauauugcccuuugauuucagccuuauuaaggauaauaccucaauuucuuauuuauauacaaaugggaagaauaauuacuuuaggaugggaagaauuauuuagaagccguacccuacaaagugucacuuuuuagaaacaaugaccacauauaauuauuuuggaaacauugugcaacuuuauuucuucaguuauugaguaguuuauacaaggcaugggauggggaaaggggcauuuuuuuaacuuaaagauaaagcagaucuuuaaaaauuauguggauuaaugaaucacuuuuugccuuuuucuugcuguguacagucaucccuuuguaucaguggauaccacagauguucaaauuccuuauguaaaauauuguaguauuugcauauaaccuaaccacauccucucauauacuuguauguguagauuauuuauaauaccuaauacaaugccugcacgucacuucauucacauaaauugaacauaguacucagcacguggcaaauucaaguuuuacucuucaggacuuuguggaauuuuuuuuuuuccucaaauauguuugaucugugguugguuggguucagggacgcagaacccauguaugcacaggaccgacuacacuuuuguuaaagacuaaaagagauucugguguuaaaaaaaaaaaaaaacacuauagcauaaugaguagagguaucagaaaagaaaucgucauagaaaauuuaauaauaaguugaaauuucaaacuaugaagucagaaacagaucuagguuuaaauccuaacugcuagcuaacaguauaguaccuugaguaaauuauccuucuuuugaugccuuaauuucccaucucucagguggggagaauaauaaugauaauaccuucuuuaugagacaauacauguaaagugcauaacacuaugccugguacacaguaagcacuacaugaauguuaauuaccauuuauuaucauuaguguuauuaugugaauuuaaaaauaaucuguuuuuuccugagaugaaaaaagaauguuucaacuuacaugaaaauuauuuuuggcaucuaauuguagaaauuagaaaucauuugaaucaauugaauauguaauaaauaagccucauagaugauuaucaguguuaauagauauuccuuauauagaugauuauagaguuuugaggaguccccagaaaaccaagaucauuuucgucacagugauuauauuuuuuucauuagauacugcuuuugcaaaaaauaaagaugauggaaaaugguacuauuuugaugacaguagugucuccacugcaucugaagaccaaauugugguaaguuugucuuauauuuccugagaacuaugggauucacugucuuaaggagugaauauaaauuaauaaaaggggcucauggaacacuguagucuauauucuagcagcuugaguagcuaaaagacacuaacucuuauuuaaagaaaugucaaauuguccccuaaauggaaauuugucuucuaaauuugcccacuaacaaaagcauaaauugcaaggugaaaaaauuuuugguaguuuucaacauggaguuucuaauaaaaauaauuaaguuuugcuuuggaaaguagauucagcucuuaacuuucuagacauugaguacuuaaagccagaauguuuaaacaagagaaaaaaaauccuugaaguaccuuaccguaccugugaucuuuaaagucauauccugccuuaugaaaauuaacuaaacucaaaaugacauaauuagauaaaacaaauuacagauuuauaaaagauuaauacuuguguacuuacuacuuugauauuuucugaauaguaaaaaaaaugaggaaguuccgucuguucacacuuacaucaguuuaucauccaccgcugacucucaguauggguuuguguguguguguguauauguauauauacacacagaugcauacauauauauguauauauacauauauauauauauauacuguuauuucucucccuauaucuaugacaaaaagagacuugaauacuauaaauuuuuaaaauuguguuaguuuuaauuaaccacauuuuuuguuuauauuuaaacuccuaauuuuuuuucugcaaaagaaaaucaauucuguucuccucaaauugcccaccuccuccaucagucuuuuuaacaacacugcccuaaucuuggcuucaaauaaacaguuaucuuguuuauauauaguauacaaauuugagguugccaugcauuuuaacaaugaugauucuucauuuagucaacaaauugaauaugauauauauagagagagagagauacacaaaagacuccauucuaaacagaguuaaaaagauagcugucacucaguccagaguuuaaaagauagcuaucucugauuuauaaaccaaagaagauaaguaaauuaacaauuacagcaugauaaguacuauuaaauaccuuacuauggccacuuagaaagggaacuucugucucaacucagauuugggguuugaggggacaauaaccagcacagggaaguucaugugguaaagaugaugucugaccugagucuaguaaaaauaagaguaaauuaaacaaaagguguucuaagcaaagaaaacgguaucuacaaaaacaaggaggcaugacaaagcgugacauuuuaagggaacagcacauaauuggaugugacucaaaggaaaagcucuuaaagggacauggggaagaaauuagucuggagauaaauuuagcgcuuagaucaagaaaaguggcauucuaguuguuuagacauuuucuuacagacuaugaguagccauuagauuguuaaacaagagaauaacauuguucaguuuguaucuuaacauuucucugagaacaucauagaagauagauuggagacacugaguaaagaaacagaaaagccauacaggaggcugucacauaauuuaagcaauuaaaauaguaguuagaacaauacaaacaaggggagaauggauuuaugagauauuuacuggacagaauuaauauaacuugauaaaagauauaauaaggauaauagauguagagauccagagaaggagaaguuuaagaugacuuuuacuucaccauucaccaagauugggaauauaggaagaauaguugcuguugaaguuugagaugccuguaugauagcuguguggaaauuuccauuagguuguuggacucauaagacaggaguucaggggugagaacugauuuagguuauacauuugaguugucagccucaggcagcaguugaagccauagguuuaaaugagucaccuagugagaggauucagguugagacaauggugggcugaggacagaacauaguauguuuaaaggucaggauuuaauaaguccacagaagagccugagaagaaaccaaagagauaguaggagaucugaguaguguugucacagaagcaaaaaauuguuuguugauaggaaaagaaauagugaagcauuaaaugcuacugagagauugaccaaaagaacuggaaaggucacccauuucaguuguuuauuagguuauugacccugcugaaagccauuuugcuagaaugguuuggggaaaagcuagauuacuuugaguugagaagugugcaugagagugaaugaugaguauugacaacucuguuuaucacccugacuaugaggaagaggaagagagguauauggcagcuagaaggggaaguagaauggagagggacuuaugauaggaaaaaccuuagguauuuuuuaaugccaaagagacaaguccaguggauaaggacucauugaagauacacagugaugauugauggaacagcauccuuaagaugguaggaaaaguuggacucuacagcaaacaugggaugaagugacuaguauuagaagggaggaauuuaccuuuuccuuaagagaugguaggaaagaaagcauagaauucuauuuuuacguuagaauugugauacaguuuguguaucacaguuagaacugugauacaguugcauuuauuucuuuguccaaauaauuuagaagcacauaaaaauuuguaauucuaauaacgauucuuuauuagaaaucaucuuauauuuaaugaauuuuaguaacuuccauuugaccaugcaugguuuuucuauuugauuuaugcccucuuaccaaaauuggugaccagcuaaaaauucauaauguauuuaacgugaucuuugagaaucauaacuguuuuaacauccuuuguuuugacaguccaaagcagcauauguacucuucuaccagagacaagacacuuucaguggaacuggcuuuuuuccucuugaccgagaaacuaaaggugcuucagcugccacuggcaucccauuagaaagugaugaagauagcaaugauaaugacaaugauauagaaaaugaaaacuguaugcacacuaacuaaugaaaguccuagaagccauaaaagagacacuuuccugcuggugguaucuauggaaaugaugaaguuacccaccacauuaaaacaaaagucugagauggggaguuucagauaaccgaauguaaauccuuuaucagauuuuaacuugugcaguacuugaagugaaacacaaugaaaacuuuaacagaaauugucucuuaauacauuuacagucuuguauuuacaagcuaaauauauauaggaaaucacaaauaaaucccuuuuaaguuugcugcuguuuugauuaauuauguuuccuuuaauuuuuuggaugugaguugaugacaaauguuaaauuuguggauguuggucauuuauuuugcucuaauaauacugcaagaaaacuauggcugaacuuaguuuuuggauaaucuaguucaugugcauuaggcugccguauauacuacuaugauauuuagcugcaguaucaauguggcauaaauacugcggcagcauucuucgaaaaccgcauuuucaaauuuauccccguaaucaaugugggccuauuaaaaaaccaaaucaugauacaagaaacaaccuuggaaaaguuauuucccuuuguaauaccuuuaaaaauccagaguauuauauucauuuuacugccacuguggaaacagguucuagauuucauacuccaucuaaagucauuuuucaguuacauguaaguauuauuuacugcuauugggaucuauucuucagauauucaaaaacauuuuuugcuuuaaaaugcauaucuuuaauuggguguugguccaaaauuaaaauuuuugcugucuguuuuucucuaccccauuuugugguaauuuggcaacuugagcucucccaauuauuguaauauaaggacagacauaauaguauucuguacccauaguaauaauugcaucaagcuuagaugagaaauuuuuuucauauacuggccuuuaaaucauuaauggacaauuggcuauaaagguaggucuguuaacuuucuuuguguguuccugauggaauucaccauagccuuacagcuuuucucagaagguaacuuguuauaagagaaauggcauuugcauguuccagagucagaaccuguacaguauauaaagcauaaacaccuugaauuugauuuuaguucaccacauucaaggauccaggaugccaaaaauaugugugaacauuugaaacauuuuuauuugcugcuuuuucccuuugauauaguugaaagaauguauuguaaauuggcauacaauacugccuuuaauagaaaaccuaaaugcuggggcacauuucacauaucgacuaccugagaaauugcuuugugucccacuguuauuaaagcaaaaaguauaauguucuucacuugaacuaaucaaauacaauagauuauaaauuguguauuguaaauaaaaguucacucugugagugcacauuuugguaaauuauuuauuuauguuagcauuuaaaaguuuaaaaaaaaugcauuugaccaggauaaaugagguauguugaucauggcuuugcuuuauaucuugauauuaaagcugguuuaucauccugguauuuuaaaagcugcuuugggguuuuuuuuuucuuuuuuuuuuuuuuaauguaaacuaaccuccugcaugacagagguuaaaauuuugucugcacuugaguucacuugaguuuacauuugaaaugugcauguuuauuuauauagauuucaauaaagcuauucaaggccuuauuuagucuuuuauuucuuacucuuaaucuuuuaauaaaaauccccuacuuuaugguuagaugacuauaugcuagacuuuuuaguuauaaauaguuaauacuagaaaggaaauuaugucagagcaaaaugaauccuacuauuaaggacguuuuaaaguugauuuuuguccacuuuaauauuuauucauuaaacauauguuuguguaccaaucacuguuguagagucuggagauacagcaguaaacaaauauccuuaccuucacagagcuuacauucuuucugccaucuaccaacuaaugaacuauauuuccauuuuucugaagauuuaaagaaaagucaaagcuaaaucuuuuaaaccuauauuguggucuccauccuaauucuucagagaccacuuucuuuuuaaugccugucauuaacuucuguucccacuaaaagaagugauguuaauaaugccauugaaacugccaaacucaaaugucauuuuucagcugcaagaaguauacuuuaaaaauagugcaaaaggauaauacauauucuaauuaaaaguaggcauucagacugggcacggugguucaugccuguaaucccagcacuuugggagacucaggcgggaggaucacuugagcccaggaguuugagaccagccugaguaacauagugagaaccucaucuguacaaauauauguauuuuuuuuuaauuagcugggugugcacacaccuguguucccagcuacuggggaggcugaggugagagaauugcuugagcccaggcagucaaggccgcaguuagccgaaaucacaccccugcacuccagccugugcaacauagcaagacucugucucaaaaaaaaaaaagauauucauagguaauacaggguaaugggaauauaucuagacuagaauuucuacuucuagcuuugccacuuagcaaucauaugacuuugaacuuaaucuuugauaguguuucuuuaccuguagaauaaugaugauaauagccagcauuuauugagcacuuacuauggaccaggcacuauauuaaaguguuuauaugcauucucucauuuaaucccacaacagcuaugagguagggauaguugucauccccauuuuucauaugaagaaaccaagauacaaagcauuuaaguaauauucccaagcucacacaauugcuaugggguagagccaauauucuauccucagauauauacuaccucucacuguguuauagugucugccucauaggauuguugagagcucaaaugagaucauguauuuuaugggaagagcuuuguaaacuuuauuacacacucacugauuucuucagucuaaauagaaagacaucuugaagucuaauaacuuugcuucuaaaaguauauuuagcucaguauucgagcauugaauaagaaaguacccacuggaauauugacuaacccauucccuuuuaaaaauuaauuucauuuaauuuauauaccuuuauuacaauuuuaauuaaaugguaaauacaaugugacauuuuuuucuuaccuuuucaucuaacuuguguccccuucuuuccauuuccccaaaugcaacccugaauuucaggacuuuguaaacucuacucuaguuuugcuuucuguuuguuuguuuguuuguuuagagacaaggucucccucugucgcccaggcuggagugcagugacauaaucauaguucacuguaaccuugaacuccuggguuaaagugauccuccugccucagccuuauaauuuaguuuuaauuaaccuccuugaaaaaguugcagccuggugcuuuauuuaaauaucuugcuuucucauaaucuguguuauuuuaguaguccuguauuuauccuugcuuuccugacaacuggauauaaaacuacacaaaacauugauuugggcacaaagaaaaucaguaaguaccaaaauagauacaacauaaagguggugggguuuuuuaugaacuaauuugauugaagugaguuuaucuuauaaaauaagccgggagacugaaauggagucuccuucagugguacaccaaagggaguguaggguguaguaggagcucucugccuccgagaggaggaauauauuagacugauaacguuuaagucugauguauggugacaagaaaaaggccaauuuuuuguuuuguuauuuuuaaguuaccuacagauaaugcauuucauuauugccuacuuccaacucucccuauguaguauguuucugaucuucugugcuugugcaguguagaugagcucaccgcuuuaauuuuuaagauagaaauguggaaaacucuugaaucauagacuaggggaaggaaccagagguccucuaaaauaucagaggagugagaaggaaaggaagagcuccuuucuagggccauagaauaagaguagaaguuuuugcucauuuuuuuuguuuguuuuuacuuuacaaaaaaauaaaaaauuuuuugcucuuugaauaacuuaacaugaggaauuuggaaacaaccucucuugaaaauauauugguauucauucccaaauaauucuucuaaguaccacuugaccagaggauagggaaaggaggaaaaggugaguguauuuauauccuugcuaguuuuuguuauauauucaguugcagaucuauauuauauaucauuuuauuaucagauuuucuagugagaaauauauaugaugguuuuuuaauaaucauuuuagguuuggaggccauuucaauucaauauguauguguuuuacguguuuaauucguauuuacuauauauuaaaagaauuuccaaauagcucagauaagaaaacuuugguuuaaaauugaguuauuuuauaagcuacauagaauacaucaaaauuuuauaagcugcauagaauaggcuuuaaaauaucagaauuaggaaaauaaaauauagaugguaaaaauucaaauauuuaucaagacuuuuuucuucacuaaugaugggguaaagaauuuuuaaauggauaauauaaaacagacaguucaaaaauuauuuuuggaaaauauaugcaucgggaaacauaccccacacggugccaugguuuaauuauuccccagcucuacuuuugggagccuggaacuugucaggguugugaaauagaucucagacuauuaaggacauucagaaacuggcuaagccauucaaggaaaaucaggaauuuacguaauauauuggacuacagucucaaaggacagagagaaaaucagucaaauggguuuugauauuuuuuuuuccuagaaauguguagcaaaugugauuuuacaaagcagcuaaaaauacaacuaucucucuggaauugaaaauguguaaaauaagaccaca

SEQ ID NO: 16419 - RNA, 4714 nt, Homo sapiens
gagaagcgcuuucuuucgcgagcacccugaaccagaccaugacccagacccucaaguacgccuccagaguguuccaucgcguccgcugggcgcccgaguugggcgccucccuaggcuaccgagaguaccacucagcacgccggagcuuggcagacaucccaggccccucuacgcccagcuuucuggccgaacuuuucugcaagggggggcugucgaggcuacacgagcugcagguaggaagggacgccuuucccgagacagagugcuggggaaacugguuuugacagcgucagaaaggacugacuagugcagagcaaaugugggacagccagagagaacggaugcccaugaaauaaggaaaaggcgaguugaggcugggggcgguguggcuacacucgggcagagcccgucccgacucuuagcagagggcgcugcgaaagcgccuucucgcuguccugagguguggagauccugcagauaaaguacaagugcgcgggagggggaggccggagugggcaguacccuccgccugcuugcggcuuaaagcuacauggguuccuuuucauucacugaggacucguccugagauggacaguccagacauggaacuuuuagagauuucuccucgaccgagaugaucagagagguccugaaugucugccuugcacaaaguuccgguuuugcccaucacacucaaacuuucuagggaugggaaaugagagaggaggaguuugcaguaucaaaggcauacacuaguugggcacccgagaaagagcagaagcucccuauucccaagcccagucaacgcccuuggcgugggcacaggucaagcugaaaguccccgcccagguauccaaguguccgcuguguccgcucccccaggugcagggcgccgcgcacuucgggccgguguggcuagccagcuuugggacagugcgcaccguguacguggcugccccugcacucgucgaggagcugcugcgacaggagggaccccggcccgagcgcugcagcuucucgcccuggacggagcaccgccgcugccgccagcgggcuugcggacugcucacugcgugagucuucucugcccccagaagcccagacgcccugcagcggcccucuccugcugcgggucccgaaacuaucaaucugggggcauggugggaggucggcugucccacucuaccauugggcaucuugggguucccaucccagucugcuucacccacacucagguugagccccaaccucacuccccgccuaccuccuuauccuuugaggcccgaauccugggaacugggggaaccggaggaauugggcuaggguacaaggaucuggauggaaugaauguaagguucugugacucaaguuacccgggaaccccggccccugagggcaggaaaugaguaaagaggaagggggcuggaagacaggcgcaggccggugcagguuuccguaccccaagggggcagacgcaaucccucuccuggccaccgcagccgaacgcgcuccuucacugcagccagucccgucgagccguccccaccuucccgaugcgcacucucuccucaacccugcagggaaggcgaagaauggcaaaggcuccgcagucuccuggccccgcuccuccuccggccucaagcggccgcccgcuacgccggaacccugaacaacguagucugcgaccuugugcggcgucugaggcgccagcggggacguggcacggggccgcccgcccugguucgggacguggcgggggaauuuuacaaguucggacuggaaggugagucccaggacagagcugggcaggcgucgggggcgcccuaccagagccucccggaacccugacggcgcccccucccgacaaggcaucgccgcgguucugcucggcucgcgcuugggcugccuggaggcucaagugccacccgacacggagaccuucauccgcgcugugggcucgguguuuguguccacgcuguugaccauggcgaugccccacuggcugcgccaccuugugccugggcccuggggccgccucugccgagacugggaccagauguuugcauuugguaaggcacaggucgagguggaaaugggggaauguaaagcuguccagggguagcgagguauucacgugccuucuacccacgcagcucagaggcacguggagcggcgagaggcagaggcagccaugaggaacggaggacagcccgagaaggaccuggagucuggggcgcaccugacccacuuccuguuccgggaagaguugccugcccaguccauccugggaaaugugacagaguugcuauuggcgggaguggacacggugagguucucccuccgugcugugagccgguuccagggcuuagccuccgcagacuccggcuccauuuuucuguugcaggggauccauuauggccacguagaccagcuuggcuuagcacccuguagccccagacucuuccauaaucugcacccucugcuggguucucacacccaacaccucucuugcuuucacauguuuuucagguguccaacacgcucucuugggcucuguaugagcucucccggcaccccgaaguccagacagcacuccacucagagaucacagcugcccugagcccuggcuccagugccuaccccucagccacuguucugucccagcugccccugcugaaggcgguggucaaggaagugcuaaggugagggggaaggagaggaggaacaagaggaaaugccaaggaagggcuggggaagcaacuaguggauggaagcagggagauagcagagaaaaauggcccucuacuccuggccaaaaaggguuuggaaguuggaaacaaugagaagggggcugcagccccuagccucaucuuguugucuccauuuugugcuuugcaaccuagacuguacccugugguaccuggaaauucucgugucccagacaaagacauucaugugggugacuauauuauccccaaaaaugugaguaaagccuaugcacccuuucuacugagccauuccucacuaucuugggccccaacccuguucucaaacacucuccuaaaagcccuucaaacacuccccuugaccccucucuaggauaugccuuucuaggauguaauggaacaguggggagauccuuccaaaaguagccccagaaaacuuccccaucacccaccaggaccugccuuugucccugucugaauauccucuucuucaugccugcccuauucugagcccaaacugacaaguuuguuuuccuuugcaccagacgcuggucacucugugucacuaugccacuucaagggacccugcccaguucccagagccaaauucuuuucguccagcucgcuggcugggggagggucccaccccccacccauuugcaucucuucccuuuggcuuuggcaagcgcagcuguauggggagacgccuggcagagcuugaauugcaaauggcuuuggcccaggugagugcucuagauuuuauaccuuccccagacuggagagacccuaacccucuaaaguugugagcucuuuccccugacaagcauaggaaaucauauaagaccugguagaaugaaucuucugaaauaugauaagcccauuauaggccuggaguguaagugaggguauucaaacuauuuuuucccuaccauaaucccucacccuuauuaaccaagaaguccccuacuggccacaggugccacccaaucauugaccauucuaacacuaauaaugcaugcccuuuaccaauuggauuaccaaugaauccccccauuauagauaucuuucauaguaaugcucaccuucuucccuuuccagauccuaacacauuuugaggugcagccugagccaggugcggccccaguuagacccaagacccggacuguccugguaccugaaaggagcaucaaccuacaguuuuuggacagauagucccauggaaagagacugucaucaucacccuuucauucaucauagggauaagauuuuuuguaggcacaagaccaagguauacaucuuccccuaaugccuaucugaccaaacuggauagaaccaccauagugaagugugaggcggcccugaccaaugugugaaguaugcacuuggccugacucaggaagccaggugagaaaaccauggucucucugcuugcuuggcccuucugaucauguaugcaucccccaaggaugaaaucagauuuuaacuaauaaugcuggauggccugaggaaagauucaacugccucucuuuuugggcuuucauaguguucauugaugcugcuggcuaagcauuuaucaaagcauaagcucaguaacugugcaucuggucuguaccugguugguccuucgucuuugcauguaagcucuuugagaggaagggugaagccuuauuuguuuuuuauguccccugccagggccugucucugacuaggugucaccauacacauucuuagauugaaucugaaccauguggcagaagggauaagcagcuuacuuaguaggcucugucuacccccuuccuucuuugucuugccccuaggaaggugaaucugcccuagccugguuuacgguuucuuauaacucuccuuugcucucuggccacuauuaaguggguuugccccaucacuuaguucucaggcagagacaucuuugggccugucccugcccaggccucuggcuuuuuauauugaaaauuuuuaaauauucacaa

SEQ ID NO: 16420 - RNA, 5479 nt, Homo sapiens
ccccugggacaccugcucgugcggggcagggcggggaugcgcagccgcggccccuucuccucucccccuccccgccccgccccucccuccauccuucacccgcuccccggcgcccgccccgcccgcccgccacuccgggggggucuccgccgccgccgccgccggaaggagccgccauuugccaccgccgagcgcacgggccgagccaagccugaucccggagccggagggggacugggaccgagagaacggcgauggggggcggccccgccgcaggaggacccgggcgcguaaccccgggggcccggcccgcuccagacccagacccgcggggugcggcacccugagccccccuccccgcccccugcccuggccauggccgcccaccccgccgcccccgggccgccagcccgcucggccccgcaagcaccggagccccggcgguggcagcagugaacggcugucgcaggccccgaagaccccggcccggcucggcucucuagcgcgcgcccccuucccggccuuguccucuccccuccccccgccgcuagcgagccccccuugcacgcugccccccgcccccgguguccggacgaugcucaagucucggcuccgcauguuucugaacgagcugaagcugcuggugcugacaggcggggggcggccccgggccgagccgcaaccccgggggggccggggaggcggcugcggcugggcgcccuucgcuggcugcuccacccgggacggcgacggcgacgaggaggaguacuacgggucggagccgcgggcccggggccuggccggcgacaaggagccgcgggccggaccccugccgccgcccgcgccgccgcugccgcccccgggcgcgcuggacgcccugucgcucagcaguagccuggacagcggacuccgaaccccucagugccggaucugcuuccagggcccggagcaggucaggccugggcaccuggccgggcgcggaggguggaggcgcgcaccuggggugucagcggagaccgcgagcaggcgcggcgccuaaggaggcugggcgggccccaggacacggagugggaauggggugaggccgaggggcuggcaggggacuccuggagcgcuuguuugugucggagggucaaggguccccaggaagggguggggcuuucuccccggagagcgcaaaaucccucucacccauuaacagggacugcuguucucuccuauuucccucgccccagggucuccguaagcuaaggggaccuguucucuugcaggugggcagaaaggagagugcuucugugccccccuugaagggaggggcccagccagcgcccuugcuuagcucaguauuucuccccguggggcacuuuuuuucacuucccauucugcaacuuucuaucucauucuaaagaguauucuuuguuaaaauuuuaugggcaaaguugucccagaauagugccagggggugucucuguguagugagaauugauuccaugauuaaagggaaacacccuucacucccaccuccgcgauuucuccccuuuuuaguacguggaaaccgaggaccauaacccaucccaguuugcgccagaucugugaaguaacuuuacaaugauggggugggggaaggaaagcauggcucagaagcucuaacacuccccucccuccagauccuaagaggaagccuuucuuuugagaagucuuaaagacuacccaucccaaauucuaggaaaagagaagacccagcccuucuccccucuaauccccccaucccuuuccaucuuucaucucuuugguaugggaaguuucccuugaucuccaagggaagcuucuuuucuguugcagccuuacuuagccucuugcccugucuugggugaaaggccugaguuauuuaaggugggaaagugaccugaagaggagguuucccugucggggagcgcggcugaguggggucgggguggugauggcugacagggccccuccucacucuuccuccagggggagcucuuaagccccugccgcugcgacggcucagugcgcugcacgcaucagcccugccucauccgcuggaucagcgagaggggcuccuggagcugugagcucugcuacuucaaguaccagguccuggcgaucagcaccaagaacccacugcaggugaggugcaaggagaggacucggagauugggcgaggaccuuuuagcuauuggacucagggacccuccaggaagccuauuucauuuacucuuuucccaaagccacccuuccccgccaguuaccacagucucccgugugucuguauauccuuccuaagcccuuaauuuauucacagagauauuuauugggugccacuuauauuccaggcacuguucuaggcacugggacaaucaccacuccccacccgccacaaaaaaaaagaaaaaagaaagaaaagaaaaaaaaaaugcugggcgcgguggcucacgccuguaaucccagcacuuugggaggccgaggcgggcggaucacgaggucaagaguuugagaccagccuggccaacauggugaaaccccgucucuacuaagaauacaaaaauuagccaggcgugguggcucgugccuguaagcuacucgcgaagcugaggcgggagaauccuugaacccgggaggcagagguugcagugagccgagaucacagccacugcacuccagccugggcaacagagcaagacuccgucucgaaggaaaaaaaaaaaaaagaaaagaaaaaaugauguugaugaugauagcaaauauguaguguuuucugugucaaguuuugguguguauuaacucuuaaucuucacaauaaucuuauuagauacuauuauuauccccuuuuacaaacgaggacacugaugcacaaagauuugaaaacuuacccaagguuacuuagccaguaagugauggagucaagauuuaggauucaaaucuagauguuuugguuucagagcacuugcccaauccugccuuucuaaaguaagacaaauggugucagacaagugccacauucuagauuuaaucaaggcacagagaagacagauguugauccugccugaagguuuuagggaagguuccuggagcacccugcucuucagggccacccaucaccuggcccuccaucccuuucugggacucuuuggagcccuuucucccacacaguggcaggccaucucccugacggucaucgagaagguccagauugcugccauaguucugggcucgcucuuccugguugccagcaucuccuggcucaucugguccucacucagcccuucagccaaguggcaacgacaggaucugcucuuucagaucugcuacggcauguauggcuucauggaugucgucugcauaggugagggcaccucucucuccuuuaccugcucuguaucuuccucuuacacaccuaacuccccugcccauccccucaguuuccuggcuuuauuuucugccacuguagccuuuagugcuauccuggugcccccucaacccacuucccugcuucuccagggcccuuugcaacuguaucuucucacucugaagaaaugcuugcuuaaguaccucuggccuagaucuaggccacaguuaacccuggauuucuuauuccuauugcucaggccucaucauccaugaaggcuccucugucuaccgcaucuucaagcgcuggcaggcagugaaccagcaguggaagguccuaaauuaugacaagaccaaggacauaggaggagaugcagggggagggacggcagggaagucaggccccaggaacucacggacgggccccaccucuggggccacgagccgccccccagcugcccagcgcaugcggacgcucuugccucagcgcugcgguuauacaaucuugcaccuccuugggcagcugcggccaccagaugcccguuccagcucccauucuggccgagagguugucaugagggucacuacagucugaacuggacuccaggagcagggaucuugagucaaugcaucagucagagaagaacucucauggcugcuggagguaccagcuggacaagguguuuggggcaugcugcccccgucaccgaggaucuguguggguagccucaagcuggagacauugucuggccucacugcccacuggguagagacaccuggaugacauuucaguacccgcuggcagcuccucccacucauccagagacggccggugggcaggcggggagagcagcuuuccuucccuggagagaaccgucuuuaccucagcuccuagggccuccagccccccagcuccaccacggugacuuggugaagggggaccaaugccagaagaaaggggcuguagaccccuauuccccaccccauggccacagggcaucuggcaauaagacuaguauacauugaccucccguucccugcaugagggcggggaguucccccugcuccaucccccauugcaugggggaagggcauaaagaaucauuuauaugcacguggagacuccuuucucaucuggggcuuuucuggaggguugggagauguggggagguuucucugcacagguugcaaaucccaaaugcagcaguggguucugaguuguaggugugacucccacuugcuggugaauaauucauguuggcugcuagguggcagcacuccgagguaucuaaaggguagaccuggaccugccaccuaugaguugugugauauagaaaaaaaucucuuagcucugguuuuccugucuacuucauaggguuggaauaaggauaaaugagggacagguuggaugccguugcagagaaaaucagcaaugacauaaagagauuucuagaauaguugaugguccauuuauuucaaauaguagcugguguaacaaauucuaaaauguguuuuucaucuggaguugcacagaaucauggaauuuuguguugagugacauaauagguauggaaauaugaggggaaauagacauugcaaaugugaagcauggugguuauuuguuaagaaugagaacuccucugacucuaaauauuugggccugugggcuggggaaggcuggagccaucugccuuguucuggagaucaucuggguucuaucaguccuucucaaguacugugcucacccagaaaagcagugugaagugaauuuggacucauuuggagugagauggagggaauccccccacucaguguuaugagucuccaaccccaguuuaagcuauuuccauggcaguuuagggucacagguuugaucccggugugcccagccagugguauuaauggauggcauuauguuuggaggcagcagcauagaggacuguuguuuauagagaaaagauuugggaaggacuguuuacaaugugggucagccugaagccugggcacuuucuucugugaccuugggguuguguauuauaugaaugaugcuguuuuuaaguaaaccauucaacagcaauuaaauaauuccuucauucacggcuaaagucag

SEQ ID NO: 16421 - RNA, 4280 nt, Homo sapiens
agaacguccggcguucgccccgcccucccaguuuccgcgcgccucuuuggcagcuggucacauggugagggugggggugagggggccucucuagcuugcggccugugucuauggucgggcccucugcguccagcugcuccggaccgagcucggguguauggggccguaggaaccggcuccggggccccgauaacgggccgcccccacagcaccccgggcuggcgugagguaagugcagucccuucccaggaaugagaaccagugcccgccccccucacagcuuuccacgcguucguuucgcgagcugguuauggaagggucgcucaagggcgggaaguggggccuuuguggucaugggaaaguauaauuuuagggacugagguguaggaucuucgaugcaaggcaugugucaugugugaucuuugugcggggcgcgauugucccaaaggaaaaagcguuuucuauugcagggccucacguggcuggagggguugguauugagucauuguguuaucucuggggccggccccaaggaagacugggagcgggggaugggaugcuggugguguucuuugcgcuuuuuuuuugggagucccuuuguugcugcaggcucauaccauccuaacucuguaagcgacuuuuggugauaggagucugugauuguagggucucccuugaucugagaauggcuaccucucgauaugagccaguggcugaaauuggugucggugccuaugggacaguguacaaggcccgugauccccacaguggccacuuuguggcccucaagagugugagaguccccaauggaggaggagguggaggaggccuucccaucagcacaguucgugagguggcuuuacugaggcgacuggaggcuuuugagcaucccaauguuguccggugagaaggugguggaggguugggcguggggaguaaagggaaaagacagccuauagguggggugugaugaucuguagagaaguggggacccugaggaaauaaugagaggccauguuggguuaaaggggauugaaaagugagcauuuacucuggucaggcugauggacgucugugccacaucccgaacugaccgggagaucaagguaacccugguguuugagcauguagaccaggaccuaaggacauaucuggacaaggcacccccaccaggcuugccagccgaaacgaucaaggugagugggguugguaggcauugagagguggauugggaccuuuguaguagaaccuucugggauuucagguauggugccuaguuuccagugcaucuguaccuccccuuugaaacuaggaucugaugcgccaguuucuaagaggccuagauuuccuucaugccaauugcaucguucaccgagaucugaagccagagaacauucuggugacaagugguggaacagucaagcuggcugacuuuggccuggccagaaucuacagcuaccagauggcacuuacacccguggucaguagaaagaugguaccaaaauggguucugguugggaguaggagagugauugcccguagcaauugagaagucaugugcuucauguguucagucaagcaaguuguguuucaugguaacccaugggguccccauccauucuuccuauucccuuuagguuguuacacucugguaccgagcucccgaaguucuucugcaguccacauaugcaacaccuguggacauguggaguguuggcuguaucuuugcagagauguuucgucgaaaguaugggacccacauacccuggacuaccuugaauuccccaaaucgcuuguucauaaaccacauccauaccuugcccauucuuuuuuuuugagaccagggcuugcuguguugcccaggcuggauugcaauggcaugaucacagcucacugcagcuucaaccuccugggcucaagugauccucccaucucagcuucccaacuagcugacacuacaggcacgcaccuccaugcuuggcuaguuuguuaauauuuuuauagagauggggucucaguauauugcccaggcuggucuugaacucuugcacucaagcaauccucccaccccuaccucccaaaguagcauaagcuacugcaucuggccccauucuuuuacuugcguacuacuaacuugcccauagcagaaagcucugaaauguucuggaauuaggaacuucauaucccuuuauucucuuuauuuuuuauuuauuuauuuauuuauuuauuuauuuauuuauuuauuuauugagauaagguuucacucugucacccaggcuggagugcaguggcccaauuacagcucacuguagccucuaccuccugggcuaaagcaauccucccaucucagccucuugaguagcugagacuacaggugcacgccaccaugacuggcuuuuuuuuuuuuuagauggagucuugcucugucgccaggcuggagugcaguagugcgaucucugcucacugcaaccuccaccucccagauucaagcaauucucuugacucagccucccaaguagcugggaccacaggugcacgccaccaugcucagcuaauuuuuguacuuuuaguaaugacaggguuucaccauguuggccaggauggucucgaucucuugaccucaugauccacccacaucagacucccaaagugcuaggauuacaggcgugagccgcugcaccuggcauuucuuuuuuuuuaaaaaaagagacaaggucuugcuugcccaggcugaucuagaacuccugggcucaagcaguccucucaccucagcaucccaaagugcuggaauuguuggccuuuauucccuauacuuccuauuuugagccacuaagcaguaaccauucaacuaagauaucuuugaaaaugacugcuaccuuauaucccuucucaccuuaggccucucuucuguggaaacucugaagccgaccaguugggcaaaaucuuugaguaagugaccaacaugggagaaaaagauuuucuauucugaguccucuuucugcugaacccaggauggcaacuggcucugcccauggggaugggaacuggaggacccuccugaccagaguucuccugucccccacagccugauugggcugccuccagaggaugacuggccucgagauguaucccugccccguggagccuuuccccccagagggccccgcccagugcagucggugguaccugagauggaggagucgggagcacagcugcugcugguacuggagauggcugugggcacagggaaagaaauagagacuggggaaagaaauagagcaguaugcagggcccuggccacugugguuaaugaaacuugguugguagaugggcuguaguuuuuauuacagcugcaaauagccacccacagagaaggauauagaagagaacccauccuggcugggcacgguggcucacgccuguaaucccagcacuuugggaggccaaggugggcguaucaccugaggucaggaguucgagaccagccuggccaacauggugaaaccucgucucuacuaaaaguacaaaaauaagccgggggugguggcacacgccuguaaucucagcuacuugggaggcugagauaggagaaucacuucaacucaggaggcggagguugcagugagcugagaucauaccauugcacuccagccugggugauagagcgagacuccgucucaaaaaaaaaaaaaaagaaaaaagaagaaagcucaucccagguauuguugugggugggcagaagucuguuuucuucaugguuuucugaccuuugccucuccccucaggaaaugcugacuuuuaacccacacaagcgaaucucugccuuucgagcucugcagcacucuuaucuacauaaggaugaagguaauccggagugagcaauggaguggcugccauggaaggaagaaaagcugccauuucccuucuggacacugagagggcaaucuuugccuuuaucucugaggcuauggaggguccuccuccaucuuucuacagagauuacuuugcugccuuaaugacauuccccucccaccucuccuuuugaggcuucuccuucuccuucccauuucucuacacuaagggguauguucccucuugucccuuucccuaccuuuauauuugggguccuuuuuuauacaggaaaaacaaaacaaagaaauaauggucuuuuuuuuuuuuuuaauguuucuuccucuguuuggcuuugccauugugcgauuuggaaaaaccacuuggaagaagggacuuuccugcaaaaccuuaaagacugguuaaauuac

SEQ ID NO: 16422 - RNA, 3624 nt, Homo sapiens
cucaggaaaugcugacuuuuaacccacacaagcgaaucucugccuuucgagcucugcagcacucuuaucuacauaaggaugaagguaauccggagugagcaauggaguggcugccauggaaggaagaaaagcugccauuucccuucuggacacugagagggcaaucuuugccuuuaucucugaggcuauggaggguccuccuccaucuuucuacagagauuacuuugcugccuuaaugacauuccccucccaccucuccuuuugaggcuucuccuucuccuucccauuucucuacacuaagggguauguucccucuugucccuuucccuaccuuuauauuugggguccuuuuuuauacaggaaaaacaaaacaaagaaauaauggucuuuuuuuuuuuuuuaauguuucuuccucuguuuggcuuugccauugugcgauuuggaaaaaccacuuggaagaagggacuuuccugcaaaaccuuaaagacugguuaaauuacagggccuaggaagucaguggagccccuugacugacaaagcuuagaaaggaacugaaauugcuucuuugaauauggauuuuaggcggggcgugguggcucacgccuauaaucccagcacguugggaggccaacgcggguggaucaccugaggucaggaguucgagaccagccugacuaacauggugaaacccugucucuacuaaaaauacaaaauuagucaggcgugguggugcacaccuguaaucccagcuacuugggagacugaggcaggaggaucgcuugaacccgggaggcagagguugcggugagccgagaucaugccauugcacuccagccugggcaacagagcaagacucugugucaaaaaaaaaaaaagaauauagauuuuuaaauggcuuuuacuuuuauauucgcuaaacuuucucaaacuggauccugcuuauuacaggaaagaguucuugguuguuuucuccuuggcccuaucccugauuuacccuuagagccacaccaggguauguugaggugauccaguauauggacagaggaagggaaacagcuaagaaugacuccagcccccauccuaugcacucacagaagcuucccauauccucuuggagagagaggaagaaaguuuuuccuuuuauuccuuauagucuggcucccacuaaaauaugucaaggcauaaagucuugcuauuccaucaauuuuagaggaugugacaaggggccuuuccuuuuucucaaaccaaaacgguuacagacccuagauauucccuaagggaggaagagaaagcuuagagagagcagaagaaaagucagaaggauccaaagucucauagaaaggcacugggguuggcucuaggauccuucugauuccgaaaucucauugcuagccaaacaccaaggaucuguaggaacaaagggagagagauaaguaucaauuaauucucagucucaaaaaggaugugugugagggaacuggagaauguuaccucuguaaagcuaaagaagaguccaacacccccuaggauuuucagggcuucgucugaaugcuuaagaaacuuuucuccacacaucuggcauguggggcucuggcucuugcagaucugaggauaaaacgugaagaaugcaaaguugugaauguaaaguugcuagugacuaauaccuaugccgaaugucccuagaaacuuuacuguuaucugaccaguguccuacaaacuaaaauccuacuuggcuaauuccccagccucuauccacccccaccucccaccaacacagccccaauacaagagggcuuguagagagagaaacaaugacauucaaacuaaauuugccaacuugggcauuguccuuacccaguuuccuaccuccccuggcugcugcaccacccccaacacacucacugcagugcagaaaucauaaucuuguugauacaggguugugagguugaauaagccacaacaaucaaaacuucuuuccaguucaucccgagucuuguugcucaugacccaccaagaagcauugaugacaucugucugaaagauauggguagagggaaauuaagucucccuacauccuguuaucaguucaagugccucaauuucccuagcccagcaaaggaagucaaacagaagcauaacggugugcaacaauuauagacacgauaaauaucuaccuuuugagguucucuagaucauccucauggaaaauuaaccagacaucccagaggaagcaaauagcccaagaggccagaagcagugcaccuaaggaugaucuuuggguaguuggggccagacuaaggaaggaguucgagguuaagaggaaaauuuuaaaaagcaaguaaguacuugaaaggguacugucuuaccuguuugcuucgguuaauagccagacaugagcaagagauuacaaauuggaagaugaagaccaaaccaaggaugaucauguacugagaggaaagguuauggaaaaaaguccuagauuccuuuauguuucaucuauaauaacugucuggucucaucuguucauagaacuuacaccaccaugucaaauugaaagcaauaaaaucagcucuuguuucguagauuaugggacagggcagggcaaggagacguguccaagaucccugagguccccuacccuucuaacaucuuccuuagaugacagcccucccaagcccccgguugcccccaucacuucaggucaggauacaaagaacagcaggacuugguggugguugacagcacccaccaguccagccacugcaauaaggagaaggaagacucccacagcaaugacuccgccgaugauguggaugcuggacaccagacccaggcccuugccccaagcagccacuccaaugagcaacaagcucaccagcuacgaagaaagagcaggauacaucucaacaauucuagcaugcggcacagcccaaggccauacaagaggacuugggagcggggcagggggaaggaauaauggaauagugugugaaugggagcuggggauggugcuauccgcaccgggagcaucccuaggcacucccaaagguuagaauggcuaggauggcggggaggggguggcagggaugguaguaugaaugcaaaagaugaacccucaggaucauccuaucacuuccaguuuggaagaaacugagguucacaggaaggagguauggaacuuacgcccacggccuucaguucauucccccacccucagacaaacccccuuaaucaaccggaagucuccucucucccacggaaguccccaggaauucccucgucgccggaaguuccugggaaucuucccggaacccccauacaccccucuccccaccggaaguacccuagagauucuccccacggggccuuuccgccuugaagcuucccccaccuccaaaaccucaccauguagaccacguugagagcgcaaagcgcauucuuggagcaggcaaagccgccacaaaccaucuccccagcucuggggacccaaguggucccaaggacuuggggggaggguauuggggaccgucuuccaggaccccgacagcuucugucucuuuaaaucgaggccagccaaacccaauacucugcgccugcaccgucccuccccugccucuggauugg

SEQ ID NO: 16423 - RNA, 3624 nt, Homo sapiens
ccaauccagaggcaggggagggacggugcaggcgcagaguauuggguuuggcuggccucgauuuaaagagacagaagcugucgggguccuggaagacgguccccaauacccuccccccaaguccuugggaccacuuggguccccagagcuggggagaugguuuguggcggcuuugccugcuccaagaaugcgcuuugcgcucucaacguggucuacauggugagguuuuggaggugggggaagcuucaaggcggaaaggccccguggggagaaucucuaggguacuuccgguggggagagggguguauggggguuccgggaagauucccaggaacuuccggcgacgagggaauuccuggggacuuccgugggagagaggagacuuccgguugauuaaggggguuugucugagggugggggaaugaacugaaggccgugggcguaaguuccauaccuccuuccugugaaccucaguuucuuccaaacuggaagugauaggaugauccugaggguucaucuuuugcauucauacuaccaucccugccacccccuccccgccauccuagccauucuaaccuuugggagugccuagggaugcucccggugcggauagcaccauccccagcucccauucacacacuauuccauuauuccuucccccugccccgcucccaaguccucuuguauggccuugggcugugccgcaugcuagaauuguugagauguauccugcucuuucuucguagcuggugagcuuguugcucauuggaguggcugcuuggggcaagggccugggucugguguccagcauccacaucaucggcggagucauugcugugggagucuuccuucuccuuauugcaguggcuggacuggugggugcugucaaccaccaccaaguccugcuguucuuuguauccugaccugaagugaugggggcaaccgggggcuugggagggcugucaucuaaggaagauguuagaaggguaggggaccucagggaucuuggacacgucuccuugcccugcccugucccauaaucuacgaaacaagagcugauuuuauugcuuucaauuugacauggugguguaaguucuaugaacagaugagaccagacaguuauuauagaugaaacauaaaggaaucuaggacuuuuuuccauaaccuuuccucucaguacaugaucauccuugguuuggucuucaucuuccaauuuguaaucucuugcucaugucuggcuauuaaccgaagcaaacagguaagacaguacccuuucaaguacuuacuugcuuuuuaaaauuuuccucuuaaccucgaacuccuuccuuagucuggccccaacuacccaaagaucauccuuaggugcacugcuucuggccucuugggcuauuugcuuccucugggaugucugguuaauuuuccaugaggaugaucuagagaaccucaaaagguagauauuuaucgugucuauaauuguugcacaccguuaugcuucuguuugacuuccuuugcugggcuagggaaauugaggcacuugaacugauaacaggauguagggagacuuaauuucccucuacccauaucuuucagacagaugucaucaaugcuucuuggugggucaugagcaacaagacucgggaugaacuggaaagaaguuuugauuguuguggcuuauucaaccucacaacccuguaucaacaagauuaugauuucugcacugcagugaguguguuggggguggugcagcagccaggggagguaggaaacuggguaaggacaaugcccaaguuggcaaauuuaguuugaaugucauuguuucucucucuacaagcccucuuguauuggggcuguguuggugggagguggggguggauagaggcuggggaauuagccaaguaggauuuuaguuuguaggacacuggucagauaacaguaaaguuucuagggacauucggcauagguauuagucacuagcaacuuuacauucacaacuuugcauucuucacguuuuauccucagaucugcaagagccagagccccacaugccagauguguggagaaaaguuucuuaagcauucagacgaagcccugaaaauccuaggggguguuggacucuucuuuagcuuuacagagguaacauucuccaguucccucacacacauccuuuuugagacugagaauuaauugauacuuaucucucucccuuuguuccuacagauccuugguguuuggcuagcaaugagauuucggaaucagaaggauccuagagccaaccccagugccuuucuaugagacuuuggauccuucugacuuuucuucugcucucucuaagcuuucucuuccucccuuagggaauaucuagggucuguaaccguuuugguuugagaaaaaggaaaggccccuugucacauccucuaaaauugauggaauagcaagacuuuaugccuugacauauuuuagugggagccagacuauaaggaauaaaaggaaaaacuuucuuccucucucuccaagaggauaugggaagcuucugugagugcauaggaugggggcuggagucauucuuagcuguuucccuuccucuguccauauacuggaucaccucaacauacccugguguggcucuaaggguaaaucagggauagggccaaggagaaaacaaccaagaacucuuuccuguaauaagcaggauccaguuugagaaaguuuagcgaauauaaaaguaaaagccauuuaaaaaucuauauucuuuuuuuuuuuuugacacagagucuugcucuguugcccaggcuggagugcaauggcaugaucucggcucaccgcaaccucugccucccggguucaagcgauccuccugccucagucucccaaguagcugggauuacaggugugcaccaccacgccugacuaauuuuguauuuuuaguagagacaggguuucaccauguuagucaggcuggucucgaacuccugaccucaggugauccacccgcguuggccucccaacgugcugggauuauaggcgugagccaccacgccccgccuaaaauccauauucaaagaagcaauuucaguuccuuucuaagcuuugucagucaaggggcuccacugacuuccuaggcccuguaauuuaaccagucuuuaagguuuugcaggaaagucccuucuuccaagugguuuuuccaaaucgcacaauggcaaagccaaacagaggaagaaacauuaaaaaaaaaaaaaagaccauuauuucuuuguuuuguuuuuccuguauaaaaaaggaccccaaauauaaagguagggaaagggacaagagggaacauaccccuuaguguagagaaaugggaaggagaaggagaagccucaaaaggagaggugggaggggaaugucauuaaggcagcaaaguaaucucuguagaaagauggaggaggacccuccauagccucagagauaaaggcaaagauugcccucucaguguccagaagggaaauggcagcuuuucuuccuuccauggcagccacuccauugcucacuccggauuaccuucauccuuauguagauaagagugcugcagagcucgaaaggcagagauucgcuuguguggguuaaaagucagcauuuccugag

SEQ ID NO: 16424 - RNA, 938 nt, Homo sapiens
cguugagagcgcaaagcgcauucuuggagcaggcaaagccgccacaaaccaucuccccagcucuggggacccaaguggucccaaggacuuggggggaggguauuggggaccgucuuccaggaccccgacagcuucugucucuuuaaaucgaggccagccaaacccaauacucugcgccugcaccgucccuccccugccucuggauuggcgaaaugcguggcuaauccuggacguccaaggccugcaugccaaucaacccgcauuacgucaccgacccgccuucugucccucuccuuuuguuuuuucauugggcgaaacuuaaaacuaggggcaggguuucuagagacucucuuagggacuacagccuaaacuccaaaagcuuagguugaaagcugagcuuucuguggucggaguuaggagagggcuaauucccagggagacggcucuggaggaacuuaggugaaggggagacggcgggaggggcggguagggggccgcucugagagcugggcaaaaagggcuccgcccguagaaggagggcccuuccccacccccuucccccuguucugcagugaccucacgaugacgccauuguuuuguuauugcgucacgcucgggaacacccaaaggagccacauauugagcuuauuuagcccggccgcagaguccgcggguuggacacagcaacacccagcaaaucaucacacguuuguguguccucuaguacccauguccuguuccauaucuccuccuaaaggggugugaauauaccagaaauucaguguggaaauagcggccucaggccagcgcauuccuguauguggcauugccacaagugcacagaggggugugcucagcauuuucagaguacacgccugaucuagggcuugcaaaaaaacggcaggcaagaggaagagucucauuuacauaaauauaag

SEQ ID NO: 16425 - RNA, 938 nt, Homo sapiens
cuuauauuuauguaaaugagacucuuccucuugccugccguuuuuuugcaagcccuagaucaggcguguacucugaaaaugcugagcacaccccucugugcacuuguggcaaugccacauacaggaaugcgcuggccugaggccgcuauuuccacacugaauuucugguauauucacaccccuuuaggaggagauauggaacaggacauggguacuagaggacacacaaacgugugaugauuugcuggguguugcuguguccaacccgcggacucugcggccgggcuaaauaagcucaauauguggcuccuuuggguguucccgagcgugacgcaauaacaaaacaauggcgucaucgugaggucacugcagaacagggggaaggggguggggaagggcccuccuucuacgggcggagcccuuuuugcccagcucucagagcggcccccuacccgccccucccgccgucuccccuucaccuaaguuccuccagagccgucucccugggaauuagcccucuccuaacuccgaccacagaaagcucagcuuucaaccuaagcuuuuggaguuuaggcuguagucccuaagagagucucuagaaacccugccccuaguuuuaaguuucgcccaaugaaaaaacaaaaggagagggacagaaggcgggucggugacguaaugcggguugauuggcaugcaggccuuggacguccaggauuagccacgcauuucgccaauccagaggcaggggagggacggugcaggcgcagaguauuggguuuggcuggccucgauuuaaagagacagaagcugucgggguccuggaagacgguccccaauacccuccccccaaguccuugggaccacuuggguccccagagcuggggagaugguuuguggcggcuuugccugcuccaagaaugcgcuuugcgcucucaacg

SEQ ID NO: 16426 - RNA, 4079 nt, Homo sapiens
gacucacaagcauucaauuacuagcuacugaucauccauugugugccaggcagagugcuaggcacuggguguacaggagcaaaccagaaaaccagcagauaugcucuaaaagcugcuucccagagggaugaauaggagguaaacacgcaaagggaugaugguguugggaagcaggcgcaagugaggacaguguuccagaaaguggggagagaaugagcacccucagaagggaaggaacaggguccccucugggaacagaaccagcugagggaugaaaacaacagacugggcuacucuuucuugucugacugcucucaccuguagguuggggugaugggggaggcuuuuuggggacaacccucuuuuucuugugcuucuucaccagcucuggacucuguuuuuccuccagucuuuugaugaguuuguugagaguggaugugagagccagcauugcccgaucccgcucugacuccuucuucagcccaucuggguccagcucuuucucugucuggaauacccaagagaagagagugagucaagggucugggguguggaggcagccagcgggcugggcucuguaggagagucugauauuuugaaauggaguuuugcuuaucacccaggcuggaguacaguggugccgucucggcucacugcaaccuccgccucccggguucgagcgauucucuugccucagccuuccaaagagcugggauuacagguacccacugccaugccuggccaauuuguuugcauuuuuaguagagaggguuucgccauguuggccaggcuggucuugaacuccugaccucaggugauccgcucaccucggccucccaaagugcugggauuacaggcgugagccaccgcgccuggccagagagucugauauuuaagucuugucccucucucuggucccccuuccccaacagccccgauuaauuagggaaacagcuaccacuuccaagugccccguccuugcccugugcugugcccucuguuucuuuuagcccgucagccuguccugcuccacgggaccaggcggcuguggaagcaacaggaggaagagcugggcuugccuccuggaugauguuuuccaguucccgcuccaugccagccuucaccuccgaacggagccggucucggucugacggaagcaggaucccuuccaguuccuucucaaauucucccaguaacugccguucauccucaucuucauccucauccucauccucauccuccucuucuuccaucucucucugccguucuggaucaccccuuuccuucucugguucccucugagggacuucugcagcaucauccacaggcugcucuuggccuauauuuggcuuccccuggguggguagggaguggggagaaagacaguugggguuucaacagagacacauggucgggggcagacaaacaguagcaggugugugguacugggggacccaggaguugagucccaggucaggguaguuuuucaaaugcucgcaguugggagguggguucuacccauucccuaagcacggccuauaccuuuuuuguuccaccuuucagcuccucuaugaaucgaaucaaauccgcagggcuucgaaugacuuugaccugcacguuguucugaaaaucugagaugaaagaauaauaaucaugaaccuguucuguuguguuuaaauucuuuuuuuuuuuuuuuuuuuuuuuuuuugagacagagucuugcacugucacccaagcuggagcacaguggugcaaucucugcucacugcaaccucugccucccggguucaagagauucuccugccucagccucccaaguagcugggauuacaggcgccugccaccacacccagcuaauuuuuguauuuuuaguagagaugggguuucaccauguuggccagguuugucuugaacucuugaccucaggugauccaccugccucagccucccaaagugcugggauuacaggcaugagccaccacgcccggcucuuuuucuuuuucaacaugguguguuacuauguugcccaagaugaucuugaacuccugggcucaagcaaucuuccugcaucagccuuccaaguaacuaggauuacaggugugcgcuacugcgcuccuaaauucucucuggauuccuaaggacagguaaugagagaccaaggaaggacauggucccugccucuaggauuuaccuguuugacagugagacaagggcaaauauucgccugcagagagcaccauccuaagguggacacucugguaggagagauggaugcuaacaagcugcuaaguccccacucuuccaugcacuucugaggcccuucuggcagucacucuagcuuuuaggacuacagaggagauccuggggcuaagggcuugucuucccuggaacccuucuccucuuuccacaaauauuaaccauuuaguuuauucaguuccaggccuucuacugugaauuauggaugcauucucauuuaaucccaugcaacccucuaagguagggguuauuacccucauuuuauggguaagaaaauugagguuaagugaauuacaaagucaccaagugguggagccacuguguucugccaccuugcuaaaauagcagugcugucuacaaagaguauuaacuccuauaaaaaugaauuuucugccggccuggcuacccaaccucccucccaggcuuagcucuccccuccaucccuaccccugccaauccuaaaauauauucaguaaaggagacauggaagguucacucaccauugggagcaccagaagcugaaucugcugccucagggcuuggguccugcuccugacgaggagaaaaggagagagucaaguaugaaagccuguucaugcccuccauacuaugaaggcaaagguucuggggauauccuugcaucccuagguagauguaggucaccucacaauggccccagcugcagugacccuccccauccccauccugcuccucugaggcagcuggucucaccucagccggcaccuccuccccuccuggggccugguccucuggcucauuaagcaucuuccagaaaucugaguccuuacugucauccuuggucgggcucgcaccuaggguacagagaacagggagagacugaucugacaggaggggugagacagaagggagcaaauaggauggggucccuuccccuccucuaucaccaagggaggagggcccaugguacuuuuccacccccccccaccccaccagucagucaggacaguaagaucaggggaagggaagaaauggaagugaguuucacggaacaggugaaacaagguccuaccugccaucuuuuggggugccaccccagacuuggucucacuccacacuugggggccuagaucuugcagcuccucuaugauuuuaucuccauacugcuuugagucuacugagaaacagcaugcaagcaggccaggaacacauuccuccagcuauucaauacuugaucuuuugccacccccugcccccguaucuccccgucuucuccuccuucucuaauuacucaccggcuugccucugaacguaggccauguacuccucaggcuguagggaagggugacagaggauggccugcggugcagcacugggugggggccggaggagagggugggggcagagccgaggagugcgaauggucagcacauaagagcaggacaagggcucguccacgcgaucgauguaguccccagagauaccugcacccucgucacagaggaacugccaggacagaaaggaugaauacacuuaaucaccaacaauaauuugcuuuaguuauuagagcaggugucuuuuacuaagcacugauuaucugucaagcauugugcauacacugugcauauggcacuuuacauaaauuggcucacuuaucacaaagacccagugaggcgauauugguuucucaacuucgugccucaagaaacagguguggugcaguuaaggcacuuguucagguugaccagccuuuaagugguaaaaacaggaacugaauucaggcagcuuaacuguagguaaccaauuuauguuucauauucuuguuuuguauaaauauugugugu

SEQ ID NO: 16427 - RNA, 4079 nt, Homo sapiens
acacacaauauuuauacaaaacaagaauaugaaacauaaauugguuaccuacaguuaagcugccugaauucaguuccuguuuuuaccacuuaaaggcuggucaaccugaacaagugccuuaacugcaccacaccuguuucuugaggcacgaaguugagaaaccaauaucgccucacugggucuuugugauaagugagccaauuuauguaaagugccauaugcacaguguaugcacaaugcuugacagauaaucagugcuuaguaaaagacaccugcucuaauaacuaaagcaaauuauuguuggugauuaaguguauucauccuuucuguccuggcaguuccucugugacgagggugcagguaucucuggggacuacaucgaucgcguggacgagcccuuguccugcucuuaugugcugaccauucgcacuccucggcucugcccccacccucuccuccggcccccacccagugcugcaccgcaggccauccucugucacccuucccuacagccugaggaguacauggccuacguucagaggcaagccggugaguaauuagagaaggaggagaagacggggagauacgggggcaggggguggcaaaagaucaaguauugaauagcuggaggaauguguuccuggccugcuugcaugcuguuucucaguagacucaaagcaguauggagauaaaaucauagaggagcugcaagaucuaggcccccaaguguggagugagaccaagucugggguggcaccccaaaagauggcagguaggaccuuguuucaccuguuccgugaaacucacuuccauuucuucccuuccccugaucuuacuguccugacugacuggugggguggggggggguggaaaaguaccaugggcccuccucccuuggugauagaggaggggaagggaccccauccuauuugcucccuucugucucaccccuccugucagaucagucucucccuguucucuguacccuaggugcgagcccgaccaaggaugacaguaaggacucagauuucuggaagaugcuuaaugagccagaggaccaggccccaggaggggaggaggugccggcugaggugagaccagcugccucagaggagcaggauggggauggggagggucacugcagcuggggccauugugaggugaccuacaucuaccuagggaugcaaggauauccccagaaccuuugccuucauaguauggagggcaugaacaggcuuucauacuugacucucuccuuuucuccucgucaggagcaggacccaagcccugaggcagcagauucagcuucuggugcucccaauggugagugaaccuuccaugucuccuuuacugaauauauuuuaggauuggcagggguagggauggaggggagagcuaagccugggagggagguuggguagccaggccggcagaaaauucauuuuuauaggaguuaauacucuuuguagacagcacugcuauuuuagcaagguggcagaacacaguggcuccaccacuuggugacuuuguaauucacuuaaccucaauuuucuuacccauaaaaugaggguaauaaccccuaccuuagaggguugcaugggauuaaaugagaaugcauccauaauucacaguagaaggccuggaacugaauaaacuaaaugguuaauauuuguggaaagaggagaaggguuccagggaagacaagcccuuagccccaggaucuccucuguaguccuaaaagcuagagugacugccagaagggccucagaagugcauggaagaguggggacuuagcagcuuguuagcauccaucucuccuaccagaguguccaccuuaggauggugcucucugcaggcgaauauuugcccuugucucacugucaaacagguaaauccuagaggcagggaccauguccuuccuuggucucucauuaccuguccuuaggaauccagagagaauuuaggagcgcaguagcgcacaccuguaauccuaguuacuuggaaggcugaugcaggaagauugcuugagcccaggaguucaagaucaucuugggcaacauaguaacacaccauguugaaaaagaaaaagagccgggcgugguggcucaugccuguaaucccagcacuuugggaggcugaggcagguggaucaccugaggucaagaguucaagacaaaccuggccaacauggugaaaccccaucucuacuaaaaauacaaaaauuagcugggugugguggcaggcgccuguaaucccagcuacuugggaggcugaggcaggagaaucucuugaacccgggaggcagagguugcagugagcagagauugcaccacugugcuccagcuugggugacagugcaagacucugucucaaaaaaaaaaaaaaaaaaaaaaaaaaagaauuuaaacacaacagaacagguucaugauuauuauucuuucaucucagauuuucagaacaacgugcaggucaaagucauucgaagcccugcggauuugauucgauucauagaggagcugaaagguggaacaaaaaagguauaggccgugcuuagggaauggguagaacccaccucccaacugcgagcauuugaaaaacuacccugaccugggacucaacuccugggucccccaguaccacacaccugcuacuguuugucugcccccgaccaugugucucuguugaaaccccaacugucuuucuccccacucccuacccacccaggggaagccaaauauaggccaagagcagccuguggaugaugcugcagaagucccucagagggaaccagagaaggaaaggggugauccagaacggcagagagagauggaagaagaggaggaugaggaugaggaugaggaugaagaugaggaugaacggcaguuacugggagaauuugagaaggaacuggaagggauccugcuuccgucagaccgagaccggcuccguucggaggugaaggcuggcauggagcgggaacuggaaaacaucauccaggaggcaagcccagcucuuccuccuguugcuuccacagccgccuggucccguggagcaggacaggcugacgggcuaaaagaaacagagggcacagcacagggcaaggacggggcacuuggaagugguagcuguuucccuaauuaaucggggcuguuggggaagggggaccagagagagggacaagacuuaaauaucagacucucuggccaggcgcgguggcucacgccuguaaucccagcacuuugggaggccgaggugagcggaucaccugaggucaggaguucaagaccagccuggccaacauggcgaaacccucucuacuaaaaaugcaaacaaauuggccaggcauggcaguggguaccuguaaucccagcucuuuggaaggcugaggcaagagaaucgcucgaacccgggaggcggagguugcagugagccgagacggcaccacuguacuccagccugggugauaagcaaaacuccauuucaaaauaucagacucuccuacagagcccagcccgcuggcugccuccacaccccagacccuugacucacucucuucucuuggguauuccagacagagaaagagcuggacccagaugggcugaagaaggagucagagcgggaucgggcaaugcuggcucucacauccacucucaacaaacucaucaaaagacuggaggaaaaacagaguccagagcuggugaagaagcacaagaaaaagaggguuguccccaaaaagccucccccaucaccccaaccuacaggugagagcagucagacaagaaagaguagcccagucuguuguuuucaucccucagcugguucuguucccagaggggacccuguuccuucccuucugagggugcucauucucuccccacuuucuggaacacuguccucacuugcgccugcuucccaacaccaucaucccuuugcguguuuaccuccuauucaucccucugggaagcagcuuuuagagcauaucugcugguuuucugguuugcuccuguacacccagugccuagcacucugccuggcacacaauggaugaucaguagcuaguaauugaaugcuugugaguc

SEQ ID NO: 16428 - RNA, 1615 nt, Homo sapiens
cacugaccugucuaacgcucuaaggcagcggcaaaauuucgguccgggcugugccgggcucucgccccggccugaggguccucauggggcugggggcugcccgaugggggagcugggcaugagccugagggugugggggacccuccugccucuggagcgcgcccgaucccucccgucuuggaacucccggggcuuuuguggagcgcggcgcgguggugguucugggcguuuccugcccgggggcgguuggcggggcgcgaggaccaaguuaagagucuguugcaccccagccccggggcaaagccggggaucccuggcuccgcgucccacuggcagcgcggggagggcucuggccgccgcccggcucuucgcaccgcagcgcagcgcggcucagcucccggcucguugcggcugcuucggcuccgcgcggggaaugcgagcgccccggcgccuucuagugggcgcggaggaaacugcgggggcgcggagcaaacgcgggaagguccucgcucacagcccccaguccuuagccuccaaacacuggcaucucaaccgccugcucccacgacauccauuccauugccugcucguucugagcuuguaggcaaggaugggcaaauaagggcuuugggaggagguagggcgggggcgcgcuaaaacucaagucaaguuugaauguuaggaugaagauaaaggaaacaaccccuggaaaauaaacgcucugccuggcuaacaaagacugaggcacagccucccucucccccuccuccccgcccugccccccauuauuuaacagacacucaagagauacacacuggguaauugaaggcccuauuuccccgaacugccgcuuggugcaaccuugcaggaggaagggaaccccagagaggccagauuggcgguaguucugcuugcaagccuuaggucauagccugauaccucacauugccgagaaucggaguucuguggcuccgugguucuaauaaaagaugcaucaagauucaauaggaaaaaaagauauaacaagaaauauagaacauaacgaaaauaugugugugugugugugugugguggauuauugaaugaaugaauuuuauacaaacaaaugacuaaucagcuggggugaaaguggaaucucuacacuucuuacaccaaaauuccaaauguauuaaauauuuuaauauuaaaggugaaaucauaaaaguagugaaagaaaucaugaaacccggcgcaguggcucaugcuuguaaucucagcacuuugggaggcugcgauaggagaccaggaguucgagaccagccugggcaacauggugagacccccccccccccccgucucuacaaaaaauuuaaaaauuagcccagcaagauggcucacaccuguaguccaacuacuuaggaggcugaagugggaagauugcuugagcucgggaaguugaagcugcagugagcugagauggugccauggcacuguagccugggugacagagcgagacucugucucaaaagaagaaaucauggaauuuuuguuuuguuuaugaucuuggaguagggaagagaucucuaagccagauguaaagggaaauauuaauaaaucugacuauaugaaaaacuug

SEQ ID NO: 16429 - RNA, 7317 nt, Homo sapiens
cggagccgaagcagccgcaacgagccgggagcugagccgcgcugcgcugcggugcgaagagccgggcggcggccagagcccuccccgcgcugccagugggacgcggagccagggauccccggcuuugccccggggcuggggugcaacagacucuuaacuugguccucgcgccccgccaaccgcccccgggcaggaaacgcccagaaccaccaccgcgccgcgcuccacaaaagccccgggaguuccaagacgggagggaucgggcgcgcuccagaggcaggagggucccccacacccucaggcucaugcccagcucccccaucgggcagcccccagccccaugaggacccucaggccggggcgagagcccggcacagcccggaccgaaauuuugccgcugccuuagagcguuagacaggucagugcccgggggugggugggggugggauugguuggugaggggaggaggaggaggcgggaggaggcgggaggaggcgcgcuucccgguccacucugucccccgcgccgcuugccgaggccacucaucgggucaccuccgccgggggcgcccgccagcacgggcaugauucugcauuuuuuccugacaggcuagguguggagccgcccuccgcagcccaccccggcccaggugaugcucagacugaggagucgggggcgcgccggccagggcgggcggcgggcuuggggacugccacugcccugauagagcggggcuuuuccgcuuacgcacggccgcgucgaaaccgcggcauccaaaugucuucagcauuaagaugccaggccucgggugugugaggaaaccgagaugcaggagagggcgagaagaaaggaggccgggagacccuggggccugggaagugaggggagggguaccgggaaaaccgcggcuggcagugcaaacccuagcgcgauguguggaguggagagcgcucuugggagccggcaggagccucugaggacgcgggggccaagggccccaucccuugcccucccuucuucccucccuuucucacuccccacccuacccccaccuaggauguggcugggccgccgggcccugugcgcucugguccuucugcucgccugcgccucgcuggggcuccuguacgcgagcacccgggacgcgcccggccuccggcuaccucuugcgccgugggcgcccccgcaaagcccccgcaggcccgagcugccagaucuugcuccugagccccgcuacgcacacaucccggucaggaucaaggagcaaguaguggggugagugccgaccgcggcggcgcagcgcagcgcucgcuggggguggucugggggcuuuuguuuucuccacugcugggcucagaugccugcauucuccuaacgggcuguguggagugaagugggagguggaagugggaggcugcugaggcuugggcuggggaaaaucuguucucccugaaccuugccauggggauaaggauggggaugggcgugggagguugugcagucaagggagggcccugaaagacucccugagguccugauucagguaugagaagagacuccaggugggguccugguugguggguaggcagcuccugaaauccugguaauuggcccuauccuacaacucuaaaauccagauuuaggggauaggucauccgauccuuggucccccucccgaggacuauuugaagggcagcauuuaaggggacagagccuagacagacagaauugcagggccaagguguggggugcugugucaguguuuaugggaugaauggagcuguguagcugggcucugaugacccucacuaccuacccccuucaggcugcuggcuuggaacaacugcaguugugaguccaguggggggggccucccccuccccuuccagaaacaaguccgagcuauugaccucaccaaggccuuugacccugcagagcugagggcugccucugccacaagagagcaggaguuccaggccuuucugucgagguaccagcuugaaagaagcgcaugacuccucagggggagagcagugauugugccgggagggagagacccucuccccccgacucugcucuguccucuccuuccuccacugccaggagccaguccccagcugaccagcugcucauagccccugccaacuccccgcuccaguacccccuacaggguguggaaguucagccccucaggagcaucuuggugccagguagggaggagggucccagaggaugaccucagccacaguggggguggcagagcccaagguuggguggggaagaaugggagaugauuggaaugggaggugggaaccucugaugaaugggggacuuaagcucaaacggcggcuuaggaggugggaagugaggacagaagggacucuaggaauuucagaagacuguaacuggggaguuuugggggaaauaaucuauucuuugcugacuaaccauugguuaggugguggucagggcaggccauagggcaagcuuugacgggacgggcucaaaaaucagucacuguaggcuauguuauacagugugcccugcugaggccucaauaagaagaauagguggaaaguucucuauuguguguggugacagcagggagagaaaaugagaaagaauucagggcugccuaugugauucugauccccccacuccuuucuccuagggcugagccuucaggcagcuucuggucaggagguauaccaggugagagaaaacaagaaggcaaggaggccaaguaggcaucaagaaugcugggagggaggcagggcuacuaagggaaggaugggcgaaucagggaggcaagaagugggucuggggccuaacccugcacucuccaauccccuccuaggugaaccugacugccucccuaggcaccugggacguggcaggggaagugacuggaguuacucucacuggagagggucaggcagaucucacccuugucagcccagggcuggaccaacucaacaggcaacuacaacuggucacuuacagcagccgaagcuaccagaccaacacagcagacacaggugcaaggccuggguggagagacgggcaggcugggcaaacagagaagaaccagaaaggcuggagugggcaaauggcagagggcaugggaggcaucugggcuauggccagagcuguccagccacacaaugggugcuucaacuggaccagcagggccagagggagaaagggggccuuuguucaucuggggcuggagcaggccagagggaaacccgagccuugggugugucuccccuuuaggccaacuguggggggccccaggaagagacuugucuaaggaguuagaagacuauauucccaacccaccccuuacuagagggcaaaggucuuuacuuuccugagaucccauuucucuuccagcaaaagaggccuaaaagcccucuuugcuucuccccaaagcugguuuguugcacuaaguuugcuuccaccuuagggccuuugcacuuucuauuuucucagccuggaaugcucuuccccagauuuuugcagacuggcuucuucuugucauuuagaucucaguucaaaugccuccucuucacuaucacauuacuuguuugucuuauuuuccacucaauacuuaccaguaucugaauuuuuuaauuuacuuagccuggcaccagacugacuagguugcuaucaguuuuguugcuuaauaguuguguaaauguggcaaguuacuuuucugugucucagcuuuuuuuucuguuguaggaaucuacuuaauagggcuaucauggggauaaaaugagugcauauauuuaagguaauuuuuuaacgggucuggcacauaguaagugcucaauaaagauuagcuuuuacuuaaaauuuucuuuguuguuuuuucuccuacccauuagaauguaaguuccauaaagguaagaaccuucuguucuuguccaccaaggccuagaaaggugggacacagaguaggcacuuaaauauugauuggcugaaaacagaauguuaucccacccuucagggucaaaugccauguccuuucuucccaguccgguucuccaccgagggacaugaggcugcuuucacuauccgcauaagacacccgcccaacccucggcuguacccaccugggucucuaccccagggaggugaggcugguaggggcagggacauauuagaaccagccuugguggggagcaaguugggagagggcaguccugggaggggauaucuaccuguuccccucucccaacccuccuugucugcacccaacccugugcccccaaucucagcccaguacaacaucagcgcucuagucacgauugccaccaagaccuuccuccguuaugaucggcuacgggcucucaucaccaguauccgccgcuucuacccaacgguuaccguggucaucgcugacgacagcgacaagccagagcgcguuaguggccccuacguggaacacuaucucaugcccuucggcaaggugugcagcuagcaggcugaacggcaggccagaggacucccgcagggggugugcccucaaucugcagccuccaggguagugauucgaggaccaccugccucagaaucauggggugccuguuaagcaugaggauuccuggaauguaagcuucgugggagcaggaaauucucucugaauucuuagaauggugcuuagugccuaauggcauucaauaaaauagcugaugaaugaauaaauaaaugcacacggaaauuaaacgcauucuaagaccacugacuuggaaccucuguggggaucugcauuucuuuuaccuagcuccuggccuuucgaaagcacucaaaagucuggagaagaauacaagcugagaagggucgggggagagaaagaaagguggcagagggccauguccuauuucugcagccuccccaaccacacacaccuuucugccagggcugguucgcaggccggaaccuggccgugucucaaguaaccaccaaguacgugcuguggguggacgacgacuucgucuucacggcgcggacgcggcuggagaggcuuguggacgugcuggagcggacgccgcuggaccugguagggcaggggcugcaggauguggggguggagaagggccuugaacaggcuaaggccacagcgggggcgcugcggccaggaacggccagcccuaggacaaagagagaaccacgaaguggggccugggaacugucuggguccugcaggggugaagcggaagaggauggggcagggguacccccgaaggcaccggagcgcagaccuugaccccuucggguccccuaucccaggcccgccuggaggcaaccucccucucccugcagguggggggcgcggugcgcgagaucuccggcuuugccaccacuuaucggcagcugcugagcguggagcccggcgccccaggccucgggaacugccuccggcaaaggcgcggcuuccaccacgagcucgucggcuucccaggcugcguggucaccgacggcgugguuaacuucuuccuggcgcggacugacaaggugcgcgaggucgguuucgacccccgccucagccgcguggcucaucugggugaguggcacccccucccggucgacccuggcaggagccccacggggagcuggcgcacggucacgcgccucuccuccuaggcugcacccgcgcccagccgccagcgggaaccccagaacaguucugcagugauuuaccaagaccugcaccugggcgagagacagcucccacccucucccagccccgcauacucuuuuuuuuuuuuuauaaauauauauauuuuuuguuauacuuuaaguucuaggguacaugugcacaacgugcagguuuguuacauguguauacaugugccauguugaaucuccauucccagcacagccgcugggcccccauaagcuuccccaucacuguucccgccaccccugcucuacucccagggcuuccccuaguucagaccacagucggugcaacccaucuggcguuuauuuaaccucugggaguagggguagguuuuucgauuuucaaagcacaaguauauugacuccauuuacacaagaguaagacugagacccagggaguugauuuacaugcucaggguccuuagaaacaagccuuugcacacacacuuuccacacccuaaauuugagaguucucccuuaccagucggccuucugcacccucaggaucccucacuguguacuccccuccacccccagaauucuucuuggaugggcuugguucccuucggguuggcuccugcuccgacgucgugguggaucaugcauccaaacugaagcugccuuggacaucaagggaugccggagcagagacuuacgcccgguaccguuacccaggaucacuggacgagagccagauggccaaacaccggcugcucuucuucaaacaccggcugcagugcaugaccucccagugauggcccgcuggggauuucugacugucaggcugggccugccuccuugucccugccaggaauuuccaacaaaccccaccacccugugagcacucuacuggcugucccugagccucuaguuccucacucuuccuuuucagaaccugaugcccaguagggguuguccuggugacaccccuccuuuuuccagugcccagaggccugguggagccauaaccucucccacagccagugccaaguccucccccugcccauucucauggggcaggaaauggggggaucacuuuccaagugccaaagagcccagagggacucuaagaaccuaagguggaaacacuguccucucaucuugggaccgaggggguggggaaguuccccaacacauaaucccaagacugugccccucaucugcaucuucagauccaguacucuguguaccugcuccagccccacccccacagagagaacuuguggcucuggggcuggggugagggcuggugguuggugaaagccauucuuaguugugucucugcaaugcugugggcacaaaagaaggggcaccagagucccugugcaaacaccuagacucacuucauggauuccaaagcucucagcuucauuuuauuaguuacguuagguaaggggguucaagggucaugguccucaucacacacaugucaucagggcccucugcacuccacaugaugaggucagacccacacggugcaaaucuuugggucagugagcuccuggagaagagaggagacaugucaggaauagauuaggcaccccucuuccuuaaugaaauguggcaguccucucagggguaccccaccuacuuagggaucugaguucuucaguuccucacccauag

SEQ ID NO: 16430 - RNA, 7150 nt, Homo sapiens
ggagccgggcagggggcggauuccgcagcagcaacuccccggacgcgcgcaggccucaaagccccccagcuucagugcccccucgacccugaaacuuggagcaggguggggguucaguaugaagcccccggaccgccccgccccuggccgcacugaccggauacugggggucauggggggcaugcugcgcgcaugcgcccucccugggcaggaggggguaagaaugggggcucgcgguggggucgggggucuuucggggccuucaggagggcugcacccacaacucaacuuauccgaaaacgaguucugcggggcagucgcaggaauacaugaauucuauuacgagggccauagccccguucugggcgagccuuuuauaacaauguggguuuugacagguaggagaaggggaagggggaggucagggcugccuaggagggcagguuccuuacagugguucuguccccgcagcccccaaggagaagcccucuaggguugguggguaccgagccagagucugaacguacggagggagaucacagaagggaucgcgaacaugagguccucgccggggcucugcagcccgguaagaagcugggggugggguggggcacaguuugcuauccugcgccaaguggcgaauucaaaaauauucuauucuuauuagcauaaaguucgcaucuaauuugcaugagacccauuuaaucgcagagaccuccacucuucuugccuucgaguccaaugugugucccccaucccagucgaucccgagcccucgcaggcagaguguccccgcgccccaccccuggccccucgccagcccgggcuccaggacuucgccuuaauuggcgauuagucuuagcuggagucccggggccuggaggaaagaaggguccugagagagggcggcaucuggguuguguucacccacaaaagacuccccauacacgcaccccguaccagggggccucuguccacucggccggggacagccccaaacccagaacaucuucgcacaggccaaggccccauccacugaguccuccuucaucgcagaggccaaggggagaccugggcagacccugcagacaggcugaaccccgaccccagcgcuccgcagagcccgggaugcgagagggagggggaccccggggcaggggagcacgggcuggggaggggaaaaagcgcuggggacguggagugggaacgugguggugucugggggaggggcgaucggggcgggaacccggcgcaggcaggagggggaacgcgauggagagggcggagcugggccgcagaggccccgccucguggcggccccgcggccaggccuguuauucagcucuccgcuccgcugggacccgcacagcgccaguggcucgggggucggcccucgccuccuccccggcccgggccuagagccaccccuaaccagaggccggagacagcuggagcggcugccgcaucccggcccagccuccccuaccaucccucccccuuccacuggacaucuggacccuaggcccccgcaccgacaggguuccggaaacccuccccgcccagcccggcggccgggccccgcgccucucucucucuagagcccccagcccuccucaagacuagacuuccgccuaccccuggacaccuccucccgguccccucccucccccccucccacagccuggaccgggguaggagggagggggggugugcgcccggcgccguccccgccccgccccccgugauucccccugcauggccggcccggguggggggcgcgggggggcccgggcgccaugcggggggggcacaaagggggucgcugugccuguccccgugugauccgaaaagugcuggcaaaaugcggcugcugcuucgcccgggggggacguggugagugccaggucgagaggguccaguguugaguggggggcgggcuggggguucagggcaucuguuugcccuggcccuugggauuuaggguuggagacuguauguguuuuccaggaaagugguuucuuaagugaucccuaaggucccuucugccuccaaauuucuguuaguucaaguuaaggaaauaggggaaggggcagggaacucaucucuuucccuuugucaaauggguuugagaaaaacccacccacaauccccuuaggccuagaaccgauuauuuuccucaaaccuuuugcuaagaaucuacuucugaagagggacaggagaauggaggaaugagaaugaggugguucuacaaggggcuuuauaaggaaucacagcucucugucgcugagcacaggccaacgauaacccugauggacccuccucacuggccuccucuauugggucuacgcauguguuggggaggugggcugcagaagucuuuucuuuuuauagugauuacugcaauugguggaggaggggacugggaguggcagauggacccagcucauccuccccucuucccagagaauggucuguacccauugaaagagggaggguuguaggagagcagauggccacccccagcuuccaaugucugcccagauggcugcccccacccccauaucuaugcuaugcucaggauauggggaaccuccacauguaacuggggguuccaggccuggagagccaggcguuuaccuuacugugcuuucucccaggggugcccuggugaaauuuucuauccuggccaacucaaaugaggauggcaagagagugagcccuuggagagagaggcugagcaucaugaagagaagacccugggaguucccuggggacccugagucuggagcuggggcaaggucuaucaccuccucucuuuuuccucccauuagaauccuauuccauugcgggcagugaggggaguauaucggcuucugcugccuccggucuggcugcccccucuggccccagcucuggccucagcucuggccccuguuccccaggccccccagggcccgucaguggccugaggagaugguuggaucauuccaaacauugucucaguguggaaacugaggcagacaguggucaggcaggaccauaugaggugagcagggaacggcaccaaagcaugugggacaucuaugaaggacacuggcagagagggcaaguuggggccacccagcuacuguccccgaccucugacacuugauuucuggcccccagaacuggauguuggagccagcucuagccacaggagaggagcugccggaacugaccuugcugaccacacuguuggagggcccuggagauaagacgcaggugugaggacaggcucuggggaggcuccuuucacucaaggggcauucguuugcucacccuaggauguucuuuccuuccagccaccugaagaggagacuuugucccaagccccugagagugaggaggaacagaagaagaaggcucuggaaaggaguauguaaguguccacagcccuucccugcaguugcacaacuuccagaagacugucccucacauuuuagauggaauuuccuccaagguuggcuaugaugauaaaggggaggagggaggaacgggcugaaccaaggaugagcuccgacgcugaagugggggccuccuccugcuuucauccuagguauguccugagugaacugguagaaacagagaaaauguacguggacgacuuggggcagauuguggagguagcucccuuuaccccuucccagccccuccugccugcuuuuccaucugcccagggcuauuuucaggaggugccugggcgcuccucugucccaccucucaagccuccccacuccuggaccuuccuacucugggggcagggcggcucccaccagggagggggagguggaacacacccuggauuuguguacaggagcaccauuaagguggggagagggccaccacaugcucaugacccaaccucaacuuucccacaggguuauauggccaccauggcugcucaggggguccccgagagucuucgaggccgugacaggauuguguuugggaauauccagcaaaucuaugaguggcaccgagagugagugguggaacucugacagcuaggugcuggagaggggcccucaucugguuguccuguauccuaacaucagcccauugcgacuuaaggaauguuuggagaaguuuuguagggcacacuaccagggcagacagcucgaaacugcugggagugggcgagguggggguugugaaauguauuugaccugcugcuucucuaccaaccccuccagcuauuucuugcaagagcuacaacggugucugaaagauccugauuggcuggcucagcuauucaucaaacacgugaggcuugagggggcagggccuggggcggggcuuaggaaugggcugggauucucuggagaugcguccucccuccuugcccacccugcucucucuuaaacauuaccccuguuaggagcgccggcugcauauguaugugguguacugucagaauaagcccaagucagagcauguggugucagaguuuggggacagcuacuuugaggucaguagcugagaugucuuggugggaaggaggacagaacuggggcuuuccaggcugcauaaccacccugucccuguccccaggagcuccggcagcagcuggggcaccgccugcagcugaacgaccuccucaucaaaccugugcagcggaucaugaaauaccagcugcugcucaaggucaggacccccuuuuuccugggggcacagcuggcuggcacagcuguuuccucauucaucuccccaggguucuuagggcucccccagacuuccugagggcccucacugguguccucaggggaggaugugagagcuucuaaggguguccucgugaccucccugagcauuucuucucucugucuuaggauuuucucaaguauuacaauagagcugggauggauacugcagaccuagaggugaggaccccagaucuuccaggacacaccaugugcuccuuauccuccuaguaucucauggguucccccagccccuugggugguuuacagcugucugguuuuuagggggaggcugguugggguugagauaccgucugaagaggcaacuggccgaggaggccucuuucccaauaaugacucucuucgcccaacaaugcgccucccucaccugugucccagcaagcuguggaggucaugugcuuugugcccaagcgcugcaacgauaugaugacgcuggggagauugcggggauuugagguacggagauagggcaagaaacuggaggcccgaugcucuucugccccagcccuagcauucaggagguccuuauggggaguugucuucuccuggggcugaccccaugguugguugggcaugucaggcgaggaagggaggagcagagaauuguccuuuuucuuguucuuuuuccaaggccacuauccuuuugguuucagggcaaacugacugcucaggggaagcucuugggccaggacacuuucugggucaccgagccugaggcuggagggcugcugucuucccgaggucgagagaggcgcgucuuccucuuugagcaaaucaucaucuucagugaagcccugggaggaggagugagagguggaacacagccuggauauguauacaagaacagcauuaagguggggagaaggccacgagggagggcuuggagagagagagggcaugaggccucugagaggaugucucagaggagccagggagggccugaggaaucugggggcugucuccuaucugccaauucaggugagcugccugggacuggaggggaaccuccaaggugacccuugccgcuuugcacugaccuccagagggccagagggugggauccagcgcuauguccugcaggcugcagacccugcuaucagucaggccuggaucaagcauguggcucagaucuuggagagccaacgggacuuccucaacggugaagcucucauccuuucuucccgaugugcucucucagccccuuaaccuccugaaucccucacugcccagucuccaguaccuacccucugaccauggcccauccccuuuuccacugcuagcucaaaauuugauagaauccccuaaagcccuaagcaauugacauuggcugacagggagggagggcaaagugggagaaugauacaggcccuagggagcagaccugucucugcgguaacccuccuucuguuccucucuuugcuccagcauugcagucacccauugaguaccagagacgggagagccagaccaacagccuggggcggccaagagggccuggaguggggagcccuggaagaauucagcuuggagaucaggcccagggcagcacacacacacccaucaauggcucucuccccucucugcugcugucacccaaaggggagguggccagagcccucuugccacuggauaaacagguaugacgaauagagcucccucauuguagggauaaaaaggggagagccucucuuguucugggaccccaaguucccuccccauaucauuccuuccuuuuaucugguccuuccuacuucccaucccuuacgcuucuccccucuauuuuaacucuggagaagcugauagucucagacagucuaagauaucuagcaagaggagguggcuuggcuagggacuuaaacugaaaagagagaagugaggguagauuucuggccuuuuugauccucugacuugaaucuuuucuucaggcccuuggugacaucccccaggcuccccaugacucuccuccagucucuccaacuccaaaaaccccucccugccaagccagacuugccaagcuggaugaagaugagcuguaacuggugaaaaccauggggguggugcugacucagccgccuauuccccaaggagcuucagggcaguccuucuggcacugcuccagaauuccuccuucuuggugugucuggagggugggcaaggcugggagggauaucaacuuggaggagaacaccuagacccaaggacuuuuuucugcccaaggaacacaguuuccuucagcucccaucccuaugcaugcaucaugguccccccaaaaggaggauaugugggugggugggagggcuggggcaggggccagauagaaauuauugguuuuguuuuuuaauuuuguuuuuccuguuuucugagaauaaagguuuuguuauaucaccgag

SEQ ID NO: 16431 - RNA, 4983 nt, Homo sapiens
auaaagaguugcauauuuuacuuuauuuuuauuaaauuaaaagcuacagucuggcagcgauuccagaacaggguaaggagguuccucacaggggucagagaagagcggagaaagacagacugacggagacugagacacaggagagaaaggacaagguuaagggagaacuguaucugaugaacacacacagccggcuccauggcgggugacggggagcucacaucagcccaauuucuccuccccggcacccgaaguucagcgguggagcaguaugugggggcgguuaggaaucaagagacccucccuuccccacccuagguccuuucucggcuuggucguggagcacagcacauaccagaaaaagccaagggcaauggaggggcagggaaaccgggaguauauguacacggggaggggagaacagagccuuggaggucggccucugccagaagggaguggcucacacugcauugaaacacuuggccagugggggaugggggaagggauugcccccucccucucggaacucccuucccagucagacagguccccuacaggugugguguggggggcagggggcagagaggagaaagaggcuucugcuggguccuaguagaggcagacagcaggggccuuggcaaaggcgauguccuucagucaucugugauacccuucgcucucagcuccucuugcacccgggucagguagguggggucuggguacccaaaccugggagcaaagagaaaugagggugaggguuguuagcuguuugaacuugcuauuauccccaugcucacccucauucuagguggcucagacaccuccccaccuccccuaagggaggacaccuccaaauccaagauaauuuagcccaguucugcuuauuuuuguaggcuaagcugggcacaccaggaccagguugaauguaggagaaacugagauggcugaacaguuuggaagugguucucuccaguuaggaggcuccgugagcgagggguuggugggucccucaguggaaauggaacaaaggggaggagccaagggaaaggaaaugaagaggggucgcacagcuggggucccccugugcagcuggucuugugguggaugucguuccaggugaugacauucggucucccuguggucauggacgugccgauagugaaggugagacgcuggucaaacgccuugcggaacagggucagcaccuuguugcccucagggcaguccgggagguaggccacccguguggugccaggauaccgaacuccuggguuuggguguucagccugggaggaaggugaagcagagugggcagugagcagccaggcauccuaaggcccagaugccagaggagggucauccaggcuagucucugucugagcacccccagcuaaugcgaacggggcagcaacaggcugacagcuuuccacagaaggagagauuauacggccucggcagcaagagccuguuucagagcauaauccuuauguguuaagagauuuuuucugcugucucaaucccucaagucuccauucagcaacaaauggauucucagaagugauggaaguuagcuggucccuacacuccagacaacucagcaaaaaugugaagacagaauaaucuaucuuucagccuucccuucaccugaaaauacuccuaauguuucugccacugucuaacuuguuccauuuuccaucacucuucugugcagcuucuucaccccucugcagccagaauugcacauuacucuuuguccagcaggaagacaccuauaggccuugacuacuccuguuuuuacagagugaugcuccuggcucuguuggguuggucagaucccuuccuauugugccucccuuccccuaagccaccaccuccacagaauuuaccucugccaagaugucagcacaguauuuguguucaucaaggaaauaauaugcaauuccuuccucucauaucugauuugcuuuuuuuuuuccuagcucauaucugauuuucacgugugccuugggaucacagggauggaaaggcugggccucacggggaccuccuagguccagggcacugaguaggagggcacaguggaagacagcaagacugucucacaucuaacaagcacacucacccucacccgguuuuccuaggucagagcuuggggaaagccaaaggguaagggcaggccauggucuucuuacccccuggacaccgggcgggaagacguacuggaugacaauggugccguacuucucauagcugggcaguaggaggguggcguccuuagagaccagcauccgcccauucuggggcugguugcccaccagcugcccauagaagcggccgcacauggggcaggccuuuuucaccugcagagcccgggugaugcagcccucgcagaaugaaugccggcacuucuccaaugucuuggcauucuggaucucccccagacagauggggcaggugcucuccugcucuucugccuccucccgaaggcgaggaggaagaggugggggcagggggggaggaggaggggggagcccccgagcuccugggggcagaaguggggcugcucggagagggggugggccugcgcggugcaucucagggugcuccccuccaccccccagagccaggcagcccaucagcucccccugccucugagcuuucuucagcucuuucucugccucuuuuagcagccccuugagagccuuccgggcuagguagagcccauuuggaggggccgggggaggacccuguggggaaagcuggagaacauagaugucagaagucucgccaucuaugaggauggacacacggugcuccucccgaagccgggccagccgggcuggggucucuuugcucaggaagucccacacgggcuuggacacagucacuuuguucuugcaggugccuccacaggcugccauucuggacaggacgaacgacacugcccccagggugaaagggacucagggugggggguccccauuugacaaguaucagugccuccuacuucagguuccuuccaaacccucuauuaccucuguuuucucaaagccuaauccccaacccuucacccaaauucauauucugucuccccuuaucuuccaaacccaaaacccacugaagagcaaaaaaguuuccagagcuauauuaucaucuaagccaaguaucagucuuguuucuccugucauuucucccagaucauagaaacaacuugccccucccaccucuuggggaaaaaugggcuguuuaaaggggagggagacucuuugccccuccuuuuugcuuacuuugauccugaagagcuuagaauuggcaugcaggcucacucuucuuucccugcucccuacuuguaggucgugugaccugguagggcggaaaaauggaaggaaagugagaaaccccuucucccaauucccauggcccccaacccagcagcccauggaacagagacagaaaccuggguauagguuacuaagaauggcauuacuuggaacauggaaugaaggaaaccaguuuaagggugaaaauugaggaucccuugcgggggagauaccuggaaagcccauggaagaugauggcagcagaaauccuucuauuuccacucagcugaccaggacugggagugggggaaggguaaaaaguuaugauggcaaauguuaccauuccccucagccaacccagaaauaaaaacuccccuuccaucuccucucuucucugcagaauuccauuaucagcuucuccccaaguugcucaagaaggaacuucaacaugcuaaccuuccuccuuucuuccccagcucugaggcccccaagaaagccuagggcacacauaagagaagucaggaaagaaaacgcccacacagguggaggucuucuugccaccucccucagaucacauggaccggaauauuuccuaugcuccccaacuccucgccugcuccacauugccaaauaauucagccccuauugccagggagccuuccuugagagcuaacucagucccuucugcugaagucuguuaaggaugugaacaaaguggcagcagccccugcaauaacaaaguucucauugucaccuuuuaaacccagcacaggcagugcugucugucagcucccaagucuggcauuuagggaggggcggggcucacacaagggcucagcuggaggggccugauguuuucccugagucuggucgcauugggcuacggggcugucuccacaacacuuccaaaugcagcucaaacagaaagaagggccauuagugugaccuccauuuauugacugauccaagaaggagcagcugucccuucaugccuccaucaucgucccccaaggccagaugcaccucgagauucauaagugaaaauggaacccuagagucucagcccauacagucuauccgcgaugcaacacuucucuccccaucacgggggacccaggaccuagguguccuagguccaaguccugcuggcacagaaaagggaggcggggccccaguuuagggugggucugugauuccucuguggcaacccaggccggacaaggaaccagucucucccuccagacagaggccagagggaggcacagcccggaugggcaagggucccugggggcauccacugaagcagcucccgcccuccccccacggccuccuccaagacccgacccggaaccaacuccccacaucccucaguagccaaagcccccggauccccaccgccgggugggggugcaugucggcccgaucgcagcccucagaacccccgaauggaggccaaggcuggagggugcuagaaagaugaucggccgggcacggagcggggagcccggagccgcgcgcggggaggggagguggaggagggggcgccgggggagcggggggcgcgugaggggugcgagcggggcccggggggcgcgcgguggguguggggggcgccgggcucaccuaccucucgucagcgccgccauugccggucacaugacug

SEQ ID NO: 16432 - RNA, 1003 nt, Homo sapiens
uccuccucaagcugagggaagcagucugggugacagggcgccuuguugugagagggaaaguuuggaagccgccaguguggggugggagcaauggugaggcuggggaggauaccugcagguuggaggggcuuccccuucuaucggaggacaggcucucuuggagauaaucggaagccaguggaauaggagguucugaaucccuuugccguaggcuugagggaaaaucaggagcuucccaggauccugggagaagacugagcugugauccucaccucuuaagacccgaaugaacuauaucagcgauugucugauggagcaggcauggggggaguucugcugguaccaccccagcgggcaguugggcaauugccuggugaccuguggggcaaucuguacuuuuuauaucaucuuccuggguagagaacaacaggagccagacacucugggaaacuuccuaguggccuagcauuaugggaaugugcccauacuccugguugaagucuucuacuccgaauggagggaggccuugcccuucauaugccuaagaauugggcuagacuuucuuggucccagggagcugagguucugacccucuggucccuagggacugggcuuggaaaggaugguuguagacuaagccagcagauccccgagaucuuuauaggugcuugccucacauuguuaaggaucuuucuuuugagagggugcugggcugugcugcucuuuagaguugggcagacuccugacagucccaucucucuacuugcguugcaggugugggcuaagcugguggccccggcuuuagacuggaccccacaauguuugcagagauguucagguagcuguggugauacggcagaggacuccucagucucccucccagcugagggguuccccuugcuccucuggggcuuccccugaguuuucuugggucuccccacaaccuuugccuuccuggaguccucucucagguacuucgcucaguuuaauccuccuagugccu

SEQ ID NO: 16433 - RNA, 4130 nt, Homo sapiens
gaggagggcaaggccaugguaaaagauuacagccaggcgcucccgaggucagagacuuaagucuaaggcacugagcguaucauguuaaagaugagcggguggcagcgacagagccaaaaucagagcuggaaccugaggagagaggcgaguacugauucccaucuaccuuuuacccucccgucuccucaaaguuggggcguccgcucuuuaggaucggccucacuccuccacagugaaguuagggaccguccgagagaggaauggggagagucccuuauucugggguggugcuuacaaaccccuauugcuucggacgacggcgucucuccaccccugcccggagccggaacacgggcccugcucugugcugcugggcaaagggaccucgguugcccuugggaaauucauucuuucccguagccaacuucaggccucaucguuaggccuguccgcggggaggcaggucagcaggacacacccccgcucuaagacugggugaccaucgcucaggccguuuccgccgcuucgccaccagcgggccuucucccuaccccacccccaauucugucucagucucagugccucuggugucagcauggccaccuugguagcuggggcuacuggacccugcagcggauaggggaaccuugaggagacacaagccuuugggaggggugccgauggacagggagugguguguuuuccuuuugccguagaggucucugggccuccugcacaagagagcagccuggaucucuuaaguguaggaggccauuuggggucuccccaggguauuguccuucccucgggauuagucccugccucuuuaacccgguccugucucccagcuaaucucuguguaaccauugcaucaggccagccccguuuggcucugcagccuucugaccugaggcucuacugcugaugaaagccaagucccacacacuggaaggcaagggaggguuccccagggaggacagcccugcagagaaauacuucgggcaauauugcaucucuagccccuagggaucagcagcugccacucugcuucugccccuucccuauaagagagacuggggggaguuuauccauucauucuuaacaaauacuuaaugaggaccuacugugugccacacaguuuggggcucaggguacauccuugagcaagaggaaaaaaucaucucagugggaggccuacaguaaacaaaauauaagugccacggagaaagcuaaagcagagaaaggaauggagaauguucaggauggaggucagaguguuacaucagguggucaggaauuaccuuagguaauuccuccacucaaaacccuucagugacuuccaugacaugaaauaggaagucauuggaggguuugagcagaggaaugaccuguuuuaaaaggcucacucaggcugcuguauggugaauagaguugcggagggguggcaagagaagaaaugggaagaccuucugcagucagaaaguuucugcaguaauuuagagaugguagugaauugaucuagauuggaaacaauggaauuagaaguguuuagauucuucuaagcaaagguuuuaaaaacucauuuuuaaagaaugaguuaagggccgggcaugguggcucacaccuguaaucccagcacuuugggagaccagagguggguggaucaccugaggucaggaguucaagaccagccuggccaacauggugaaaucccaucuuuacuaaaaauacaaaaauuagccgggcauggcagugcaugccuguaaucccagcuacuccggaggcugaagcaggagaaucgcuugaacccagcaggcggagguugcagugagccgauugcgccacugccuuccagccugggcaaaaagagugagacccgucucagaaaaaaaggaaugaguuaaaauuugcuaguacuuuggauugcagggugugagagaagaggaaugaaggaugauaccaagguuuuuagcuuaagcaacuagaguugucaucugagauggggaugaccuuggaaggggaaaaucagcaagaguuugccuuugcacauagucuuaggugccuauuagacauugaaaaagaaauggcaaguaggcaguagacagcagagucugaaguucuggaagagguccagacuggaaauguacauuuggaggaugucagcccugugggaauggaguuaggaaaaugcuaugauuuguucccuucccuguaguuuaguuuuuacccuggcagauuugaggccugcuuuggauuuagagaaagcugaguuggccaggacuuuacuauuauguaaccaggacuacaaaugucagcaacuaaaaauaaagaaagucaggcccucuucugcccuucgaaauggcuacagggaccaaguaugcauaccccacaagaccagaaguaaggaaggaccaguaggaggcuggagguaaaagaaaaauaagggcccagcacgguagcucaugccuauaaucccagcacuuugggaagcgauggaucacaagguuaagagauggagaccauccuggccaacauagugaaacccuaucucugcuaaaaacacaaaaauuagcugggcgugguggcacgcgccuguagucccagcuacucgggaggccgaggcagaagaaucacuugaaccgaggaggcagagguugcagugagccgagaucgcaccacugcacuucagccuggcaacagagcaagacuuggucucaaaaaaaaaaaaagaaagaaaaaaagaaaaagaaaaguaaguugccucucccccuuccaaaaauggcugacauuucucuuuguugcccacaguguucaagaaggaaguguaucuucauacaucaccacaccugaaagcagguaaacuuaaccuacccuuuuccaaaaauuuuaaacggcaggacaguaaauauuuuagauguuaaaaguccuauagucucuagcgugacucuucaucucugccacuguagcaccaaagcagccauaaacaauauguaaauaaacagauguggcuguauuccaguacaacuuuaccuacaaaaacaggcaucagaccagcuugccaacuuguggcauagacuguuugcuacauggagcuuguuccagccacuccccauuauccugcagaugugcuuuuccagacugauccaacugcagagauggcagcugagucauugccuuucuccuucgggacacuguccagcugggagcuggaagccugguaugaggaccugcaagagguccugucuucagaugaaaauggggguaccuauguuucaccuccuggaaaugaagagguaagaauguuagcccuaaagcuaaagggggauguuaccuuucccuucucaacuaauaucuauguucccuuuccucauuuccuugaaggaagaaucaaaaaucuucaccacucuugacccugcuucucuggcuuggcugacugaggaggagccagaaccagcagaggucacaagcaccucccagagcccucacucuccagauuccagucagagcucccuggcucaggaggaagaggaggaagaccaagggagaaccaggaaacggaaacagaguggucauuccccagcccgggcuggaaagcagcgcaugaaggagaaagaacaggagaaugaaaggaaaguggcacagcuagcugaagagaaugaacggcucaagcaggaaaucgagcgccugaccagggaaguagaggcgacucgccgagcucugauugaccgaauggugaaucugcaccaagcaugaacaauugggagcaucagucccccacuugggccacacuacccaccuuucccagaaguggcuacugacuacccucucacuagugccaaugaugugacccucaaucccacauacgcagggggaaggcuuggaguagacaaaaggaaaggucucagcuuguauauagagauuguacauuuauuuauuacugucccuaucuauuaaagugacuuucuaugagccaaggucuuuuacuuuuucuucuugccuuuaggggcuucaggggguuuccccucagcuacagccaacuguuucuuuagauccaagaguuucgccaccuccgcagcaaccucguucuugucugccuuuugugcuuucaguucucggacaauguuucccua

SEQ ID NO: 16434 - RNA, 4130 nt, Homo sapiens
uagggaaacauuguccgagaacugaaagcacaaaaggcagacaagaacgagguugcugcggagguggcgaaacucuuggaucuaaagaaacaguuggcuguagcugaggggaaacccccugaagccccuaaaggcaagaagaaaaaguaaaagaccuuggcucauagaaagucacuuuaauagauagggacaguaauaaauaaauguacaaucucuauauacaagcugagaccuuuccuuuugucuacuccaagccuucccccugcguaugugggauugagggucacaucauuggcacuagugagaggguagucaguagccacuucugggaaagguggguaguguggcccaagugggggacugaugcucccaauuguucaugcuuggugcagauucaccauucggucaaucagagcucggcgagucgccucuacuucccuggucaggcgcucgauuuccugcuugagccguucauucucuucagcuagcugugccacuuuccuuucauucuccuguucuuucuccuucaugcgcugcuuuccagcccgggcuggggaaugaccacucuguuuccguuuccugguucucccuuggucuuccuccucuuccuccugagccagggagcucugacuggaaucuggagagugagggcucugggaggugcuugugaccucugcugguucuggcuccuccucagucagccaagccagagaagcagggucaagaguggugaagauuuuugauucuuccuucaaggaaaugaggaaagggaacauagauauuaguugagaagggaaagguaacaucccccuuuagcuuuagggcuaacauucuuaccucuucauuuccaggaggugaaacauagguacccccauuuucaucugaagacaggaccucuugcagguccucauaccaggcuuccagcucccagcuggacagugucccgaaggagaaaggcaaugacucagcugccaucucugcaguuggaucagucuggaaaagcacaucugcaggauaauggggaguggcuggaacaagcuccauguagcaaacagucuaugccacaaguuggcaagcuggucugaugccuguuuuuguagguaaaguuguacuggaauacagccacaucuguuuauuuacauauuguuuauggcugcuuuggugcuacaguggcagagaugaagagucacgcuagagacuauaggacuuuuaacaucuaaaauauuuacuguccugccguuuaaaauuuuuggaaaaggguagguuaaguuuaccugcuuucagguguggugauguaugaagauacacuuccuucuugaacacugugggcaacaaagagaaaugucagccauuuuuggaagggggagaggcaacuuacuuuucuuuuucuuuuuuucuuucuuuuuuuuuuuuugagaccaagucuugcucuguugccaggcugaagugcaguggugcgaucucggcucacugcaaccucugccuccucgguucaagugauucuucugccucggccucccgaguagcugggacuacaggcgcgugccaccacgcccagcuaauuuuuguguuuuuagcagagauaggguuucacuauguuggccaggauggucuccaucucuuaaccuugugauccaucgcuucccaaagugcugggauuauaggcaugagcuaccgugcugggcccuuauuuuucuuuuaccuccagccuccuacugguccuuccuuacuucuggucuugugggguaugcauacuuggucccuguagccauuucgaagggcagaagagggccugacuuucuuuauuuuuaguugcugacauuuguaguccugguuacauaauaguaaaguccuggccaacucagcuuucucuaaauccaaagcaggccucaaaucugccaggguaaaaacuaaacuacagggaagggaacaaaucauagcauuuuccuaacuccauucccacagggcugacauccuccaaauguacauuuccagucuggaccucuuccagaacuucagacucugcugucuacugccuacuugccauuucuuuuucaaugucuaauaggcaccuaagacuaugugcaaaggcaaacucuugcugauuuuccccuuccaaggucauccccaucucagaugacaacucuaguugcuuaagcuaaaaaccuugguaucauccuucauuccucuucucucacacccugcaauccaaaguacuagcaaauuuuaacucauuccuuuuuuucugagacgggucucacucuuuuugcccaggcuggaaggcaguggcgcaaucggcucacugcaaccuccgccugcuggguucaagcgauucuccugcuucagccuccggaguagcugggauuacaggcaugcacugccaugcccggcuaauuuuuguauuuuuaguaaagaugggauuucaccauguuggccaggcuggucuugaacuccugaccucaggugauccacccaccucuggucucccaaagugcugggauuacaggugugagccaccaugcccggcccuuaacucauucuuuaaaaaugaguuuuuaaaaccuuugcuuagaagaaucuaaacacuucuaauuccauuguuuccaaucuagaucaauucacuaccaucucuaaauuacugcagaaacuuucugacugcagaaggucuucccauuucuucucuugccaccccuccgcaacucuauucaccauacagcagccugagugagccuuuuaaaacaggucauuccucugcucaaacccuccaaugacuuccuauuucaugucauggaagucacugaaggguuuugaguggaggaauuaccuaagguaauuccugaccaccugauguaacacucugaccuccauccugaacauucuccauuccuuucucugcuuuagcuuucuccguggcacuuauauuuuguuuacuguaggccucccacugagaugauuuuuuccucuugcucaaggauguacccugagccccaaacuguguggcacacaguagguccucauuaaguauuuguuaagaaugaauggauaaacuccccccagucucucuuauagggaaggggcagaagcagaguggcagcugcugaucccuaggggcuagagaugcaauauugcccgaaguauuucucugcagggcuguccucccuggggaacccucccuugccuuccagugugugggacuuggcuuucaucagcaguagagccucaggucagaaggcugcagagccaaacggggcuggccugaugcaaugguuacacagagauuagcugggagacaggaccggguuaaagaggcagggacuaaucccgagggaaggacaauacccuggggagaccccaaauggccuccuacacuuaagagauccaggcugcucucuugugcaggaggcccagagaccucuacggcaaaaggaaaacacaccacucccuguccaucggcaccccucccaaaggcuugugucuccucaagguuccccuauccgcugcaggguccaguagccccagcuaccaagguggccaugcugacaccagaggcacugagacugagacagaauugggggugggguagggagaaggcccgcugguggcgaagcggcggaaacggccugagcgauggucacccagucuuagagcggggguguguccugcugaccugccuccccgcggacaggccuaacgaugaggccugaaguuggcuacgggaaagaaugaauuucccaagggcaaccgaggucccuuugcccagcagcacagagcagggcccguguuccggcuccgggcagggguggagagacgccgucguccgaagcaauagggguuuguaagcaccaccccagaauaagggacucuccccauuccucucucggacggucccuaacuucacuguggaggagugaggccgauccuaaagagcggacgccccaacuuugaggagacgggaggguaaaagguagaugggaaucaguacucgccucucuccucagguuccagcucugauuuuggcucugucgcugccacccgcucaucuuuaacaugauacgcucagugccuuagacuuaagucucugaccucgggagcgccuggcuguaaucuuuuaccauggccuugcccuccuc

SEQ ID NO: 16435 - RNA, 7763 nt, Homo sapiens
uuucucagcuguccacuuuccuccagcccugucauuucagcccugacaccaaggcaggaggcuaggaggucuacaaauagcgacuggguagcuggugugaacacaggggguacugggggggcuuagcccccaaggaagaggaccaguuuuuccccagcaccaccaucaaggccucgaggcucccagcucccucuacagccuguggacugacuuagggaaucccgaacguaaguuaccucuucauccucuugauuuccacgacugcucaccccagcugcccugaucuauaaucuacucagcuucuucauuucucuccuugucugugagucuuuuggguuuuaggcguaaaauuauuauucuacucuaggaugaguuuggauugaagcgggggguggggguggggguggggugaagggaaugaaguaguaagggaaggaaaggcucauauuacccugaaaacuuaaaauagcugagcccugaggcaggcugggacagaacuaggcacagggcccccagggcucaagaaaaaaguaggggaggacaaaugucuccaguccauccuuccuugugugcacacgaggacacacauuaaaccucuugaagagaggagaucugggaagguaugcaucacaucucuguugcccacagauuuccaggagaaacaaaguaccuauaggaaaaugacguaaaccacgcagcuuugaacacuguguaagggcuguaaacuauggggucgccccucaggauggaaggaugaguaucaguuugaggaacuaauugggaagcucuuuagucuguugggcuuuuuuuuuuuuuuuuuuuuuuuuuuugagacgaagucuugcucugucacccaggcuggagggcaguggcacaaucccggcucacugcaaccuccgccucccggguucaagcgauuauccuuccucagcuuccugaguggaugggauuacaggcguccgccaccacacccggcuaauuuuuauauauuuaguagagaugggguuucaccauguuggccaggcuagucuugaacuccugaucucuagugauccgccugccucagccucccaaagugcugggauuacaggcaugcaccaccacacccggccauguuaagcuuuuuucuagaccuccaugaaaucuguuaauaaaaccugccaaaggaucuguauuuggcccagugcaguggcucacgccugucucaacaauuugggagguugaaacaggaagauugcuugagcuaguucgggaccagccuaggcaacaaagcaagaccaugucucuacaaaaaauaaaaaaguagccagguagugugcaccuuguguuccagcuacucaggaagcugagguagggggaucgcuucaggcugggaggucgaggcugcagugagccaugaucacgccacugcacuccagccugggugacagagugagaccccaucucaacaguaacaacagcaaaaucucucaucacauuucuccgaaagccuccccuuugaggaccacccuacugcaagggacagaaagggagagaagaaugaaagggauuagauuucauagugggguccaaccucuugcaggaugacagaaaaggaggugcuggaguccccuaagcccuccuucccagcagagacucggcaaaguggggugagucugggccucugaccacuggguguggggggcugggaagccauuacagcugaagaagagugcuuaaauugaucucauuugugugugacucauuuuuugcuggccagcaccugcaguccccaauaccaauaccccccuaauccugggguacauuccuugccugaaacuagaaaacugucuaguuugcucuagcgccccccuacucuagagagggugacaaguccuuuuaacauuggguuuucuucacucccucccucagcuacagcggcuaaagcaguuacucaggaaggguucuacagggacaaaggagauggaacuucccccagagccccaggccaauggggaggcagugggagcugggggugggcccaucuacuacaucuaugaggaagaggaagaggaagaagaggaggaggaggagccacccccagaaccuccuaagcuggucaacgauaagccccacaaauucaaagaucacuucuucaagaagccaaaguucugugaugucugugcccggaugauuguucgugagucaugaagggaagugaagagaguaugauauugaaggcagagguuuggggagagggcauaggagaggaguauuuguagcagaugggcuguggcuagaguugguguaaggcaaugcuauuagagauugagcaaguagggucccagacagaaaaggaaaccuaagaguagcagcagugguacaaagggaaagggcaaucuggaaccuuaucugaauuuucucccccuuucccaagucaacaacaaguuugggcuucgcuguaagaacugcaaaaccaacauccaugaacacugucaguccuauguggaaaugcagagaugcuucggcaagaucgugaguaggcuguggagagcaaggaggggacauggccacgcgugguggcucacgccuguaaucccagcacuuugggaggcugaggugggcggaucacgaggucaggagaucgagaccauccuggcuaacacagugaaaccccgucucuaaauacaaaaaauuagccgggcguggugacaggugccuguagucccagcuacucaggaggcugaggcaggagaauggcguaaacucgggaggcggagcuugcagugagccgagauugugccacugcacuccagccugggugacagagcgagacuccgucucaaaaaaaaaaaaaaaaaaagaggggacaugucaccagccagcuaccccuugcuggucucuccuccaucccauucauuucucugcuuuuucuuucucagcccaucucuuuuucugagaaagggugagcacuccugggagagauaggcuucuggaccuuacuuugcuaccucuaaugcuuccucucaucccauccuacagccaccugguuuccaucgggccuauaguuccccacucuacagcaaccagcaguacgcuugugucaaagaucucuguaagugcccuuuauggaacaugagggaaugggcaagccuagagaugguuucaugccaucucuagcuuugggagccaaauucugaaacagaaacuuucuguuucccauaauucucccucaaccucacauuuuuauauccauuuggaugcagaggcaauauccccauuuuacagcagagggagauacgauuuaguugcaacuacauacaguuagcaagagguagagccaagacuggaaucuucaguugcuagcuucagaaucugugcucuuugugugcaaaaucauuucuaagcaagaacaaggauucuagauuguccucauccuuacuacagagucauaucagacucggggcaagacccaaaggcugcaggcacccugggcagguucauaauuuggcaacccaggccgggcgcgguggcucacguuuguaaucccagcacuuugggaggccgaggcggguggaucacgaggucaggagaucgagaccacggugaaaccccgucucuacuaaaaacacacaaaaauuagccgggcgugguggcaggcgccuguagucccagcuacucggagaggcugaggcaggagaauggcaugaacccgggaggcggagcuugcagugagccgagauugugccacuguacuccagccugggugacagagcgagacuccgucucaaaaaaaaaaaaaaaaaaaaaaauaauaauaauaauaauaauaauaauuuggcaacccuuaaaaacauauucauugacaaauuugcucaacauuuauuuggaggagaggcugaacucugugaagagcaugggugaaaaagaagaaccuauugguggcagcaccucagcuuacacaugccauuuagcagaacaaaagccagcaguuaagggcccauucuccuuagaaggagaauagugauucugcgcaugucucagcucccaagcaagcaaaguuguguuucaaacaucauauaaugcucugccuggaaggaguucuaauaaauacuuuccucccucacuuuacaucaccagugauguuuuuaaaguccuuuauagauugguguccuggguauugccuagcugacccuucccuaaucuuccccgcggcgcccccaccgccacccaacacacacauggguauccaucuacucaaucccaccucucccuuccuuuccuccaagccuuucucugccuucccaauaaugucuucuuucuccucccauucgauuagcugcugccaaucgcaaugauccuguguuugaaacccugcgcacuggggugaucauggcaaacaaggaacggaagaagggacaggcagauaagaaaaaugugagcacuguaccuccccacgaggucccucccagagaucccauggagcaggucauuuucccauuuggaaagcugacagaaguaauggauugucuuccccuaaaauugcacaaaacucggccaggcaugguggcucacgccuguaaucccagcacuuugggaggccgaggugggcagauuaccugaggucaggaguucgaaaccugccuggccaacguggugaaacccugucucuacuaaaaauacaaaaauaaaaauaaaaaauccgggugugguggugcucgcuuguaaucccagcuacuugggaggcugaggcaggagaaucgcuugaacccgggaggcagagguugcaguaagccacugcacuccagccugggggagaaagugagacccugucaagaaaaaaaaaaaaggaaggaaggaaggaaaggaaggaaggaagggaaaagaaaagauaaauguacauaucugaucaaaaaaaucaacugcaaaaaacaacuagaaaucuggccucaaacuuguugauauggagguuggacacagauaagggauuucuauggagugaauuaaugacuuguaaggcacuagcaaugugauauggcugcuuccagaagggcuaacauacucuuggguuauauucuuuuaagggaauuauaaaaauugugcugcucuuuuuuuuuuuuuuuuuuuuuuugagauagaguuucgcucuuguugcccaggcuggagugcaauggcacgaucucggcucaccgcaaacucugccucccggguccaagcgauuauccugccucagccucccgaguagcugggauuacaggcaugugccaccaugccuggcuaauuuuguauuuuuaguagagaggagauuucuccauguuggucaggcuggucucgaacucccgaccucaggugauccgcccaccucggccucccaaagugcugggauuacaagcauaagccaccgcgccugaccaugcugcucacuuuuuacuuacacacuggaguauuuuuaaaggcugacagcauagucaaggaccuggaaucugguagugaauucccuguuauuuagcuacauucaagcagaaugugggugacccaccugauaggauguuuuagggaaagucccugcauggccgggcacagugggucacgccuguaaucccagcacuuugggaggccgaggcugguggaucacgaggucaggagauugagaucauccuggcuaacacggugaaaccccgucucuacuaaaaauacaaaaaauuagccgggcgugguggcaggcgccuguagucccagcuacucaggaggcuguggcaggagaauggcgugaaccuggaggcggagcuggcacugagccaagauugcgccacugcacuccagccugggugacggagggagacccgucucaaaaaaaaaaaaaaaguuccugcauuaggcagauggcugaacuagauauuuccuccaaggccucuuccaacucugagaucucugagaucccauuauucuauaguucucugaccugauuauagacagccagggcauguguucccaagacagcgucucccuaacucuggugcccccuccagccuguagcagccaugauggaggaggagccagagucggccagaccagaggaaggcaaaccccaggauggugaguguuacccaccuccauccagagauggaguaggaucagaggcucagcuguggaacagaggguggaggagcaaagggcaggccagcuuuggauagacgaggcccuuccacaaaaggguaagagaauaagaauugcccuccaggagacagacaauuuguugguguuuccuaucccaggaaacccugaaggggauaagaaggcugagaagaagacaccugaugacaagguaagaauccuuccucccugcaaggaacccaguucucuccccaacccagcucugacaccacuacucauggcccuggcagaagcucacucuuuaacuccuaggcuucccaucacuucugacccacacucuccaucaacuugcacacccacccacgaccaaaacacuucucucaguucagggaccuagaagagaguuggaguguagaguguguggugaaugucccugccuuggaauccugccccucagugugggguagaggagcccuaagacucaucauucccuugcacccccagcacaagcagccuggcuuccagcagucucauuacuuuguggcucucuaucgguucaaagcccuggagaaggacgaucuggauuucccgugagaggccuuggggcagggggcugguacugcggagugaagaggaaagagcuggguucccccaagggaaaggaaaaggggggacucagggcuuggagccuauugaugcuggacccggggcacagcaggggaccugcuaugugagugaggccccucccuuccccucccaggccaggagagaagaucacagucauugaugacuccaaugaagaaugguggcgggugagagaaauggcuagggcuaggguggaguguggguugaguccagaacccgacauugagagauggacucucccuacuaucuucccuaggggaaaaucggggagaaggucggauuuuucccuccaaacuucaucauucggguccgggcuggagaacgugugcaccgcgugacgagauccuucguggggaaccgcgagauagggcagaucacucucaagaaggaccagguaggcuguugccccaacccaaucccaggccugaaugcucccuagcccaccacacuccuuggagagcuuaaccauuaauaagacuagggugagccccuguaaaccccggcuccccugcuguccucuccuaccuuuuccuuugauuccucuccuacuucugauccuuuaaucuucuagaucguggugcagaaaggagacgaagcgggcggcuacgucaaggucuacaccggccgcaagguggggcuguuucccaccgacuuucuagaggaaauuuaggcgugcgggcgccugcaagcgggagacacccacaccccauucugggcgggcccaguggaguuuggggaggggggcgaaagcaacgggacugcugggagaggagggguaggaaggcccgccugagcgcgacggggcuuccgggaagggacugguucucgcccccuuccccagccuggggccucggauaccugcugcccagagcagcccggacccgaaaccuuucaggccccgcuugcaagagcuggaaaaaaacgcguaucuacuaggaggagccagggacuggggcggggggcgggggcgagggagggcgaacugucgaauguugcgaauuuauuaaacuuuugacaaaacuuag

SEQ ID NO: 16436 - RNA, 2233 nt, Homo sapiens
agggagaggacagagccacugcagaggaccagacugggaaaacaacgauauggcaggagccagucuuggggcccgcuucuaccggcagaucaaaagacauccgggggugaguccucagaaccucagaaccucuaacuccuaacucuccugcugccccacccuccaaaucccccaaugccuugccuugugcccaggucccucagcgcuccuauucuuccccuaagguugccccagucucucuccgaaacgucccugugucccacaaaucuacuaccuuggacacgaucgcuguagggugagggagaccaugccaggaaauaugguuguaggagauuccagggagggagcaccagacccggggugggguuggggugggcagaaaagcuuguaaagggugacugggaacugcggggagagggcugaccccaaaagugcucucccucuuccccgcagaucaucccgaugaucggcuuaaucugccugggcaugggcagcgcugcgcuuuacuugcugcgacucgcccuucgcagccccgacgucugguaaaggcacggcuugggaugcucacgggggccugggugaggcaagaugggguggaaauaggcggcccuaguggggaucccgugcccugcugcaugcaccuucgacuguaccgaccggcaucucagggcuggagcccacugcugaccugggagacccccguauccccuccagcccaccuggccgcucacuccucagcuuggcccgcccugaaaugcggaacccgcgccucucccggccggguugccaugacgacgccgcucagccagcggugggcuugggcuuuuggguaccucuaaguccucaccagagcacugggguuguggccgggugagcugcuggggguggcauuggggaccaguguggggcggagauuucacacccggccgcggagaggguccggaagugaaaggcgcacccauggcuuuauaauucccggcacaucaccagaaacccagccccuugggaucugugucugauucccacgacucugcucuuaggguuaaccuaggguggcaggcagcaagugggagucccugggccccguugucaguuugucacgcagccccaugcugacaauggugacaggcuucuugucucacuugucagcaccugcuaauaugaccguuccuuugucaguaucugggaaaugggacccccagggcaggaggcagggguacugggguggggccagagccuccggguggagcuugggggucaaauuggguuacagaguucugggucccagggaggagacccuaacccuccccccuccugcuccacagcugggacagaaagaacaacccggagcccuggaaccgccugagccccaaugaccaauacaagguaccucucgauggcucuaggguugccccccauccucuuaucuccugguccuggcacccacaacucccguacuagaagcaaagggaggcuugggguacucagcgcaacccccuuucccucuccucuuaguuccuugcaguuuccacugacuauaagaagcugaagaaggaccggccagacuucuaagccaggcugggcugccagugccaugcaagccacagccagccagcccauccacuucuuccacuccuccccgcaggccccaaggcaucacuccggccacccugucccgcuacugcuuacacaggccggguucccacgcagaggggaggcugcuccaccccuacucuccucccuugcucccagcagcggaagcgccucugacccuuggcuugagucccacgugggggaggaggaggcaggcagcaccagcagggguccaccaagagcccagaccagccccucugcccuccuacccgggccucgaaggguguggcacaggcuacguguugagcguggccuacgugagccaacaagaagcaggggccucugagugccaagcgacguggcgggcuccacguuagcccaggcucugagagccagcccaggggcggcgcugcucagcuugggcugguccagggccugcccaggcuggggcaccuuugccuccugaggcgcagcgcacuccuccccugcccaagccuacugccucccgcugccgccaguacccccuccagccccacaccugggccucccccugccacuccccucccuugcuccccucuguccccagggaucaaacagaagcagccgugggcaaaauacaauuucauuuaacaaauugaau

SEQ ID NO: 16437 - RNA, 2233 nt, Homo sapiens
auucaauuuguuaaaugaaauuguauuuugcccacggcugcuucuguuugaucccuggggacagaggggagcaagggaggggaguggcagggggaggcccagguguggggcuggaggggguacuggcggcagcgggaggcaguaggcuugggcaggggaggagugcgcugcgccucaggaggcaaaggugccccagccugggcaggcccuggaccagcccaagcugagcagcgccgccccugggcuggcucucagagccugggcuaacguggagcccgccacgucgcuuggcacucagaggccccugcuucuuguuggcucacguaggccacgcucaacacguagccugugccacacccuucgaggcccggguaggagggcagaggggcuggucugggcucuugguggaccccugcuggugcugccugccuccuccucccccacgugggacucaagccaagggucagaggcgcuuccgcugcugggagcaagggaggagaguagggguggagcagccuccccucugcgugggaacccggccuguguaagcaguagcgggacaggguggccggagugaugccuuggggccugcggggaggaguggaagaaguggaugggcuggcuggcuguggcuugcauggcacuggcagcccagccuggcuuagaagucuggccgguccuucuucagcuucuuauagucaguggaaacugcaaggaacuaagaggagagggaaaggggguugcgcugaguaccccaagccucccuuugcuucuaguacgggaguugugggugccaggaccaggagauaagaggauggggggcaacccuagagccaucgagagguaccuuguauuggucauuggggcucaggcgguuccagggcuccggguuguucuuucugucccagcuguggagcaggaggggggaggguuagggucuccucccugggacccagaacucuguaacccaauuugacccccaagcuccacccggaggcucuggccccaccccaguaccccugccuccugcccugggggucccauuucccagauacugacaaaggaacggucauauuagcaggugcugacaagugagacaagaagccugucaccauugucagcauggggcugcgugacaaacugacaacggggcccagggacucccacuugcugccugccacccuagguuaacccuaagagcagagucgugggaaucagacacagaucccaaggggcuggguuucuggugaugugccgggaauuauaaagccaugggugcgccuuucacuuccggacccucuccgcggccgggugugaaaucuccgccccacacugguccccaaugccacccccagcagcucacccggccacaaccccagugcucuggugaggacuuagagguacccaaaagcccaagcccaccgcuggcugagcggcgucgucauggcaacccggccgggagaggcgcggguuccgcauuucagggcgggccaagcugaggagugagcggccaggugggcuggaggggauacgggggucucccaggucagcagugggcuccagcccugagaugccggucgguacagucgaaggugcaugcagcagggcacgggauccccacuagggccgccuauuuccaccccaucuugccucacccaggcccccgugagcaucccaagccgugccuuuaccagacgucggggcugcgaagggcgagucgcagcaaguaaagcgcagcgcugcccaugcccaggcagauuaagccgaucaucgggaugaucugcggggaagagggagagcacuuuuggggucagcccucuccccgcaguucccagucacccuuuacaagcuuuucugcccaccccaaccccaccccgggucuggugcucccucccuggaaucuccuacaaccauauuuccuggcauggucucccucacccuacagcgaucguguccaagguaguagauuugugggacacagggacguuucggagagagacuggggcaaccuuaggggaagaauaggagcgcugagggaccugggcacaaggcaaggcauugggggauuuggaggguggggcagcaggagaguuaggaguuagagguucugagguucugaggacucacccccggaugucuuuugaucugccgguagaagcgggccccaagacuggcuccugccauaucguuguuuucccagucugguccucugcaguggcucuguccucucccu

SEQ ID NO: 16438 - RNA, 5960 nt, Homo sapiens
cugacuauaagaagcugaagaaggaccggccagacuucuaagccaggcugggcugccagugccaugcaagccacagccagccagcccauccacuucuuccacuccuccccgcaggccccaaggcaucacuccggccacccugucccgcuacugcuuacacaggccggguucccacgcagaggggaggcugcuccaccccuacucuccucccuugcucccagcagcggaagcgccucugacccuuggcuugagucccacgugggggaggaggaggcaggcagcaccagcagggguccaccaagagcccagaccagccccucugcccuccuacccgggccucgaaggguguggcacaggcuacguguugagcguggccuacgugagccaacaagaagcaggggccucugagugccaagcgacguggcgggcuccacguuagcccaggcucugagagccagcccaggggcggcgcugcucagcuugggcugguccagggccugcccaggcuggggcaccuuugccuccugaggcgcagcgcacuccuccccugcccaagccuacugccucccgcugccgccaguacccccuccagccccacaccugggccucccccugccacuccccucccuugcuccccucuguccccagggaucaaacagaagcagccgugggcaaaauacaauuucauuuaacaaauugaauuugcugcgccugcuaaucacgucuggugucggcucugaucagagacagaaagaggaggcugcagccccggggguccuugugguagcgguggugggagcggagcgguguacacauugagggagacaaaucacuguuuggcccaggggaaccccacccacaguaauggaaacucagggcagguuagcauuuuauuagauaaaaacaggaaggagggugccuacccaccccugccugcuacuggcucugaagggcacuccucaacuuccccaagaaagaggacgcgucucugacacugugaucaugacagggguucaaacagaaagugccugggcccuccuucuaagucuuguuaccaaaaaaaggaaaaagaaaagaucuucucaguuacaaauucugggaagggagacuauaccuggcucuugcccuaagugagaggucuucccucccgcaccaaaaaauagaaaggcuuucuauuucacuggcccagguagggggaaggagaguaacuuugagucugugggccucauuucccaggugccuucaaugcucaucaaaaccaggcauggggaaggcccuggcaaacugcuccacccguugccugagguuggccagacgcugacuuguuucugaguccuuaagcaggaaggauuugaaauccuggagcuuggcuagagagagagggugaggaaacaaguggucagagcucuagggaaggcagugagaucagcugggggagggagcagacagugagugggaacuggcuggcccggggcuccuucuugcucacucaccagucuugcucuucaccucuaagccaauguugaccccuucaucuauaaaguccacaacucuccggaagucauccucacggaacugucgagaaguuaaggcuggggccccuggaacgaggcacaaggggagggaugagcauagcccaaggucaccuggcagucauccagcaugggagccccuucccuccucaaaccccaggucucaccaagccgcaggccgcccggugugauggcacuucggucuccaggacagguguucuuguuggcagugauggauacaagcucuagcacccgcucagcccgagcuccauccaggcccuugggccgcagguccaccagcaccaggugguugucaguaccaccuaagguggguaagaaauggggaguggugaguccugggccucugccugaagcuacagaggcccucacccaucaccugcuggcuuaccugauaccagugaguagccucgcucuagcagggcaucugccauggcccgagcauucuucagaaccugcagggaguacucccggaacaugggggugcaggccuggagaugagacaguagcagcugucacccuaggccuggacccaagcccugcacuacccucuggcccugcacccucagcauagcucugugaccccagccuugacuccuuccauccuggcauuucccuuccaucagccccagcaucaguuagcaaggugcagggucuaagccuccaggccauugcccccccacacccuacaaagacaggauccccaaccugcuuuagggccacagcuacugcagcaauggcaugauugugggggccccccugcagggaugggaacacggcaaaguugauucgguccucaaauguguaagggaucucccggccagucuugggguccacagccuucaccccuuuccgguagaagaugagcccugaccugugugagagguggauggucagagucuaagcugaaaagaaggacaagggacagagaaggcagaggaagcuggcggaccugggccccaagggcacagcucacgugggcuugguacacuggauuccagugguagagggaaucagccccucaaucccauccacaaauccccugccagggcauggccaccaugggcaagagaaggagaacucucacagacugggcaggagucuuaagggcugcaggugggaaugaauuccucucagguccaggccaacagugccccaggaauaggccugaaggcagggaaaggcaaggcccgaccucagggagccugaccuggccccucgaagagucuugugaguagugguggugacgauguccgcgugcuugaaaggcgagggaaucaccuuggcagccaccaggccacugaugugggccaugucugccagcaggugugcuuugacuucaucacacaccugggcagguacagaggcaaggccucagccuggggagggcccggagaggccugcccaaggcugcccuccucccacaccuccucaccacccccuggggaggugcccagucuccagccccccccaccaaccucucucaugcgggcguagucaaugaggcgagcauaggcgcuggugccagcuaugaugagccguggccggaaaagucgagcagucagugccagcugguuguagucaaugaggccaguuuugggcuggacagacacacaaacagcuaaagcccugagaaggaagcagggcagcucacucuccuccuuaacccuaaggacggcccggcgcuccaggcccucagcuucuccaggggaggaccaccaccagggccaagagccccuccccacacccuagagcacucacguugagcuuauagggcauagacucgaagaagauggacguggcugauauccgcuugacgucagacauguagccgugggugagacugcgaagugagaggaaguaagaaggccuggguggaaggacccccggacuuaaccacucccuucaacuccacaguucucuguccccagaacaccaguccuaggacacaccgccucacugcucuguccacucugugguaggcacuauaacugggaucuuaucuuccucauccacugugacaugcaggacagggcaaggccuguuccaucuguaugguccacaguagguauucaauaaauaacuccuuucccacaccaauccugccgccaagaccaucagccagcccauccauacucacuggcccccaucgggcagguccagccccaugauccggucgugagguugcagaagggcuguguagacggccagguuggcuggggacccggaguagggcuggacauugacuccccacugugcaggauccaggucaaaggcuuccaaggcccggcgcuggcacagcagcucaauuucauccaccaccucugcucccccauaguaucugccgugggagagggguaaugagggcacagagaaaggacucucaaccaucagcaaaggacugggaaguucacuccucaaugaacacugggaagguacagguggguucccccacugggagcaccaucccugacacugcccuccagcccucaccucuugccaggauaacccuccgaguacuuguuguucagacaggaccccagggccuccagcgcagcucggcugcagaaguucuggggugguggggggcaaugucagaagguauugagccccuuccccuggacucccacagucccucccugccagagccagagcugaaagcgggaguacucccugcagaaagcuccauucacucagcaccaggccuggggcaaagccagaggcagcauucucagaaacccaucugccaugagcaguggccccucaaugccaccuacccacucaaacuugugcuucuaggcuccuccuuccucauaggaggaaggaaggaagggaucagaugaaacuguagggacccuggaggcucccuaaaugucccaaccccauaaacuggacuugcacugccuuugcuugagggagauaagaaaggaagauaaagcccaaagaaagguccugagugugaaaggggguuuuggagaaauaucaguuaagauaacuuuguuacuuccuguacccaugguggcccaaccccugcccaucuccccaggucccaccucugaggcaaugagcuccaggccacgacacugccuguccuucucccucugcagcaacucccacaucucaggaucacuguccgacaggcucuccuggccuguccagccccuguuugcuuccccagucugagucugggcugcguugcugugcugagcccgaauggccauccugaccagcugcccacaucucugcagaggcugaaggcaggaaaagucagggugaaaucacaacaguccagacaaaucgucucccggccacccucacucaugcuucuaaggccacaccaagcugccaguuguccagccagccuguuucaguucucacuacccccaccuccaccuucaaaagccaguucuggagccaagcuugagaucaacguccaaggggugguucugauuugcuccauucaccgcaccgcaccucagaaaucucccaccaccucacuccaugaaccacucugcaaagcuuguccuccaaaagccuaugucuccccaacuccagagagggcaacugagauuccagaaccuucccacccacaggaacaagagggucuuccugcagggcaccauaaacugauaccccagucagcgggggaagaggcagaguuggcaagggcugaggccacagauuguagagcaaugcaggugggaggggagaccuuuagcaguccgugaggaagagcugugugggagugguggggguggggaucugcccgagaguaagccaauacccuuuccccuuacuuagcccccuacccguuccaccuccuuccagcccucacugccgccgggaccccugccugaugcaagcagugaagcucgguugcaucaucugcagggcucagagcuggccggaaaggcucagcuugugagaccaggccgaaaacuccgcucauuugccagcaccggguccgcggggcauccggggcuguccucuccccuaaugccacgugaaaugggcggucacgaggcccuggggcgucugaucgccagaaugaggacaggcucgcaguuaacuccacgcgcgcccaggggucuuggggauuccccaguuacacguccgcucccugaggccccaauccacgugcauggaaaagccaagagaaccccagaguuugugacuaggaacuaagguaggagaagagcuuccuuuccacugauuacccagcguuuggagccccauucuuacccgagccgcccaaaacaaagagaaguacagcaucgcaacucggaagucgcaggagguccagccaccaacucuggucuagggcagcaagcugucggaagaagaccguucggagaacgcaugcgcgagaagagcucgcugaggcgccaaagcuaacgggagggaucuacg

SEQ ID NO: 16439 - RNA, 5960 nt, Homo sapiens
cguagaucccucccguuagcuuuggcgccucagcgagcucuucucgcgcaugcguucuccgaacggucuucuuccgacagcuugcugcccuagaccagaguugguggcuggaccuccugcgacuuccgaguugcgaugcuguacuucucuuuguuuugggcggcucggguaagaauggggcuccaaacgcuggguaaucaguggaaaggaagcucuucuccuaccuuaguuccuagucacaaacucugggguucucuuggcuuuuccaugcacguggauuggggccucagggagcggacguguaacuggggaauccccaagaccccugggcgcgcguggaguuaacugcgagccuguccucauucuggcgaucagacgccccagggccucgugaccgcccauuucacguggcauuaggggagaggacagccccggaugccccgcggacccggugcuggcaaaugagcggaguuuucggccuggucucacaagcugagccuuuccggccagcucugagcccugcagaugaugcaaccgagcuucacugcuugcaucaggcaggggucccggcggcagugagggcuggaaggagguggaacggguagggggcuaaguaaggggaaaggguauuggcuuacucucgggcagauccccacccccaccacucccacacagcucuuccucacggacugcuaaaggucuccccucccaccugcauugcucuacaaucuguggccucagcccuugccaacucugccucuucccccgcugacugggguaucaguuuauggugcccugcaggaagacccucuuguuccugugggugggaagguucuggaaucucaguugcccucucuggaguuggggagacauaggcuuuuggaggacaagcuuugcagagugguucauggagugagguggugggagauuucugaggugcggugcggugaauggagcaaaucagaaccaccccuuggacguugaucucaagcuuggcuccagaacuggcuuuugaagguggagguggggguagugagaacugaaacaggcuggcuggacaacuggcagcuugguguggccuuagaagcaugagugaggguggccgggagacgauuugucuggacuguugugauuucacccugacuuuuccugccuucagccucugcagagaugugggcagcuggucaggauggccauucgggcucagcacagcaacgcagcccagacucagacuggggaagcaaacaggggcuggacaggccaggagagccugucggacagugauccugagaugugggaguugcugcagagggagaaggacaggcagugucguggccuggagcucauugccucagaggugggaccuggggagaugggcagggguugggccaccauggguacaggaaguaacaaaguuaucuuaacugauauuucuccaaaacccccuuucacacucaggaccuuucuuugggcuuuaucuuccuuucuuaucucccucaagcaaaggcagugcaaguccaguuuaugggguugggacauuuagggagccuccagggucccuacaguuucaucugaucccuuccuuccuuccuccuaugaggaaggaggagccuagaagcacaaguuugaguggguagguggcauugaggggccacugcucauggcagauggguuucugagaaugcugccucuggcuuugccccaggccuggugcugagugaauggagcuuucugcagggaguacucccgcuuucagcucuggcucuggcagggagggacugugggaguccaggggaaggggcucaauaccuucugacauugccccccaccaccccagaacuucugcagccgagcugcgcuggaggcccugggguccugucugaacaacaaguacucggaggguuauccuggcaagaggugagggcuggagggcagugucagggauggugcucccagugggggaacccaccuguaccuucccaguguucauugaggagugaacuucccaguccuuugcugaugguugagaguccuuucucugugcccucauuaccccucucccacggcagauacuaugggggagcagaggugguggaugaaauugagcugcugugccagcgccgggccuuggaagccuuugaccuggauccugcacaguggggagucaauguccagcccuacuccggguccccagccaaccuggccgucuacacagcccuucugcaaccucacgaccggaucauggggcuggaccugcccgaugggggccagugaguauggaugggcuggcugauggucuuggcggcaggauuggugugggaaaggaguuauuuauugaauaccuacuguggaccauacagauggaacaggccuugcccuguccugcaugucacaguggaugaggaagauaagaucccaguuauagugccuaccacagaguggacagagcagugaggcgguguguccuaggacugguguucuggggacagagaacuguggaguugaagggagugguuaaguccggggguccuuccacccaggccuucuuacuuccucucacuucgcagucucacccacggcuacaugucugacgucaagcggauaucagccacguccaucuucuucgagucuaugcccuauaagcucaacgugagugcucuaggguguggggaggggcucuuggcccugguggugguccuccccuggagaagcugagggccuggagcgccgggccguccuuaggguuaaggaggagagugagcugcccugcuuccuucucagggcuuuagcuguuugugugucuguccagcccaaaacuggccucauugacuacaaccagcuggcacugacugcucgacuuuuccggccacggcucaucauagcuggcaccagcgccuaugcucgccucauugacuacgcccgcaugagagagguugguggggggggcuggagacugggcaccuccccaggggguggugaggaggugugggaggagggcagccuugggcaggccucuccgggcccuccccaggcugaggccuugccucuguaccugcccaggugugugaugaagucaaagcacaccugcuggcagacauggcccacaucaguggccugguggcugccaaggugauucccucgccuuucaagcacgcggacaucgucaccaccacuacucacaagacucuucgaggggccaggucaggcucccugaggucgggccuugccuuucccugccuucaggccuauuccuggggcacuguuggccuggaccugagaggaauucauucccaccugcagcccuuaagacuccugcccagucugugagaguucuccuucucuugcccaugguggccaugcccuggcaggggauuuguggaugggauugaggggcugauucccucuaccacuggaauccaguguaccaagcccacgugagcugugcccuuggggcccagguccgccagcuuccucugccuucucugucccuuguccuucuuuucagcuuagacucugaccauccaccucucacacaggucagggcucaucuucuaccggaaaggggugaaggcuguggaccccaagacuggccgggagaucccuuacacauuugaggaccgaaucaacuuugccguguucccaucccugcaggggggcccccacaaucaugccauugcugcaguagcuguggcccuaaagcagguuggggauccugucuuuguagggugugggggggcaauggccuggaggcuuagacccugcaccuugcuaacugaugcuggggcugauggaagggaaaugccaggauggaaggagucaaggcuggggucacagagcuaugcugagggugcagggccagaggguagugcagggcuuggguccaggccuagggugacagcugcuacugucucaucuccaggccugcacccccauguuccgggaguacucccugcagguucugaagaaugcucgggccauggcagaugcccugcuagagcgaggcuacucacugguaucagguaagccagcaggugaugggugagggccucuguagcuucaggcagaggcccaggacucaccacuccccauuucuuacccaccuuaggugguacugacaaccaccuggugcugguggaccugcggcccaagggccuggauggagcucgggcugagcgggugcuagagcuuguauccaucacugccaacaagaacaccuguccuggagaccgaagugccaucacaccgggcggccugcggcuuggugagaccugggguuugaggagggaaggggcucccaugcuggaugacugccaggugaccuugggcuaugcucaucccuccccuugugccucguuccaggggccccagccuuaacuucucgacaguuccgugaggaugacuuccggagaguuguggacuuuauagaugaaggggucaacauuggcuuagaggugaagagcaagacuggugagugagcaagaaggagccccgggccagccaguucccacucacugucugcucccucccccagcugaucucacugccuucccuagagcucugaccacuuguuuccucacccucucucucuagccaagcuccaggauuucaaauccuuccugcuuaaggacucagaaacaagucagcgucuggccaaccucaggcaacggguggagcaguuugccagggccuuccccaugccugguuuugaugagcauugaaggcaccugggaaaugaggcccacagacucaaaguuacucuccuucccccuaccugggccagugaaauagaaagccuuucuauuuuuuggugcgggagggaagaccucucacuuagggcaagagccagguauagucucccuucccagaauuuguaacugagaagaucuuuucuuuuuccuuuuuuugguaacaagacuuagaaggagggcccaggcacuuucuguuugaaccccugucaugaucacagugucagagacgcguccucuuucuuggggaaguugaggagugcccuucagagccaguagcaggcagggguggguaggcacccuccuuccuguuuuuaucuaauaaaaugcuaaccugcccugaguuuccauuacugugggugggguuccccugggccaaacagugauuugucucccucaauguguacaccgcuccgcucccaccaccgcuaccacaaggacccccggggcugcagccuccucuuucugucucugaucagagccgacaccagacgugauuagcaggcgcagcaaauucaauuuguuaaaugaaauuguauuuugcccacggcugcuucuguuugaucccuggggacagaggggagcaagggaggggaguggcagggggaggcccagguguggggcuggaggggguacuggcggcagcgggaggcaguaggcuugggcaggggaggagugcgcugcgccucaggaggcaaaggugccccagccugggcaggcccuggaccagcccaagcugagcagcgccgccccugggcuggcucucagagccugggcuaacguggagcccgccacgucgcuuggcacucagaggccccugcuucuuguuggcucacguaggccacgcucaacacguagccugugccacacccuucgaggcccggguaggagggcagaggggcuggucugggcucuugguggaccccugcuggugcugccugccuccuccucccccacgugggacucaagccaagggucagaggcgcuuccgcugcugggagcaagggaggagaguagggguggagcagccuccccucugcgugggaacccggccuguguaagcaguagcgggacaggguggccggagugaugccuuggggccugcggggaggaguggaagaaguggaugggcuggcuggcuguggcuugcauggcacuggcagcccagccuggcuuagaagucuggccgguccuucuucagcuucuuauagucag

SEQ ID NO: 16440 - RNA, 3841 nt, Homo sapiens
ggcagguuagcauuuuauuagauaaaaacaggaaggagggugccuacccaccccugccugcuacuggcucugaagggcacuccucaacuuccccaagaaagaggacgcgucucugacacugugaucaugacagggguucaaacagaaagugccugggcccuccuucuaagucuuguuaccaaaaaaaggaaaaagaaaagaucuucucaguuacaaauucugggaagggagacuauaccuggcucuugcccuaagugagaggucuucccucccgcaccaaaaaauagaaaggcuuucuauuucacuggcccagguagggggaaggagaguaacuuugagucugugggccucauuucccaggugccuucaaugcucaucaaaaccaggcauggggaaggcccuggcaaacugcuccacccguugccugagguuggccagacgcugacuuguuucugaguccuuaagcaggaaggauuugaaauccuggagcuuggcuagagagagagggugaggaaacaaguggucagagcucuagggaaggcagugagaucagcugggggagggagcagacagugagugggaacuggcuggcccggggcuccuucuugcucacucaccagucuugcucuucaccucuaagccaauguugaccccuucaucuauaaaguccacaacucuccggaagucauccucacggaacugucgagaaguuaaggcuggggccccuggaacgaggcacaaggggagggaugagcauagcccaaggucaccuggcagucauccagcaugggagccccuucccuccucaaaccccaggucucaccaagccgcaggccgcccggugugauggcacuucggucuccaggacagguguucuuguuggcagugauggauacaagcucuagcacccgcucagcccgagcuccauccaggcccuugggccgcagguccaccagcaccaggugguugucaguaccaccuaagguggguaagaaauggggaguggugaguccugggccucugccugaagcuacagaggcccucacccaucaccugcuggcuuaccugauaccagugaguagccucgcucuagcagggcaucugccauggcccgagcauucuucagaaccugcagggaguacucccggaacaugggggugcaggccuggagaugagacaguagcagcugucacccuaggccuggacccaagcccugcacuacccucuggcccugcacccucagcauagcucugugaccccagccuugacuccuuccauccuggcauuucccuuccaucagccccagcaucaguuagcaaggugcagggucuaagccuccaggccauugcccccccacacccuacaaagacaggauccccaaccugcuuuagggccacagcuacugcagcaauggcaugauugugggggccccccugcagggaugggaacacggcaaaguugauucgguccucaaauguguaagggaucucccggccagucuugggguccacagccuucaccccuuuccgguagaagaugagcccugaccugugugagagguggauggucagagucuaagcugaaaagaaggacaagggacagagaaggcagaggaagcuggcggaccugggccccaagggcacagcucacgugggcuugguacacuggauuccagugguagagggaaucagccccucaaucccauccacaaauccccugccagggcauggccaccaugggcaagagaaggagaacucucacagacugggcaggagucuuaagggcugcaggugggaaugaauuccucucagguccaggccaacagugccccaggaauaggccugaaggcagggaaaggcaaggcccgaccucagggagccugaccuggccccucgaagagucuugugaguagugguggugacgauguccgcgugcuugaaaggcgagggaaucaccuuggcagccaccaggccacugaugugggccaugucugccagcaggugugcuuugacuucaucacacaccugggcagguacagaggcaaggccucagccuggggagggcccggagaggccugcccaaggcugcccuccucccacaccuccucaccacccccuggggaggugcccagucuccagccccccccaccaaccucucucaugcgggcguagucaaugaggcgagcauaggcgcuggugccagcuaugaugagccguggccggaaaagucgagcagucagugccagcugguuguagucaaugaggccaguuuugggcuggacagacacacaaacagcuaaagcccugagaaggaagcagggcagcucacucuccuccuuaacccuaaggacggcccggcgcuccaggcccucagcuucuccaggggaggaccaccaccagggccaagagccccuccccacacccuagagcacucacguugagcuuauagggcauagacucgaagaagauggacguggcugauauccgcuugacgucagacauguagccgugggugagacugcgaagugagaggaaguaagaaggccuggguggaaggacccccggacuuaaccacucccuucaacuccacaguucucuguccccagaacaccaguccuaggacacaccgccucacugcucuguccacucugugguaggcacuauaacugggaucuuaucuuccucauccacugugacaugcaggacagggcaaggccuguuccaucuguaugguccacaguagguauucaauaaauaacuccuuucccacaccaauccugccgccaagaccaucagccagcccauccauacucacuggcccccaucgggcagguccagccccaugauccggucgugagguugcagaagggcuguguagacggccagguuggcuggggacccggaguagggcuggacauugacuccccacugugcaggauccaggucaaaggcuuccaaggcccggcgcuggcacagcagcucaauuucauccaccaccucugcucccccauaguaucugccgugggagagggguaaugagggcacagagaaaggacucucaaccaucagcaaaggacugggaaguucacuccucaaugaacacugggaagguacagguggguucccccacugggagcaccaucccugacacugcccuccagcccucaccucuugccaggauaacccuccgaguacuuguuguucagacaggaccccagggccuccagcgcagcucggcugcagaaguucuggggugguggggggcaaugucagaagguauugagccccuuccccuggacucccacagucccucccugccagagccagagcugaaagcgggaguacucccugcagaaagcuccauucacucagcaccaggccuggggcaaagccagaggcagcauucucagaaacccaucugccaugagcaguggccccucaaugccaccuacccacucaaacuugugcuucuaggcuccuccuuccucauaggaggaaggaaggaagggaucagaugaaacuguagggacccuggaggcucccuaaaugucccaaccccauaaacuggacuugcacugccuuugcuugagggagauaagaaaggaagauaaagcccaaagaaagguccugagugugaaaggggguuuuggagaaauaucaguuaagauaacuuuguuacuuccuguacccaugguggcccaaccccugcccaucuccccaggucccaccucugaggcaaugagcuccaggccacgacacugccuguccuucucccucugcagcaacucccacaucucaggaucacuguccgacaggcucuccuggccuguccagccccuguu

SEQ ID NO: 16441 - RNA, 3841 nt, Homo sapiens
aacaggggcuggacaggccaggagagccugucggacagugauccugagaugugggaguugcugcagagggagaaggacaggcagugucguggccuggagcucauugccucagaggugggaccuggggagaugggcagggguugggccaccauggguacaggaaguaacaaaguuaucuuaacugauauuucuccaaaacccccuuucacacucaggaccuuucuuugggcuuuaucuuccuuucuuaucucccucaagcaaaggcagugcaaguccaguuuaugggguugggacauuuagggagccuccagggucccuacaguuucaucugaucccuuccuuccuuccuccuaugaggaaggaggagccuagaagcacaaguuugaguggguagguggcauugaggggccacugcucauggcagauggguuucugagaaugcugccucuggcuuugccccaggccuggugcugagugaauggagcuuucugcagggaguacucccgcuuucagcucuggcucuggcagggagggacugugggaguccaggggaaggggcucaauaccuucugacauugccccccaccaccccagaacuucugcagccgagcugcgcuggaggcccugggguccugucugaacaacaaguacucggaggguuauccuggcaagaggugagggcuggagggcagugucagggauggugcucccagugggggaacccaccuguaccuucccaguguucauugaggagugaacuucccaguccuuugcugaugguugagaguccuuucucugugcccucauuaccccucucccacggcagauacuaugggggagcagaggugguggaugaaauugagcugcugugccagcgccgggccuuggaagccuuugaccuggauccugcacaguggggagucaauguccagcccuacuccggguccccagccaaccuggccgucuacacagcccuucugcaaccucacgaccggaucauggggcuggaccugcccgaugggggccagugaguauggaugggcuggcugauggucuuggcggcaggauuggugugggaaaggaguuauuuauugaauaccuacuguggaccauacagauggaacaggccuugcccuguccugcaugucacaguggaugaggaagauaagaucccaguuauagugccuaccacagaguggacagagcagugaggcgguguguccuaggacugguguucuggggacagagaacuguggaguugaagggagugguuaaguccggggguccuuccacccaggccuucuuacuuccucucacuucgcagucucacccacggcuacaugucugacgucaagcggauaucagccacguccaucuucuucgagucuaugcccuauaagcucaacgugagugcucuaggguguggggaggggcucuuggcccugguggugguccuccccuggagaagcugagggccuggagcgccgggccguccuuaggguuaaggaggagagugagcugcccugcuuccuucucagggcuuuagcuguuugugugucuguccagcccaaaacuggccucauugacuacaaccagcuggcacugacugcucgacuuuuccggccacggcucaucauagcuggcaccagcgccuaugcucgccucauugacuacgcccgcaugagagagguugguggggggggcuggagacugggcaccuccccaggggguggugaggaggugugggaggagggcagccuugggcaggccucuccgggcccuccccaggcugaggccuugccucuguaccugcccaggugugugaugaagucaaagcacaccugcuggcagacauggcccacaucaguggccugguggcugccaaggugauucccucgccuuucaagcacgcggacaucgucaccaccacuacucacaagacucuucgaggggccaggucaggcucccugaggucgggccuugccuuucccugccuucaggccuauuccuggggcacuguuggccuggaccugagaggaauucauucccaccugcagcccuuaagacuccugcccagucugugagaguucuccuucucuugcccaugguggccaugcccuggcaggggauuuguggaugggauugaggggcugauucccucuaccacuggaauccaguguaccaagcccacgugagcugugcccuuggggcccagguccgccagcuuccucugccuucucugucccuuguccuucuuuucagcuuagacucugaccauccaccucucacacaggucagggcucaucuucuaccggaaaggggugaaggcuguggaccccaagacuggccgggagaucccuuacacauuugaggaccgaaucaacuuugccguguucccaucccugcaggggggcccccacaaucaugccauugcugcaguagcuguggcccuaaagcagguuggggauccugucuuuguagggugugggggggcaauggccuggaggcuuagacccugcaccuugcuaacugaugcuggggcugauggaagggaaaugccaggauggaaggagucaaggcuggggucacagagcuaugcugagggugcagggccagaggguagugcagggcuuggguccaggccuagggugacagcugcuacugucucaucuccaggccugcacccccauguuccgggaguacucccugcagguucugaagaaugcucgggccauggcagaugcccugcuagagcgaggcuacucacugguaucagguaagccagcaggugaugggugagggccucuguagcuucaggcagaggcccaggacucaccacuccccauuucuuacccaccuuaggugguacugacaaccaccuggugcugguggaccugcggcccaagggccuggauggagcucgggcugagcgggugcuagagcuuguauccaucacugccaacaagaacaccuguccuggagaccgaagugccaucacaccgggcggccugcggcuuggugagaccugggguuugaggagggaaggggcucccaugcuggaugacugccaggugaccuugggcuaugcucaucccuccccuugugccucguuccaggggccccagccuuaacuucucgacaguuccgugaggaugacuuccggagaguuguggacuuuauagaugaaggggucaacauuggcuuagaggugaagagcaagacuggugagugagcaagaaggagccccgggccagccaguucccacucacugucugcucccucccccagcugaucucacugccuucccuagagcucugaccacuuguuuccucacccucucucucuagccaagcuccaggauuucaaauccuuccugcuuaaggacucagaaacaagucagcgucuggccaaccucaggcaacggguggagcaguuugccagggccuuccccaugccugguuuugaugagcauugaaggcaccugggaaaugaggcccacagacucaaaguuacucuccuucccccuaccugggccagugaaauagaaagccuuucuauuuuuuggugcgggagggaagaccucucacuuagggcaagagccagguauagucucccuucccagaauuuguaacugagaagaucuuuucuuuuuccuuuuuuugguaacaagacuuagaaggagggcccaggcacuuucuguuugaaccccugucaugaucacagugucagagacgcguccucuuucuuggggaaguugaggagugcccuucagagccaguagcaggcagggguggguaggcacccuccuuccuguuuuuaucuaauaaaaugcuaaccugcc

SEQ ID NO: 16442 - RNA, 34116 nt, Homo sapiens
cacagacagccgagagccugggugcacgugcccucagugggcacgaguacaugccccagcgccccccaccacagaccugcagcuuucccaggugucucccaugcgcccuggggcucacuacugcacccgugaucucagggcccucagacucgaaucucucagaaacacuccucaaagcccacggugcccugccuaaaagcacacacauccucaacggcacaccugccgaaaaccccaugcaccuggcccucccacagcagccauccccaugcccuccccacuggcugcaagccgcugugccugccgugacugagcagaggcuugggagcuccaugaagucagugaaugggugggugcacucugggugcaugcacagcagagaacacucuccagcccugcgcccacccugucccugcucaggugaacucucuccaugccgaaucaacaacgguggcugccaggaccugugucugcucacucaccagggccaugucaacugcucaugccgagggggccgaauccuccaggaugaccucaccugccgaggugagagaggcgggggggaggggcuggcggggaacccaagcacacaccagggauggugaccaucuccccuacaugcuccagcccagccccccaaagccuuuugccaagaagacgcugaugaugaccucagcuccccgggggaggaggcgugggcacuggggcccacagcgcuggcucagaaagcucccuccaccucccuccccagcggugaauuccucuugccgagcacaagaugaguuugagugugccaauggcgagugcaucaacuucagccugaccugcgacggcgucccccacugcaaggacaaguccgaugagaagccauccuacugcaguaaggagcccccugcagccccugccucuuccaggcccagagcccagguccuccucccccaggccccugcaggauggagcaggaucaggacccagcuuccugaccaugaguuuugggagcucaugaagggcagaaccacuguuagccuggacugggccuuuggguuuggggguggccagcuggacacgugcaugacgucucagggaggcagcccuuucccugugccuguggcugacacgcagccuacuccuccauuugcagacucccgccgcugcaagaagacuuuccggcagugcagcaaugggcgcuguguguccaacaugcuguggugcaacggggccgacgacuguggggauggcucugacgagaucccuugcaacagugagugaggcgcacuggcauaacccaucuguaccucaguuccugccccaccccucccuggccaagcuuugucccugggccccguggugucugguucaaggcacucugugacaggccagggcaggugcugugggccaggagcucuguccugcguccuucuggcccccacagagaaaacucuggccugacgauacggggcgggcacuguucuagagacagccuguggugugggcgaguuccgcugccgggacgggaccugcaucgggaacuccagccgcugcaaccaguuuguggauugugaggacgccucagaugagaugaacugcagugagugacgcccuuugcuggcaccuccugggcuccuccccaucgcucacugcaucucccgccuucaggcccuccugcaccugcccacauuccucucugccuucccucauccccgcugacagccuccaucucccugaggcccuguccccaucccgcuccugcuccugggcucucgugggguuccgagagggggcagugagcagauggugcagacagugccccaccagaagggcaccguucaacuuuuggaaacacaugaaggcuccauagggcuggcagcugccccagucgggggugauccagggggaaccagguaucacccucaccccugcccccaccaggugccaccgacugcagcagcuacuuccgccugggcgugaagggcgugcucuuccagcccugcgagcggaccucacucugcuacgcacccagcugggugugugauggcgccaaugacuguggggacuacagugaugagcgcgacugcccaggugggcgggggcagguguguggugggugguggccugcggugagcagggcccucacaccugccucgccccccaggugugaaacgccccagaugcccucugaauuacuucgccugcccuagugggcgcugcauccccaugagcuggacgugugacaaagaggaugacugugaacauggcgaggacgagacccacugcagugagugaccacugcacccacucagugcuccaagagccugcugggccccacuucuuagucccccccagcaaaugcccccuuggaaaagggcauccagagccuucaacccccugccccacaccccaacucuugaggucagacucagagacucugccucuagcugcugcugagcccccccacagaggggugcugugggcaucucuccuguccuucccauggcaucagccuccccaggugggugacccccacccuuccccaucuaacuguggcuucugacugccccagacaaguucugcucagaggcccaguuugagugccagaaccaucgcugcaucuccaagcaguggcugugugacggcagcgaugacuguggggauggcucagacgaggcugcucacugugguaaggaagcugggauugggccgggggaggugccccagggagggacagaccccacccaacuccaccccacacacagacaccccugcagacgacggcgaaccaucaccuccacugcuagaccugaucuacccgcuccuaagucucucaguggcccucucucccccuacagaaggcaagacgugcggccccuccuccuucuccugcccuggcacccacgugugcguccccgagcgcuggcucugugacggugacaaagacugugcugauggugcagacgagagcaucgcagcugguugcugugaguggcggggccacguggagcggguggacagcaaauggccacagucucacuuugcagauggggaagccggggugcaggagaggaaaugccucagcgggguccacugggggcggagccauagcuguagcccagguguccagacuccucauccagugcccugcccacucuaccaggagaaccacaggagguuagagugagggacggucggccgcuggccaggcagggcugaagggcuguguccaccucuguccacaguguacaacagcacuugugacgaccgugaguucaugugccagaaccgccagugcauccccaagcacuucgugugugaccacgaccgugacugugcagauggcucugaugagucccccgaguguggugagccuucggcgguggugggaggaggcccugcccucugccgggccagggcaucagccucacagguccauuccucccccagaguacccgaccugcggccccagugaguuccgcugugccaaugggcgcugucugagcucccgccagugggagugugauggcgagaaugacugccacgaccagagugacgaggcucccaagaacccacacugcaccagccaaggugggccccagaccuggcuccccucugcccccuccccagacugccugagaccccgcugaccugccgccuccgccccuccgcagagcacaagugcaaugccucgucacaguuccugugcagcagugggcgcuguguggcugaggcacugcucugcaacggccaggaugacuguggcgacagcucggacgagcguggcugccacaucaaugagugucucagccgcaagcucaguggcugcagccaggacugugaggaccucaagaucggcuucaagguaugcccagcccuggggaggagcuuccacaccccagacgugccaggaacgccuuucuccacugccuuauucauucauucauccccuagacaguggggauacagcagugaaugagacagaaaucugcuugguuggggucugccucuaucuggcagguagagagccagcagauuugcugacagaugagauaugcagugugagaggaagagaggagugaggcaucaaguaggcaagagauacacaggucuggaguucaaggagaggcccaggcuggagagggaagucugggaguuaucaccauagagaugcuauuugaaucugugagccuggauaugauucccaagggagcaguguagguggagaagagaggaguccaaagucugagccccgagcugagcaacagccaggagcagggaagugaggggaccagcagaagagccugagaaggagcagcugcugaggcaggagaacagccacgagaagaaagcauuuccauggggagggcacacgcagcucugucaaaugacacucgggggcacacagaaggaggccugcacugugggccagcugggugggcucaguacccauaugcugcugccccuagugaggccggguagagggaauuggagucucugagccaggucuccagggugggaggcccagacccugccacaugcccagcccaaggcucccugugccugcagugccgcugucgcccuggcuuccggcugaaggacgacggccggacgugugcugauguggacgagugcagcaccaccuuccccugcagccagcgcugcaucaacacucauggcagcuauaagugucuguguguggagggcuaugcaccccgcggcggcgacccccacagcugcaaggcugugacuggugagaugcgcgcuuggagggcaugaggugacccaggcugugugggacugcccggguggcagagcuccagacaggcaggagaccagggccgcuagaaugugccaggagcugaggcaagauccucugucugcagacgaggaaccguuucugaucuucgccaaccgguacuaccugcgcaagcucaaccuggacggguccaacuacacguuacuuaagcagguaccaaacccaggcccuccuccccgcugcccaucucccagacccagcacagccucccuugcaagucuccccgcuuagguccaaccaucccucccccagaugcaaauguggccccuguugccacaaccgacuucugcuguccuucacuccccaaauccagggccugaacaacgccguugccuuggauuuugacuaccgagagcagaugaucuacuggacagaugugaccacccagggcagcaugauccgaaggaugcaccuuaacgggagcaaugugcaggugaggcgggcggcccucggcgaccaacacuggcccgccucagaugacuguuuucagaucgucucuccuucccgccccaccaacccaaauugcuuccuucucacuccacuagucacuauaugacugcuuguucuagcugcucacucuccucugggcccagacagcaaggacugggagauuccucuugcccuuccccucgcugccagccucaugucuccuuaaucaucaggaaguucccugugaggucuggccaagcacugugaggcuuggggcguggucccauucaccuagagcccccucuccuagagccucugcugacaccuacacagugucaggcccaggacugggcauuuuacuuccaugguucucccaccagagcugucagagggagcucuaccccauuuuacacgaggggaggcugagccucacagaggcuugcagguccucccccaggucacccagagcucucccuccccugccccuuccugcagguccuacaccguacaggccucagcaaccccgaugggcuggcuguggacuggguggguggcaaccuguacuggugcgacaaaggccgggacaccaucgagguguccaagcucaauggggccuaucggacggugcuggucagcucuggccuccgugagcccagggcucuggugguggaugugcagaauggguauguggcugaggaggguugggggagccccugaaagcagcauccaagcccagccucccugcaggccacuggugcgauggguuacgggaucucccagggcucacugccuacccaucgccagguaccuguacuggacagacuggggugaccauucacugaucggccgcaucggcauggauggguccagccgcagcgucaucguggacaccaagaucacauggcccaauggccugacgcuggacuaugucacugagcgcaucuacugggccgacgcccgcgaggacuacauugaauuugccagccuggauggcuccaaucgccacguuggucagugugccagugaggcuguccaggcacagcagacucaguggggauggaggucugaagcgacaggggaucaaguuuugggggcaagaguggacauaaaaagcggaggauauggccugaggacaccacucacuggggugugggguucagagcaccccgggggcuuccccagccuggccaccacccagcucccuugggaaggaagaggagaggcccuucccuuguauacacaguucuggaggacuggccccaaggagggugggggugggaggccugcgauugagaacugcagugcuccccacuucccgaggggagccauacacuggcagggcaggaacuugccaugaggcagucuagguuugaacuccagcucugacacuuguuagcugugagaccauggggggucuguaccaugaaccaucuguaacuggggcugacacccaccucucaggguggugguagggcuugaggagguggagugggccggcacccuguccgagcuccggcugacuggcacugugccugccccuuggcccugcagugcugagccaggacaucccgcacaucuuugcacugacccuguuugaggacuacgucuacuggaccgacugggaaacaaaguccauuaaccgagcccacaagaccacgggcaccaacaaaacgcuccucaucagcacgcugcaccggcccauggaccugcaugucuuccaugcccugcgccagccagacggugagcaggcaaggggugggagcaggcgaacggugagccaggcaccggggucccugggaguuccugcucaucccuucucuagcauugaccaagcccuccuggccagacacugggagacuccaggagggucuagacaggggauggucuggcucccgggagcuucagcccggccuggauccagcccuggagucuggcagcagcaagucccugaggccagucaagugggggucugggugcccagcccccagaaggaaggcaggccggccccugggagggaagcacagaggagguggggagcuggccuucaggccuggccugauccugggaccuuagaauccucuccuaucuccagcuucagcucccuccuaaaagaggcaggguucagacccacccgccucuguccaggauagagugagugaggcagccuuugguaggccagaaaaugucaccauauuucacgacguuuucucuggcagugcccaaucaccccugcaaggucaacaaugguggcugcagcaaccugugccugcugucccccgggggagggcacaaaugugccugccccaccaacuucuaccugggcagcgaugggcgcaccuguguguccaacugcacggcuagccaggugaggcugucccccagaccccaucaccagugcccgcuccccaacccccaaauccuccuuggaccccaacaccugcucuguccuaauguccucaugcaucugguuuucccacacuaacacccccacauuucuugccuaccucuugucuccccacagcaauacuuuuacccccgucaccucacacagacaccuccacacccuaaccuugacccuccuugccaugcuucagugcugccuuccccacccuaucccacgcagccccauaccuggccuuuccgaacucaccauagcccaaccugccccauaacacccugaccccugccucaacuucuuugaaacauccaagccccucaaaagaaagacuucugagucccccagacccccaccaaccccucuugcccccaccugcccuccaguuuguaugcaagaacgacaagugcauccccuucugguggaagugugacaccgaggacgacugcggggaccacucagacgagcccccggacugccgugagugccugcugggggugacaggagggcccccagcugugucggaggccugacuccugaggcuuugaauggccacuggagaggcuggggcuguggugcccugcaaguggaccuggccguguccaccccagccgcucugacucugagccucccucucuggcagcugaguucaagugccggcccggacaguuccagugcuccacagguaucugcacaaacccugccuucaucugcgauggcgacaaugacugccaggacaacagugacgaggccaacugugguaaggcgcugcccgcccacccucccuccuuccccagcaucuucccugccccaggauuuggggcuuucaagugcagggaaguugcagcccacggcagcuugcucuccaggcuggauuccuauggcucaagccuguguccucccugcugagggaugggcacccucucccugccccugaguccucccuucgccacgaaucaccuccuccucccuccacagacauccacgucugcuugcccagucaguucaaaugcaccaacaccaaccgcuguauucccggcaucuuccgcugcaaugggcaggacaacugcggagauggggaggaugagagggacugccgugagugucagaggugguggugggccgguggugggagaugacacggaagcagggcaggcagaaucuccccacagcuuugagaggcucucaaauaacuuuaguagaugggcaacacaaauuauauuggguguaacuugcuuugcucauaaaaaucaucaugcaugauauagagacauagagauccagaaaacaaaaagcaccaaaacuggggauaaacuguuccuuccuccgaagaaguugcuggcaggaccaaggccagggcuuggaagagagagaagacagugauggugaacuggaguggcagguguaagggagggcccucauucucuugcccaccccacagccgaggugaccugcgcccccaaccaguuccagugcuccauuaccaaacggugcaucccccgggucugggucugcgaccgggacaaugacuguguggauggcagugaugagcccgccaacugcagugaguugccuggccuggagcccagcuucccuccccagugucugcugcucacaccaccccgacgugugacccccucaguggcugcucccucacucuccccacccucccggcacacuccuggaaggagucucauccucaccccaugcccacccgcuugcagcccagaugaccugugguguggacgaguuccgcugcaaggauucgggccgcugcaucccagcgcguuggaagugugacggagaggaugacuguggggauggcucggaugagcccaaggaagaguguggugagccgagaccccacuccaggaggaagacagucuaccugggugggaggcauggcaccccuggcagguggagggcugggggccgccugcuuaccggucucagcguggcccugcugcugggcuuccugggccugcuguggggcuggggaaggaggccuggcuggagcucacuuccccacauccacccgugccccaugucucccaguuucccuaucccugccccugcccacgccucauccacacauaccuguguggaguuuucccugcccacccuaugggaucuguucaucuccuucccaaggcagcugcccacacacacacccccaaccaugucuccuguccccaaaccuccuuauagaccccacgucucaaaacaccgccugggcuccccgcggcugacccuucccaagcugggaugcccacccucccugccaggccagccugaccaugccugcuuggacccuaaugucugccccagcccuuucccugacugcccugacacuugccuccuccagaugaacgcaccugugagccauaccaguuccgcugcaagaacaaccgcugcgugcccggccgcuggcagugcgacuacgacaacgauugcggugacaacuccgaugaagagagcugcaguacguccccacccacccagccccgcaugagccccucccaggccuggcccuugucucgcggcccuccugccacaggccgcgccagagcugguggccaccucccagggugggggcaggagccgcccuccucacccaucccacuccaugucguguauuugaguuugugccauuucaccucaucucauguuucucuccauuuucacacuguccucucgggguugcagagguaggugucucugaugugcccgugcucccaccauacccccaccucugucccagagccccccaucccugugcugugccucuacccaucauccuugauugaccucuccccaaacccuggugcuugucucaguggucuugcccccgcuccccuccccaaacacagucuguucugagggcaaggccagggaccuguguccucucuggugucugucccaugggguaagugcgagcccgccugugcccagcuguuccauaggagcagccagugggcucugccaggacuggcucggccucugggucagucagcuguggccuucagagacacggggaugggccuugggcucgggacuguggcacuacugaggccuggaguccuugugcccacccuccugggccugucucccccuguccuucccagccccucggcccugcuccgagagugaguucuccugugccaacggccgcugcaucgcggggcgcuggaaaugcgauggagaccacgacugcgcggacggcucggacgaggugggcagggagaugagaaggaagcagauggccucagaggaguucaggcagggcuuggggagugccgagaggugaccggcugccugugcccaugcccacagaaagacugcaccccccgcugugacauggaccaguuccagugcaagagcggccacugcaucccccugcgcuggcgcugugacgcagacgccgacugcauggacggcagcgacgaggaggccugcggcacuggcggugcgccccuuggcuuggucucccuggguccucccucugcugcccaccccgccacauggcccagucauucacucauucuuucucuucuguauucauucuucaugcaacaaauauuuauuaagcauuuaccauguaccaggcacugccauagguguuagggacguaguaguaaacaagacacagggccccugaauacacauuuuugugcggguugugcccagcucaaugcccccuagucuaggggaccaguugagcugaaauccagcaaacccugagggcugugcccaucuaggccccaccccacaagucccuccgagacagucugcugccacaagaagaaaagcccugccuauuuucccuuccugggggcagugagacagugccugucccucgcugaccugccugggcucugcaguacagagggggcaggugaagcccgggaugagaaaagacugggccuuggagcggaaaucccaacugugcgggcagaugucuuggcucugccuugguaggccaggcacagggaugggaacccggucuuccauucccagcccagugcuguucccgcguccccgcuguggaacuacacagcccagugcuguucccacguccccgcuguggaacuacacagcacagugcccugccacauaccagagaaggagugcccucugaacuccuccagacaccccugaaaaauggccucuucuccccuaaauaccagagggggcaguuuggccccaccaaguagaaauuuaagagaccugguuccaauuuggcugugccacugcuugccuggugaccccucugagccuggaacccccaccuguggagacaggggucugggugggcucauggcucauucuaucucuuggcucccccuggcaccagugcggaccugcccccuggacgaguuccagugcaacaacaccuugugcaagccgcuggccuggaagugcgauggcgaggaugacuguggggacaacucagaugagaaccccgaggaguguggugagauuuggggcggggcucccaggcuucccaguggccagcaaccacccccacucccaagacuaauucuggcucugugucccccuggcugcugcagcccgguucgugugcccucccaaccggcccuuccguugcaagaaugaccgcgucugucuguggaucgggcgccaaugcgauggcacggacaacuguggggaugggacugaugaagaggacuguggugagcagggggccgacgagaggccugcaggggacggguagugcacaguggggugagucugguccucgugggagcugcacugggguuaggguuaaccaggaggacucgcccaggaaggggaggauccauugcuaggagccugggggcuuuucguuaggaaagagaagccccuggggaaggcucugggggcugccugaugccuuaggucuuggagguggggcugggaacccaaauguuugaccugcucccccugcaagccuugucacuuaggaauugggagccacuguuaucuaugggguugccgugggaggaggaggcaggggagaauacccagggccuaaagccucugcccuccucagagccccccacagcccacaccacccacugcaaagacaagaaggaguuucugugccggaaccagcgcugccucuccuccucccugcgcugcaacauguucgaugacugcggggacggcucugacgaggaggacugcagcaucggugaggcccggcagcggaccggacgcugguggggaguggggagagccaagcccuggccugggguggcucaagggagggcauccacucucugucccccacagaccccaagcugaccagcugcgccaccaaugccagcaucuguggggacgaggcacgcugcgugcgcaccgagaaagcggccuacugugccugccgcucgggcuuccacaccgugcccggccagcccggaugccaagguaggaaagcggggcagagcagggguggacaccccaacuguggacucucaugacccucccuguaacccuuagacaucaacgagugccugcgcuucggcaccugcucccagcucugcaacaacaccaagggcggccaccucugcagcugcgcucggaacuucaugaagacgcacaacaccugcaaggccgaaggugccggagccaccagagggcagaaaggcuggguggggcagggcgaccaggauaucaaacggggccgacuuggaauggaaugucuuccugcggacaucuugcccagacaagaagccccagacucauaguugcagcugccugagcacagugcuggcccagcagugggggcagguccuggggcuggcugacugaaggagucugggguguggcagugcucugaauugcacacacaccuccucacccaccacugccaggacgagaguacacucagacacgcauugcacacucacagucaugggggccucaccugcacauuccccacaugcuuugaugcccaccuugccuuccacaugccuguacacagacauucacacacaccccuggcacacacacccccaccaugcacucccaugcacacccucgugcuccaugccaagcacacacaccccaugugccuaugcacccccgagcaugugccaggcaguuuguagcagagagcguggugaugccauccagcagccgugaggagguggaagucucugggucuggaggggcagggacagcuuucugacugaaaggagcgggucacaguggaucagcucaggggaggagaggaggagguccagaggcugagguuggagccugcaacccugagcagggaggguaagcagcagcuucuggccggagcagaugguccuaccaggagaugggacaguguucaugugaaaggagcugagcuggguggggugcacaccugcaucccacagccccagcccuggccucuugcuucuccaggcucugaguaccagguccuguacaucgcugaugacaaugagauccgcagccuguuccccggccacccccauucggcuuacgagcaggcauuccagggugacgagaguguccgcauugaugcuauggauguccaugucaaggcuggccgugucuauuggaccaacuggcacacgggcaccaucuccuaccgcagccugccaccugcugcgccuccuaccacuuccaaccgccaccggcgacagauugaccggggugucacccaccucaacgugagugcccaaccuggcguggauggaguggaagagcuccauagagcaggcgguucagagcaggauuugaaaagggcagugcuggcuaggcgcaguggcucacgccuauaaucccagcacuuugggaggccaaggcgggcagaucaccugagaucaggaguuugagaccagcguggcaacauggugaaacccugucucuacuaaaaauacaaaaauuuggcugagcgcgguggcucaugccuguaaucccagcacuuugggaggcagagguggguggaucacgaggucaggagauccagaccaaccuggcuaacacagugaaaccccgucucuauuaaaaaauacaaaaaaauuagccgggcaugguggcgggcgccuguagucccagcuacuugggaagcuggggcaggagaauggcaugaacccgggaggcggagcuugcagugagccgagaucgcgccacugcacuccagccugggcgagagagugagacucggucucuaaauaaauaaauaaauaaauaaauaaauaaauaaauaaauagagacucggucucuaaauaaauaaauaaauaaauaaauaaaauaaaauaaaauaaaaauacaaagauuagccaggcgugguggcgggcgccuguaaucccagcuacucaggaggcugaagcaggagaauccuuugaacccagaagguggaaguugcagugagccgagugccacucgguugcaguggcaccaagguugcagaauagcacugcacuccagccuggaugauagagcgagacuccgucucaaaaaaaaaaaaaagaaaaagaaaacaaaagggcagugcgaggggcaaagguugagaguggggcagggggcagucuuaggauuguguucugaggcauggccagcgggaagacagagcagugggaauggucagcagcuggcugugcugcaggcagcccagggcacagggcaugaugggcaggcagacagcccuccggcaccaaucccccauccuugccacuucccacuguguacgucuuagcuaccucauuuaaccucuuuggguuucacuuuguuuaucaauaaaauuaggugaucaucgccauugcacaggcuucagggagggcucaccagccacgugugagagcugcgagucuggcgcauaagcuccaugccgguugaaucucuuuaaagccaggguccuggcugugagccuggggugacguuccagcaggcuggcagagugguggcggggggauaauggcaggaagacaaagcaguggccccugaaccuguggcuuccauucagauuucagggcugaagaugcccagaggcaucgccaucgacuggguggccggaaacguguacuggaccgacucgggccgagaugugauugagguggcgcagaugaagggcgagaaccgcaagacgcucaucucgggcaugauugacgagccccacgccauugugguggacccacugagggggugggcaagggcccuggggggaggccucugggcuggugguaggaagcccccgggacaggguugggggcugcacccacaugcgugcccuucccucccaggccagccugaggacagaguccuuuucagucccuugggucuucucggccaccccugccuggcccuccccaugcugccucugcccagggcccccagcugggccugcuugggcagggaucugaccucugcuuggccggcugucaugcacagccacacucugcccuggggaacagcucugccagcgucgguggcucugaaugagcacacugugguuuuagaggaaaagccccucaaccugcucagaagcagacucccgccugcuucucuguagaaggacagaaugcccuccucccaguccccagcagucccuguccccagaccaagaagcugguguccugccugggccugccuccucuggcccuccggccugcccacacucaccccuucucccuccccaggaccauguacuggucagacuggggcaaccaccccaagauugagacggcagcgauggaugggacgcuucgggagacacuggugcaggacaacauucaguggcccacagguuuguggggcagggugcaggagggacgggcauggagggggcccggcucgcagagcccagcugcugcugaagucacacaaaagcaagggaugggauggggcuuggacuggggcagggcagauuggccguggaggcuuuucccgaaagaggugacugugaguggcguaugaacaggguggagcugucccgggcauggaggcaguucuuuccaccccgagccuggguuggggaggccaagcucucacagugcucucucucuccccaggccuggccguggauuaucacaaugagcggcuguacugggcagacgccaagcuuucagucaucggcagcauccggcucaauggcacggaccccauuguggcugcugacagcaaacgaggucagagcccggcauaagucgcaguccccagcccuguccccagccuugccauccucccuacugagccaaaggccucacuucaaugccucccauccuuugucacugacccccagcaaugcugcagcgccuuccaggccucuccagcuggccucccccugaaccagcccugcaggccugagacccacccugacccucuggccuacuuguccauucauugguuggguugcacggaggcagcauagguacauuaggaacguagcaaauugggggagaaggaauagaagucagucaugacugaccccagaagucugggggugaugggaccuuuugccaguaguggccacaggaggaggaaccgguguggggagagagaauuuggucuggauguguugaguuugaggugucugggaaccacaggugccagugucguggacagcauggccagggccugagugccccucagguccccucugacuccaccuccucccccaggccuaagucaccccuucagcaucgacgucuuugaggauuacaucuauggugucaccuacaucaauaaucgugucuucaagauccauaaguuuggccacagccccuuggucaaccugacagggggccugagccacgccucugacgugguccuuuaccaucagcacaagcagcccgaaggugggggcagaggggagccugggcuggggaagggaggccugugggcauugagucuccaagcuguggcccugggaccugguggagagggggucacccugggcucacagggcucagagaaggguccugcucagcauccuccccaccccacccauaccugcagugaccaacccaugugaccgcaagaaaugcgaguggcucugccugcugagccccagugggccugucugcaccugucccaaugggaagcggcuggacaacggcacaugcgugccugugcccucuccaacgccccccccagaugguaugcuuaugcccucccagucccagccaugccucaggaccaucuccuuccuguggcuccugacuuccccugaccuuguugccugucccucuccuccuauuccccuggcucugccccuugacgggcccuuccugcagcuccccggccuggaaccuguaaccugcagugcuucaacgguggcagcuguuuccucaaugcacggaggcagcccaagugccgcugccaaccccgcuacacgggugacaagugugaacuggaccagugcugggagcacugucgcaaugggggcaccugugcugccucccccucugguaugcccccucaucccgccacgccugcuccuugccccugggccccagccccgccacccaccaccccaccucaggcaaaugcccagccccugccucgccuccagccuccuuuccacaacccagcauccagucacuccagucucugcuucucgcccagguccccccagcccauuccucugcuauagggccagguggucucgagggccacagucgcgcucacacauccucucccaccaggcaugcccacgugccggugccccacgggcuucacgggccccaaaugcacccagcaggugugugcgggcuacugugccaacaacagcaccugcacugucaaccagggcaaccagccccagugccgaugccuacccggcuuccugggcgaccgcugccaguaccgugagugagccaucccugggccccagggcaugcgggagggugacgggggaccccagagcauggggugauguucaaccugugccugggacccacaggggcaaguucaggaaagaaggccuuaugcagcugagccaggcccaagcugcuggcgcuuccccacaaaggugcuggcacacuuccccugaggcagugcacccccugcaccaagauuaugcaaacagaaaagcucuguucaaccuauggagagcccucaugaggguggggcuugaggcacuucucucccuccccaaccacagggcagugcucuggcuacugugagaacuuuggcacaugccagauggcugcugauggcucccgacaaugccgcugcacugccuacuuugagggaucgaggugugaggugaacaagugcagccgcugucucgaaggggccuguguggucaacaagcagaguggggaugucaccugcaagugaguggggcccuccuccacaguuccacccagcugggccccugcccuguccuagcccugcccugccccucccuuccucagcaucccaggcacgccucugccagccccagccccagccucugauuccuuccugcagcugcacggauggccggguggcccccagcugucugaccugcgucggccacugcagcaauggcggcuccuguaccaugaacagcaaaaugaugccugagugccagugaguugggcccgggcuucacccaggcauagaucaucgcucccuuccccagauuugagcaggaggaccgucaggccucagugcccaccccccgcccuguuuuccuggcagcaguggcuauggagguuauaccuacucagccgugucccuccuuucugcaggugcccaccccacaugacagggccccggugugaggagcacgucuucagccagcagcagccaggacguagguggcagggguuggggcaggcagggccaccgggaccuagagcagggggaccgugugccuccugcuucccugagccuuggugacucagugucccaccucuucccuccagauauagccuccauccuaaucccucugcuguugcugcugcugcugguucugguggccggagugguauucugguauaagcggcgaguccaagggugagucacagggauucuggaacauucuggucauuauuuugccauccuagccuucccccccaauaaucucugucuccuuauacuccugccuuuccccagggcuaagggcuuccagcaccaacggaugaccaacggggccaugaacguggagauuggaaaccccaccuacaagauguacgaaggcggagagccugaugaugugggaggccuacuggacgcugacuuugcccuggacccugacaaggugggcugggaggcgggcagggucgagugccaagaggccguggguggccuaaccaaagguguuggguuaggugagggacggaggugggggugggguaaccugggcuacaggcccagcuccugagcccuaccugaacccucugucacccugcagcccaccaacuucaccaaccccguguaugccacacucuacauggggggccauggcagucgccacucccuggccagcacggacgagaagcgagaacuccugggccggggcccugaggacgagauaggggaccccuuggcauagggcccugccccgucggacugcccccagaaagccuccugcccccugccagugaaguccuucagugagccccuccccagccagcccuucccuggccccgccggauguauaaauguaaaaaugaaggaauuacauuuuauaugugagcgagcaagccggcaagcgagcacaguauuauuucuccauccccucccugccugcuccuuggcacccccaugcugccuucagggagacaggcagggagggcuuggggcugcaccuccuacccucccaccagaacgcaccccacugggagagcugguggugcagccuuccccucccuguauaagacacuuugccaaggcucuccccucucgccccaucccugcuugcccgcucccacagcuuccugagggcuaauucugggaagggagaguucuuugcugccccugucuggaagacguggcucugggugagguaggcgggaaaggauggaguguuuuaguucuugggggaggccaccccaaaccccagccccaacuccaggggcaccuaugagauggccaugcucaaccccccucccagacaggcccucccugucuccagggcccccaccgagguucccagggcuggagacuuccucugguaaacauuccuccagccuccccuccccuggggacgccaaggaggugggccacacccaggaagggaaagcgggcagccccguuuuggggacgugaacguuuuaauaauuuuugcugaauuccuuuacaacuaaauaacacagauauuguuauaaauaaaauuguaaaaaaaaaaaaaaaaaaaaaggccaaaaaaaaaaaaaagaaagaaaaaaagccgcuggugucugccugugugugagagacgcugggagcuggggcugcgcuuuccugcuucggccaccagagggagaccugccccgugcuggaggcaggcuggcgcgugguuuuuagugcccuucucccagggcccucccccucuccaucuuacugugcccgggaagcggguggcacuggacuugacauggaagaucugcuucuccuggcugugugaccuucagccaugacuucgagucuccagauuuuguguucccucugggucuaggacacuaacucagaucuguuucucugcauucacuucuaccagacaccaccccccuacccaaaaugaucacccacagugagaagccccacuauaagaagugaauacacugaggcugcaaagguuuucucauccuucaggguccucccaugcgguucucucugccugagucugcucuugaagcacugacgucucacuuuguggagacuaaugaaucaaaugcgaaguaaaaugcugcauuccagagccaggugucuccugcgguaaaggagagcugggaagaccaguuugccaggcccucuaggcccccagcagcuccagcucaccaaucauuucagucauuccaggggguaacaggaaaaaacugucaaucaaaaguguccagguccauuucaaccccugccuagagggggaaacuucuugcagaaaguugcacaguuuacacugcccaggacuagagaggguuugagucccaguacagcaaauaugagcucaggaaggguggcugcaaaugucugaagaucccuuacccaacucccaaccaggaagugcugccuuucauuccuccucccucacugguucaacuccaggagauuccucccaggcuuccuucugccuuggggaagcuacaagucuaggcaccuguggaaagaggagcccuccccuucccuucuuagccuucagaagcucucuccaaccucauccuccaagccaacucugagauccuccccugccuucaaaagggcccuggaugggcaacugcggggaaacagaauccgugguugccgaguaggaggucugugucccaaucuggccaccagguggugucuguacgccuggagcaccgccuauccugaagccccacacagcccccgccucagcacucauuaugcaccugcgggggaccccagcccagucucucgcuuccuucucuccggcuauuuugccacaccccuccacccucugccagccagcuccccucccugccccagcgccugccugcucccaccaccaccagccccaacccugccccucugccaucggugcaucuggugccccccgggagccacugaucucugccugucaccucaagauccugggcagagcgacaagggacccccgcugcagcuuggaaggcauaccccuccagucagcaucccccacuccgccugucaggaccugcuaggagaagguccaccaggaggcaguuucucaaacuacccacccgggaggcaggugggaagcccucaccuuggccugagagaugggaagaaccagggacagaggcugagaaccagggacagaagcugauaccgaaugagaggcagaaacccagaggcggagagacagggggacagaggcaaagacccagagacagggcgaguagugugcauguguguguuugcacuuguguuugugcgagcgcgcacacauguguguguguaacuggagagagaacagguggccugagacuguagcuaaaggaggagagaugcaguggguucggcccccagaagaccaggacccugguaaugggcuucuguccuggacagccuacgccuaggugugcccacuguucccaccuacuacugaagcagcccccgugccuggaacgugggcucaggguucuggcucaaggccuuuuggccuugagccugaacauuucugccccuuccugccucucuccucuccacccccaccccggcacccagguuccugccuccuggcuucugccugucucccugggugucucugaaucugccucguccucucagcaccgguccuuuuccugacucguguguguggcugucacgucccauaucuaucuguccauuucuuuguaugugcccccacuugucuucugggcugccagugacagcauacaccuguguaugucucaguguguguguccaccucuguggguguuugcucucugccaagacaaagagagggugagcgcacugagcaacugucugggugugcucgucugggugcaggugugcucaccucuguugcugugcuccucuguguguuggggugccgcuaggugugcgccugucucuguauuucgcucugugugcccuguccccgugaaggcaucugcgugcaucccuggggugggcucucaagggaugugucugucucucagucucuuugcuugucccuaucucugucuagguguuggucauaccacaaccucagccacagccucagugcauagcaacagcugacagcugaaaccacccgggcaggagagagagaggcaguggggaggagggaaccgaggaagaaacagagaagaggaugggggcagagagcuggggcuggggacagagacaaggacagagauagggaauggggacaaggaucuagaagagcugguggugaaagaugggacggcgggaggggaggaacagagacugcaccaagaggccaggcaggcggcgcugagagggauuuccugcccagcccccaugcagaggcgcacugggccucgugggggucaguggugggggccaggggcaaaggugaacagccggucuagccgagggguccugagaccgcagaggugcggugaggcggggacggggcggagggcgccguuugucagcccuauugacagacgugaugggguuuccguccgugaucaaugauucucaucuccgggccgaaugagccgcggggcgcccauccauccccgucagcaucgcgcggcggcagccgcccgaggccccgcccguccccaccucggccccugcccugcgccugccccgacacaccuuggcccugaacagggcagaggcccggggcuuggagagcgucguccggcugggcuccgcggcgcccccacuccaggugcacgggcccggagcccagagccccacgcccugccccguuccuccugggcgcacagacgcggccucucgggggaccagugccugagccccucgacccccuccgcuucgcaccugggccaggggcguguccggggcgugccggugugaaagucaccuucggugcccccagcugggcgggagggggcgcgcggggcgcggccgggauuggagcgccgcggagccccgccccccgcccgcggagucagacccaacuuucucccccgcccgcgccccgcccccagcgccggcuccgcgccucgcgcccaguccgcgggccgcgccgccgcucccgccgcucccgccgcucccgccgcucccgcagccgccccgccgcccgcccggagccccgcgucccuaggccuggcucccgccugcccgagacccgcccagccugccccgcucagccgccagagaagaugcggcugcucccggaaugguuccucuugcucuuuggcccguggcuccuuaggaagguaagaguggcagggcuggggcgcuagcgcgggcgcgggguuccgggacgcgaaggucccagugugcgaggggcuccgugcgcccgccccgcccccagcuccgagcgucccaacuuugcgcggcgcgggggaagcggacagacagacugcccgauucaggacgggcacucuccuagcgcaaguuggcugaggcuuggagagggugccgggcggaggucccccuugcagccgacuucaggcgcggcgggggaggggacgaagcccgacccgcgagugcgccagacagagcgggagugcgagacagacagacaagccagcagggugucagccuugccgucuuuccgcgccagucucgcucgccugccucacugucugucuguccuuccaccccuccacccccgccuucccauuucucuucucugcacuugucaccaugccaggugggcucugugucgggagcauccauggcccgagcacacacgcacacacggacucaggcagacacggcugaacuuggcuacagccagccucccaucacauuucccacggagacaccaucuccccugcacgaccucacagacacaccccccucucgugccccacugaagggggaggcugucuggaaggggagucucuccucccaugcccucccugccuccaaccccacuccaaggccucuuucccugaggcucucgggcgaagagccagaggcuaagggagcucagacuugaucugccuccuuccugacuuggaggcuucaaccugcgaacaugcugugcucauaugugcuggguggagggcgugggucaccgugugcaccugugugcauguguccagggaagccaggcuugguccaguacuggggccgaggguacauguguauacugguguggugugugguguuggcuuugcaugagugagugucagugccugccucacagugcagccaucugccuaugccccuggugugugcccgcaaugggggcccaggccccagucccccauuuuccuucuaccagccuccccugccuauggcuucccuguuuucugacccccaacugugaccuaccuaguuugggggcaggcaggucauuccccaaacccucauucucuguacccucagccccuguagagucuagaagggguguauuucuucccccaacacuuggaccucugccugcucagccaaaucacauuuggcaaaccccagcagggcaggggcugccccagugaagcuagcauuagagcucccuggcccucccagccccaccuggugaccuugaggggcugcacgguaggcagaggagccccuccaugaaaacugcuuccacuagcaggagcuucuuagggacuugcugcccaacucuguccuuagugaacuggaggaguggggggggucugugcccuaccacccacccacccaugugugaaggccuggggucaagaggugguagguauggcauucucuugccccuccuuuccacuuccucccaccucaucuccacucucccaggcaaauaaacuccccuguggacagaucugguuuaauuuccuuugcccccugagggggaaugaaacaucugguggagacuugagugagagugagcgugaggauaugagcaaugggaucuaucugagugugugugugugagcugcagcuguggggccuccguguuggagucaacagggagaguggaucugcugguuagcccagcuuaugugcaugugagaauguguuuacauguguacacacugcgggugugugaauauguauaacugcacggggagguguggguauaugaguguuuguguguccaaauaccugugugugcuucugugcacuugugaguguggcguaugcacauguauaccccgggguuucuggugcaucugugugcuggggcccauguguugucuguaugagucucugggguuugugaguguguuucugugugcuugugauugugagugcauuugagugugcuaugagauugugagccucaggauguguuuauguaucugaguguggcuuaugugugugggugcucaagggugucuuggugccagcacugggagugggcaaaaggugaggcugauccuggguaagagguggcuaggggacaguuuacagggcaacuuuuuggcaacccuaaccaugaacggcugacaccucugccucucccguccugcuugcucacccuccuccagguuucucucccuuccuccucacuccaggcuucccauuucucagagccugggacuccuggcuuccacugccucugggguucuggccucucagccagggauucuugaggaucuuucucauacagucucugacuccuuucccucucucucugucuccccgaccccuugccaaagcagcugccuacugggagaagcagcaggcgaucaauagucacuaaucacuaaucacuaauuacuaauuagcugggggagggcaggggcggggcccugugggaccugccagcucuaucccgccucaggaaaggauuaggucugauucucuuagagcuggcuggccgaagccccucagccagcuacccccuccugccuccacacccuccucuagccccccagcuaaucucugccugggccacuuaggcacgcacagccugggcuagggcccagagcugcugccggggauuuggggguaaucaggggccgcagcugggccagggggacaggggagggccugcugugacagcucccuugggccagagccugcaguggaagccucacauuccuaauaggaggggcaugcgucagaaaggagaauuuagagugucaggguugggauggguagaggagcuggagacccaggagcggggugacuggcgaagaggugagguaauaaggacagaagcaaggcaaagaggggucagggacgagguaauuggagagagacaacacaaacgucuaaagaaaacagguaaguggggggaccucacaggggucagagauggaguaauuggcaaggagauggggaacuuuggaccuagcccugcaacucaagaugugugggauccgugagggacagggcaacagagagggggcagggucauaggagagggucccagggcucaggcgcaggaggagucgcagggcguggggugggaagcagcugcccaguggggauggggagcagggagcgcugccuugagcgcuggaaauuggcgcggcucccccucucccccgccugccccuccuccaccuccaccccgcccacucccccuccggcuccggcuucgggaaauuacauccccgcuccgcggcuccccccaacccccaccgcgccccggagccggcgccuuuauaggcacauuuauugcaauaauaaagugaggcgcggggcggggggcgggggggcagucguucccgcggggaccgcgcuggcuccaggaagcagggaaauaaaauaaaauaaaauaaaauaaaauaaaaauucagauaacggugagccuugcgcggcaggccaagagaagucaggcaggcagggguagagggagggggcguccagcccaagggcagagccuaccccaccccaccagcgguccccgcccccucaugcagugguagggucuggaaagaggugucuucgcuucaaccugccuggcccccucccacagccugauccugccuggucuuugccuugcccucuggcuccucucccauaccuguccucagccccugucucuguccccgucuccugugucuucccuugucccccauuucccauuccagucucccuuugagucuuccauccccaucuccugggucucugcauccaucacuguuucugcccaguaaccauccccaucccccaucucuguuuugccccacccugaccccaucccugccuguccccugugcuuaucccucauccaccauuccuguccccaugcugcuuccuggacuguucuguagcccaucuucauuucucugguccuuaccccauccacaucucugucucugccccacgccuggccaccauuucuauucugcuucucaucccuguccccaggccuauccucauuguauccucaucccuguacucuauaucugugccugccaguccccaaucccagucccccucccucucugucucaguccucaccccaggcuguccuguccaccccaccucucuccucacccacaucucuaucccucguucccagccagacuccaccggccccuauugcagcaccccugccucuuucuaggugcaggggcucaggaugcucuuuucuccccuuccccagcccaggccuggacugucccuuccuccggccagauccugggagcacccugccugacccaggugguaggggaaaagcaacgggccagccuggaggcccaggggaggugcacccugcaaugcggcuggggggcugacagccugauccucccccaaucccagcagugucauccccaaagagccacuccccgaaguggaguuuguugcccccagcagcaggaggccaccucaacucccugcaggugcgugggcccgcugccucggggguaaagcccuccuggugcagcucuccccgcuccccgaaugggccugaaggagccugcugaaccccccagcugccgcgcaccuccgccccgcccccgcgccgacagcagcgcuagccucuccccuccgcaaaugucaccgcgcccaauuagcuuaauuaagccagcucuggagcaagggggaccccuccucggacaacauccugcucccacccucagccauggaggugggcgacaagagcucugggcagaggagcuccuuaccaccugccuucccaacucccccaccuccccccauguugcuggagacagacaaccugaaggacagcaggagagaaccacagacagagggagaaaaucagaaucaugggaggaggaaauuugagacagagacagugagaaaagagacugagagacaaaagagacugagagaauggggagggagagauggaaaaacagcacaagagagggagagagagcacgagcaaucaagggagccagagggaggaucuuauuuuauuuuauuccauguucccauuucucggcucucguuuccucacagacucucaccccucccugucugaacuccccuacaaggucgcuucagccgugcccccccaacucuuccuuuuuaucuuggcugucuacaguagugggugggggcgggacugcccaaagccaggggauucgccaggaucagagaagcacagacggcacuuugucugagaucagagaugggggugacacccuggaaccucuccuuacccugcugaaccuccuccccucccccugccccuuacuucuacccccugccccugucugguagaagucacuggccugaaucaccccagccagguucugacuggguacaagacauaggggugcucuggucugcugggaggagauggcuuggaggcauuuggggucauaacaucugauggcauggggauaggggggaccuggaugacugggcuucuggaaagaacagcgguugggugagauuagggaccagaguucaaauggcccacccuucagcuuucccaggaaaccuaaccucccucccccaaugcccucucucagauucaggcccugcccucuccaagcccacuucuggggccucuucucccucccacuguacccugggaccccucccuccacccucucucaggcccacccuccagguguuagcugcuggcuuaagccugucugugggagucaaucauucuugcugcccccgcccccucaccugggcugagaggagggauggaugggagggggaaugaggggggcgauaaauauguaugacgagcgggugguggcagcauuaauaacccgggaucgcagcguggcggggacggggaccaggcgguggagauucuagcccagcagcuuggcucugcuguuccuguccccagugacacuguguguguacacaugggugugggcaaacagaggggggcacccaugcuuccuggccuccuuaccuacccacagcacagccugugggccaguguaggacaccuccccagagaccacucagauacaauugacaugcauguaugucacccccaucggaacacagcaagaccacacuuguucuaugacuacggauacacccccuuuagaaagagcuugacacuugggcagaggaugacaggggcucacacaggaaaggugacaccuccagacaaccacauauagcuacccucagaccgcuauacacagccauauagccaacccagacacguaaccacaccagucacacagacaccacuccacaaauugacacacacacccagccaauccaggcacauacacacagucaccgauuuacacaacagacaugcagccacgacaagcagccacacacacacaggcuccucagacucauaaccaugggcauccagauacacacccacacagccaccacagccacacacacauguaccggccacacacacacaaccauuuggggcuaacagagacaccagaaccccaggcugacacacaugguacugccuccccccaugggaccugugcacagucagggccacagcacgcggcggugguggcuagcucaggcugacugacacacucugacaugcagcuccucucuugccugcuccccucgcuggagcggcaucuccauauuucuuccucuugcuuccugucuccuucacuccuggccacccccacucaccccuaccccagauaauugauggcccgggccuggcccggccgcuccugccucucgauccaucuuguccucgagcccaugcugucuccaagaucgguggccaccugagacacauagaacgggugggagcaggagggggcuccuuagcccccuuggagcccaggaaaagaacggccaggcggccuccaccagaguggagcacuggcgacugggagggauacccaggcuuuccuccucugcucaacugguucccagcacucacuccuugcaggccaguuggggcugaggcccaggugggggcucuggucucugagguccuggagccucuuucuuuuucuuuuucuuuuccuuuccuuuuuucuuuucuuuucuuuuuuuucugagagggagucucgcucugucgcccaggcuggagugcaauggugcgaucuaggcuuacugcaaccuccaccuaccagguucaagugauucuuccaccucagccuccccaauagcugggacuacaggcgcaccccagaacgcccgccuaauuuuaguagagauuagguuucuccauguuggccaggcuggucucgaacugaacuccugaccucaggcaaucugcccaccucagccccccaaagugcugggauuacaggcgugagucaccgcgugugccgggcgggagccucuuucuugaugcuggauguuaauguggucacagccucccuggcucaguuugcucagaguccagucccucccuggcucauuacuggaaccaaccaggugccgggccaggaaagaugagccaggauccagagcuccacucccuacucaccuucacacuggcuuuggguuuuuggcccucauuggagcucugugggccacaucaggauucuugacgucauuucacagauguacaaacugaggcccagauccaugaagugacugggccaagacuacauagcuugaaagggcugcaguucuccuccaaggcacgcucccugcccgcugcgggacugcgugauuccauuuggucuccuagcggcuguggaaagggacuggcgucgauagggcucuggcaggauggcgggggacaaccccagcgucucucucuccucuuucuucgugcacaggccgucagugcccagauaccagaguccggaaggccgcaguaccuggggcugcgccccgccgcggccggagcgggugcccccggccagcagcucccagagccaaggucuucggacggccuaggcgugggccgcgccuggagcugggccuggccgaccaaccacacgggggcgcuggcccgggcaggggcagccggggcguugcccgcgcagcgcaccaagaggaagccguccaucaaggcggcgcgcgccaaaaagaucuucggcuggggggacuucuacuuucgggugcauacccucaaguuuucgcugcuggugaccggcaagaucguggaccaugugaacgguaccuucaguguguauuuccgccacaacucguccagccugggcaaccucagugucagcaucgugccgcccuccaagcgugucgaguucggaggagucuggcugcccgggccugucccccacccucugcagucuacgcucgcccuggagggggugcuuccugggcuggggcccccgcuggggauggcagcagcagcggcggggcccgggcuugggggcucccucgggggcgcacuggcggggccgcuugggggcgcguugggagugccuggggccaaagagucacgcgcuuucaauugccacguggaguaugagaagacaaaccgcgcgcgcaagcaccgaccgugccuguacgacccgucgcaggugugcuucaccgagcacacgcagagccaggccgccuggcucugugccaagcccuucaaagucaucuguaucuucgucucuuuccucagcuuugacuacaaacuggugcagaaggugugcccagacuauaacuuccagagugagcaccccuacuucggauagcgccccuccccagccaguccugagccucccgccaaaucccagccucacuaggugggacccccuucccaguguucugccgcuccuguggccaugucgcccacuccuuccacucugggggcggaggggaauggcuucucgggacccucagcuagcgugggugcccuuuuccuuaugcggagugcccgcaaggcugggguagcccccuccaguacaccccaaagugaaagggauaagagugcagccccagaauaggcggggcuuggaggcggucccaauguccccuggguccacaguggguccccuuuucacccuuggcgcuaggcugcgcacucccuuuccccgcagcuuuaauaacuccuggccuggcacccucaccccacccugacuuucccaucccccagcgcuuguccugcuucacccuaccccgccuaagacuguaaaggccuaaaaaccucggccuguccucccaccauucugccugccauaugccuguccccuuuuccuccaaacccuauuaggguaccggaagcagaaccccugggcugaggcccuggcccugcccccggccccugccccugcccgccccccuccaguccaggcagucgagcuccaccugcccucuccugcugcuuccucucggugauauuuuuucuacgccaaaacagacgggaaagggaacaaaauaaagugaaauccaauacacgccugugugagaccuuuguagggaauggggagguggcguggggcuucuaugugguagagaccuggccaaggccuucucccucagcggcuc

SEQ ID NO: 16443 - RNA, 84910 nt, Homo sapiens
gcuuuuuuucuuucuuuuuuuuuuuuuuggccuuuuuuuuuuuuuuuuuuuuuacaauuuuauuuauaacaauaucuguguuauuuaguuguaaaggaauucagcaaaaauuauuaaaacguucacguccccaaaacggggcugcccgcuuucccuuccuggguguggcccaccuccuuggcguccccaggggaggggaggcuggaggaauguuuaccagaggaagucuccagcccugggaaccucggugggggcccuggagacagggagggccugucugggagggggguugagcauggccaucucauaggugccccuggaguuggggcugggguuugggguggccucccccaagaacuaaaacacuccauccuuucccgccuaccucacccagagccacgucuuccagacaggggcagcaaagaacucucccuucccagaauuagcccucaggaagcugugggagcgggcaagcagggauggggcgagaggggagagccuuggcaaagugucuuauacagggaggggaaggcugcaccaccagcucucccaguggggugcguucuggugggaggguaggaggugcagccccaagcccucccugccugucucccugaaggcagcaugggggugccaaggagcaggcagggaggggauggagaaauaauacugugcucgcuugccggcuugcucgcucacauauaaaauguaauuccuucauuuuuacauuuauacauccggcggggccagggaagggcuggcuggggaggggcucacugaaggacuucacuggcagggggcaggaggcuuucugggggcaguccgacggggcagggcccuaugccaagggguccccuaucucguccucagggccccggcccaggaguucucgcuucucguccgugcuggccagggaguggcgacugccauggccccccauguagaguguggcauacacgggguuggugaaguuggugggcugcagggugacagaggguucagguagggcucaggagcugggccuguagcccagguuaccccacccccaccuccgucccucaccuaacccaacaccuuugguuaggccacccacggccucuuggcacucgacccugcccgccucccagcccaccuugucaggguccagggcaaagucagcguccaguaggccucccacaucaucaggcucuccgccuucguacaucuuguaggugggguuuccaaucuccacguucauggccccguuggucauccguuggugcuggaagcccuuagcccuggggaaaggcaggaguauaaggagacagagauuauugggggggaaggcuaggauggcaaaauaaugaccagaauguuccagaaucccugugacucacccuuggacucgccgcuuauaccagaauaccacuccggccaccagaaccagcagcagcagcaacagcagagggauuaggauggaggcuauaucuggagggaagaggugggacacugagucaccaaggcucagggaagcaggaggcacacggucccccugcucuaggucccgguggcccugccugccccaaccccugccaccuacguccuggcugcugcuggcugaagacgugcuccucacaccggggcccugucauguggggugggcaccugcagaaaggagggacacggcugaguagguauaaccuccauagccacugcugccaggaaaacagggcggggggugggcacugaggccugacgguccuccugcucaaaucuggggaagggagcgaugaucuaugccugggugaagcccgggcccaacucacuggcacucaggcaucauuuugcuguucaugguacaggagccgccauugcugcaguggccgacgcaggucagacagcugggggccacccggccauccgugcagcugcaggaaggaaucagaggcuggggcuggggcuggcagaggcgugccugggaugcugaggaagggaggggcagggcagggcuaggacagggcaggggcccagcuggguggaacuguggaggagggccccacucacuugcaggugacauccccacucugcuuguugaccacacaggccccuucgagacagcggcugcacuuguucaccucacaccucgaucccucaaaguaggcagugcagcggcauugucgggagccaucagcagccaucuggcaugugccaaaguucucacaguagccagagcacugcccugugguuggggagggagagaagugccucaagccccacccucaugagggcucuccauagguugaacagagcuuuucuguuugcauaaucuuggugcagggggugcacugccucaggggaagugugccagcaccuuuguggggaagcgccagcagcuugggccuggcucagcugcauaaggccuucuuuccugaacuugccccugugggucccaggcacagguugaacaucaccccaugcucuggggucccccgucacccucccgcaugcccuggggcccagggauggcucacucacgguacuggcagcggucgcccaggaagccggguaggcaucggcacuggggcugguugcccugguugacagugcaggugcuguuguuggcacaguagcccgcacacaccugcugggugcauuuggggcccgugaagcccguggggcaccggcacgugggcaugccuggugggagaggaugugugagcgcgacuguggcccucgagaccaccuggcccuauagcagaggaaugggcuggggggaccugggcgagaagcagagacuggagugacuggaugcuggguuguggaaaggaggcuggaggcgaggcaggggcugggcauuugccugagguggggugguggguggcggggcuggggcccaggggcaaggagcaggcguggcgggaugagggggcauaccagagggggaggcagcacaggugcccccauugcgacagugcucccagcacugguccaguucacacuugucacccguguagcgggguuggcagcggcacuugggcugccuccgugcauugaggaaacagcugccaccguugaagcacugcagguuacagguuccaggccggggagcugcaggaagggcccgucaaggggcagagccaggggaauaggaggagagggacaggcaacaaggucaggggaagucaggagccacaggaaggagaugguccugaggcauggcugggacugggagggcauaagcauaccaucuggggggggcguuggagagggcacaggcacgcaugugccguuguccagccgcuucccauugggacaggugcagacaggcccacuggggcucagcaggcagagccacucgcauuucuugcggucacauggguuggucacugcagguaugggugggguggggaggaugcugagcaggacccuucucugagcccugugagcccagggugacccccucuccaccaggucccagggccacagcuuggagacucaaugcccacaggccucccuuccccagcccaggcuccccucugcccccaccuucgggcugcuugugcugaugguaaaggaccacgucagaggcguggcucaggcccccugucagguugaccaaggggcuguggccaaacuuauggaucuugaagacacgauuauugauguaggugacaccauagauguaauccucaaagacgucgaugcugaaggggugacuuaggccugggggaggagguggagucagaggggaccugaggggcacucaggcccuggccaugcuguccacgacacuggcaccugugguucccagacaccucaaacucaacacauccagaccaaauucucucuccccacaccgguuccuccuccuguggccacuacuggcaaaaggucccaucacccccagacuucuggggucagucaugacugacuucuauuccuucucccccaauuugcuacguuccuaauguaccuaugcugccuccgugcaacccaaccaaugaauggacaaguaggccagagggucagggugggucucaggccugcagggcugguucagggggaggccagcuggagaggccuggaaggcgcugcagcauugcugggggucagugacaaaggaugggaggcauugaagugaggccuuuggcucaguagggaggauggcaaggcuggggacagggcuggggacugcgacuuaugccgggcucugaccucguuugcugucagcagccacaaugggguccgugccauugagccggaugcugccgaugacugaaagcuuggcgucugcccaguacagccgcucauugugauaauccacggccaggccuggggagagagagagcacugugagagcuuggccuccccaacccaggcucgggguggaaagaacugccuccaugcccgggacagcuccacccuguucauacgccacucacagucaccucuuucgggaaaagccuccacggccaaucugcccugccccaguccaagccccaucccaucccuugcuuuugugugacuucagcagcagcugggcucugcgagccgggcccccuccaugcccgucccuccugcacccugccccacaaaccugugggccacugaauguuguccugcaccagugucucccgaagcgucccauccaucgcugccgucucaaucuuggggugguugccccagucugaccaguacaugguccuggggagggagaaggggugagugugggcaggccggagggccagaggaggcaggcccaggcaggacaccagcuucuuggucuggggacagggacugcuggggacugggaggagggcauucuguccuucuacagagaagcaggcgggagucugcuucugagcagguugaggggcuuuuccucuaaaaccacagugugcucauucagagccaccgacgcuggcagagcuguuccccagggcagaguguggcugugcaugacagccggccaagcagaggucagaucccugcccaagcaggcccagcugggggcccugggcagaggcagcauggggagggccaggcagggguggccgagaagacccaagggacugaaaaggacucuguccucaggcuggccugggagggaagggcacgcaugugggugcagcccccaacccugucccgggggcuuccuaccaccagcccagaggccuccccccagggcccuugcccacccccucaguggguccaccacaauggcguggggcucgucaaucaugcccgagaugagcgucuugcgguucucgcccuucaucugcgccaccucaaucacaucucggcccgagucgguccaguacacguuuccggccacccagucgauggcgaugccucugggcaucuucagcccugaaaucugaauggaagccacagguucaggggccacugcuuugucuuccugccauuauccccccgccaccacucugccagccugcuggaacgucaccccaggcucacagccaggacccuggcuuuaaagagauucaaccggcauggagcuuaugcgccagacucgcagcucucacacguggcuggugagcccucccugaagccugugcaauggcgaugaucaccuaauuuuauugauaaacaaagugaaacccaaagagguuaaaugagguagcuaagacguacacagugggaaguggcaaggaugggggauuggugccggagggcugucugccugcccaucaugcccugugcccugggcugccugcagcacagccagcugcugaccauucccacugcucugucuucccgcuggccaugccucagaacacaauccuaagacugcccccugccccacucucaaccuuugccccucgcacugcccuuuuguuuucuuuuucuuuuuuuuuuuuuugagacggagucucgcucuaucauccaggcuggagugcagugcuauucugcaaccuuggugccacugcaaccgaguggcacucggcucacugcaacuuccaccuucuggguucaaaggauucuccugcuucagccuccugaguagcugggauuacaggcgcccgccaccacgccuggcuaaucuuuguauuuuuauuuuauuuuauuuuauuuauuuauuuauuuauuuauuuagagaccgagucucuauuuauuuauuuauuuauuuauuuauuuauuuauuuauuuagagaccgagucucacucucucgcccaggcuggagugcaguggcgcgaucucggcucacugcaagcuccgccucccggguucaugccauucuccugccccagcuucccaaguagcugggacuacaggcgcccgccaccaugcccggcuaauuuuuuuguauuuuuuaauagagacgggguuucacuguguuagccagguuggucuggaucuccugaccucgugauccacccaccucugccucccaaagugcugggauuacaggcaugagccaccgcgcucagccaaauuuuuguauuuuuaguagagacaggguuucaccauguugccacgcuggucucaaacuccugaucucaggugaucugcccgccuuggccucccaaagugcugggauuauaggcgugagccacugcgccuagccagcacugcccuuuucaaauccugcucugaaccgccugcucuauggagcucuuccacuccauccacgccagguugggcacucacguugaggugggugacaccccggucaaucugucgccgguggcgguuggaagugguaggaggcgcagcagguggcaggcugcgguaggagauggugcccgugugccaguugguccaauagacacggccagccuugacauggacauccauagcaucaaugcggacacucucgucacccuggaaugccugcucguaagccgaauggggguggccggggaacaggcugcggaucucauugucaucagcgauguacaggaccugguacucagagccuggagaagcaagaggccagggcuggggcugugggaugcaggugugcaccccacccagcucagcuccuuucacaugaacacugucccaucuccugguaggaccaucugcuccggccagaagcugcugcuuacccucccugcucaggguugcaggcuccaaccucagccucuggaccuccuccucuccuccccugagcugauccacugugacccgcuccuuucagucagaaagcugucccugccccuccagacccagagacuuccaccuccucacggcugcuggauggcaucaccacgcucucugcuacaaacugccuggcacaugcucgggggugcauaggcacauggggugugugugcuuggcauggagcacgagggugugcaugggagugcauggugggggugugugugccaggggugugugugaaugucuguguacaggcauguggaaggcaaggugggcaucaaagcauguggggaaugugcaggugaggcccccaugacugugagugugcaaugcgugucugaguguacucucguccuggcaguggugggugaggaggugugugugcaauucagagcacugccacaccccagacuccuucagucagccagccccaggaccugcccccacugcugggccagcacugugcucaggcagcugcaacuaugagucuggggcuucuugucugggcaagauguccgcaggaagacauuccauuccaagucggccccguuugauauccuggucgcccugccccacccagccuuucugcccucugguggcuccggcaccuucggccuugcagguguugugcgucuucaugaaguuccgagcgcagcugcagagguggccgcccuugguguuguugcagagcugggagcaggugccgaagcgcaggcacucguugaugucuaaggguuacagggagggucaugagaguccacaguugggguguccaccccugcucugccccgcuuuccuaccuuggcauccgggcuggccgggcacgguguggaagcccgagcggcaggcacaguaggccgcuuucucggugcgcacgcagcgugccucguccccacagaugcuggcauugguggcgcagcuggucagcuuggggucugugggggacagagaguggaugcccucccuugagccaccccaggccagggcuuggcucuccccacuccccaccagcguccgguccgcugccgggccucaccgaugcugcaguccuccucgucagagccguccccgcagucaucgaacauguugcagcgcagggaggaggagaggcagcgcugguuccggcacagaaacuccuucuugucuuugcaguggguggugugggcuguggggggcucugaggagggcagaggcuuuaggcccuggguauucuccccugccuccuccucccacggcaaccccauagauaacaguggcucccaauuccuaagugacaaggcuugcagggggagcaggucaaacauuuggguucccagccccaccuccaagaccuaaggcaucaggcagcccccagagccuuccccaggggcuucucuuuccuaacgaaaagcccccaggcuccuagcaauggauccuccccuuccugggcgaguccuccugguuaacccuaaccccagugcagcucccacgaggaccagacucaccccacugugcacuacccguccccugcaggccucucgucggcccccugcucaccacaguccucuucaucagucccauccccacaguuguccgugccaucgcauuggcgcccgauccacagacagacgcggucauucuugcaacggaagggccgguugggagggcacacgaaccgggcugcagcagccagggggacacagagccagaauuagucuugggagugggggugguugcuggccacugggaagccugggagccccgccccaaaucucaccacacuccucgggguucucaucugaguuguccccacagucauccucgccaucgcacuuccaggccagcggcuugcacaagguguuguugcacuggaacucguccagggggcagguccgcacuggugccagggggagccaagagauagaaugagccaugagcccacccagaccccugucuccacagguggggguuccaggcucagaggggucaccaggcaagcaguggcacagccaaauuggaaccaggucucuuaaauuucuacuugguggggccaaacugcccccucugguauuuaggggagaagaggccauuuuucaggggugucuggaggaguucagagggcacuccuucucugguauguggcagggcacugugcuguguaguuccacagcggggacgugggaacagcacugggcuguguaguuccacagcggggacgcgggaacagcacugggcugggaauggaagaccggguucccaucccugugccuggccuaccaaggcagagccaagacaucugcccgcacaguugggauuuccgcuccaaggcccagucuuuucucaucccgggcuucaccugcccccucuguacugcagagcccaggcaggucagcgagggacaggcacugucucacugcccccaggaagggaaaauaggcagggcuuuucuucuuguggcagcagacugucucggagggacuugugggguggggccuagaugggcacagcccucaggguuugcuggauuucagcucaacugguccccuagacuagggggcauugagcugggcacaacccgcacaaaaauguguauucaggggcccugugucuuguuuacuacuacgucccuaacaccuauggcagugccugguacaugguaaaugcuuaauaaauauuuguugcaugaagaaugaauacagaagagaaagaaugagugaaugacugggccauguggcggggugggcagcagagggaggacccagggagaccaagccaaggggcgcaccgccagugccgcaggccuccucgucgcugccguccaugcagucggcgucugcgucacagcgccagcgcagggggaugcaguggccgcucuugcacuggaacugguccaugucacagcggggggugcagucuuucugugggcaugggcacaggcagccggucaccucucggcacuccccaagcccugccugaacuccucugaggccaucugcuuccuucucaucucccugcccaccucguccgagccguccgcgcagucguggucuccaucgcauuuccagcgccccgcgaugcagcggccguuggcacaggagaacucacucucggagcagggccgaggggcugggaaggacagggggagacaggcccaggagggugggcacaaggacuccaggccucaguagugccacagucccgagcccaaggcccauccccgugucucugaaggccacagcugacugacccagaggccgagccaguccuggcagagcccacuggcugcuccuauggaacagcugggcacaggcgggcucgcacuuaccccaugggacagacaccagagaggacacaggucccuggccuugcccucagaacagacuguguuuggggaggggagcgggggcaagaccacugagacaagcaccaggguuuggggagaggucaaucaaggaugauggguagaggcacagcacagggauggggggcucugggacagagguggggguauggugggagcacgggcacaucagagacaccuaccucugcaaccccgagaggacagugugaaaauggagagaaacaugagaugaggugaaauggcacaaacucaaauacacgacauggagugggaugggugaggagggcggcuccugcccccacccugggagguggccaccagcucuggcgcggccuguggcaggagggccgcgagacaagggccaggccugggaggggcucaugcggggcuggguggguggggacguacugcagcucucuucaucggaguugucaccgcaaucguugucguagucgcacugccagcggccgggcacgcagcgguuguucuugcagcggaacugguauggcucacaggugcguucaucuggaggaggcaagugucagggcagucagggaaagggcuggggcagacauuaggguccaagcaggcauggucaggcuggccuggcagggagggugggcaucccagcuugggaagggucagccgcggggagcccaggcgguguuuugagacguggggucuauaaggagguuuggggacaggagacaugguugggggugugugugugggcagcugccuugggaaggagaugaacagaucccauagggugggcagggaaaacuccacacagguauguguggaugaggcgugggcaggggcagggauagggaaacugggagacauggggcacggguggauguggggaagugagcuccagccaggccuccuuccccagccccacagcaggcccaggaagcccagcagcagggccacgcugagaccgguaagcaggcggcccccagcccuccaccugccaggggugccaugccucccacccagguagacugucuuccuccuggaguggggucucggcucaccacacucuuccuugggcucauccgagccauccccacagucauccucuccgucacacuuccaacgcgcugggaugcagcggcccgaauccuugcagcggaacucguccacaccacaggucaucugggcugcaagcgggugggcauggggugaggaugagacuccuuccaggagugugccgggaggguggggagagugagggagcagccacugagggggucacacgucgggguggugugagcagcagacacuggggagggaagcugggcuccaggccaggcaacucacugcaguuggcgggcucaucacugccauccacacagucauugucccggucgcagacccagacccgggggaugcaccguuugguaauggagcacuggaacugguugggggcgcaggucaccucggcuguggggugggcaagagaaugagggcccucccuuacaccugccacuccaguucaccaucacugucuucucucucuuccaagcccuggccuugguccugccagcaacuucuucggaggaaggaacaguuuauccccaguuuuggugcuuuuuguuuucuggaucucuaugucucuauaucaugcaugaugauuuuuaugagcaaagcaaguuacacccaauauaauuuguguugcccaucuacuaaaguuauuugagagccucucaaagcuguggggagauucugccugcccugcuuccgugucaucucccaccaccggcccaccaccaccucugacacucacggcagucccucucauccuccccaucuccgcaguuguccugcccauugcagcggaagaugccgggaauacagcgguugguguuggugcauuugaacugacugggcaagcagacguggaugucuguggagggaggaggaggugauucguggcgaagggaggacucaggggcagggagagggugcccaucccucagcagggaggacacaggcuugagccauaggaauccagccuggagagcaagcugccgugggcugcaacuucccugcacuugaaagccccaaauccuggggcagggaagaugcuggggaaggagggagggugggcgggcagcgccuuaccacaguuggccucgucacuguuguccuggcagucauugucgccaucgcagaugaaggcaggguuugugcagauaccuguggagcacuggaacuguccgggccggcacuugaacucagcugccagagagggaggcucagagucagagcggcugggguggacacggccagguccacuugcagggcaccacagccccagccucuccaguggccauucaaagccucaggagucaggccuccgacacagcugggggcccuccugucacccccagcaggcacucacggcaguccgggggcucgucugagugguccccgcagucguccucggugucacacuuccaccagaaggggaugcacuugucguucuugcauacaaacuggagggcaggugggggcaagagggguuggugggggucugggggacucagaagucuuucuuuugaggggcuuggauguuucaaagaaguugaggcaggggucaggguguuauggggcagguugggcuauggugaguucggaaaggccagguauggggcugcgugggauaggguggggaaggcagcacugaagcauggcaaggagggucaagguuaggguguggaggugucugugugaggugacggggguaaaaguauugcuguggggagacaagagguaggcaagaaauguggggguguuagugugggaaaaccagaugcaugaggacauuaggacagagcagguguugggguccaaggaggauuuggggguuggggagcgggcacuggugauggggucugggggacagccucaccuggcuagccgugcaguuggacacacaggugcgcccaucgcugcccagguagaaguugguggggcaggcacauuugugcccucccccgggggacagcaggcacagguugcugcagccaccauuguugaccuugcaggggugauugggcacugccagagaaaacgucgugaaauauggugacauuuucuggccuaccaaaggcugccucacucacucuauccuggacagaggcgggugggucugaacccugccucuuuuaggagggagcugaagcuggagauaggagaggauucuaaggucccaggaucaggccaggccugaaggccagcuccccaccuccucugugcuucccucccaggggccggccugccuuccuucugggggcugggcacccagacccccacuugacuggccucagggacuugcugcugccagacuccagggcuggauccaggccgggcugaagcucccgggagccagaccauccccugucuagacccuccuggagucucccagugucuggccaggagggcuuggucaaugcuagagaagggaugagcaggaacucccagggaccccggugccuggcucaccguucgccugcucccaccccuugccugcucaccgucuggcuggcgcagggcauggaagacaugcagguccaugggccggugcagcgugcugaugaggagcguuuuguuggugcccguggucuugugggcucgguuaauggacuuuguuucccagucgguccaguagacguaguccucaaacagggucagugcaaagaugugcgggauguccuggcucagcacugcagggccaaggggcaggcacagugccagucagccggagcucggacagggugccggcccacuccaccuccucaagcccuaccaccacccugagaggugggugucagccccaguuacagaugguucaugguacagaccccccauggucucacagcuaacaagugucagagcuggaguucaaaccuagacugccucauggcaaguuccugcccugccaguguauggcuccccucgggaaguggggagcacugcaguucucaaucgcaggccucccacccccacccuccuuggggccaguccuccagaacuguguauacaagggaagggccucuccucuuccuucccaagggagcugggugguggccaggcuggggaagcccccggggugcucugaaccccacaccccagugagugguguccucaggccauauccuccgcuuuuuauguccacucuugcccccaaaacuugauccccugucgcuucagaccuccauccccacugagucugcugugccuggacagccucacuggcacacugaccaacguggcgauuggagccauccaggcuggcaaauucaauguaguccucgcgggcgucggcccaguagaugcgcucagugacauaguccagcgucaggccauugggccaugugaucuugguguccacgaugacgcugcggcuggacccauccaugccgaugcggccgaucagugaauggucaccccagucuguccaguacagguaccuggcgauggguaggcagugagcccugggagaucccguaacccaucgcaccaguggccugcagggaggcugggcuuggaugcugcuuucaggggcucccccaacccuccucagccacauacccauucugcacauccaccaccagagcccugggcucacggaggccagagcugaccagcaccguccgauaggccccauugagcuuggacaccucgauggugucccggccuuugucgcaccaguacagguugccacccacccaguccacagccagcccaucgggguugcugaggccuguacgguguaggaccugcaggaaggggcaggggagggagagcucugggugaccugggggaggaccugcaagccucugugaggcucagccuccccucguguaaaaugggguagagcucccucugacagcucuggugggagaaccauggaaguaaaaugcccaguccugggccugacacuguguaggugucagcagaggcucuaggagagggggcucuaggugaaugggaccacgccccaagccucacagugcuuggccagaccucacagggaacuuccugaugauuaaggagacaugaggcuggcagcgaggggaagggcaagaggaaucucccaguccuugcugucugggcccagaggagagugagcagcuagaacaagcagucauauagugacuaguggagugagaaggaagcaauuuggguugguggggcgggaaggagagacgaucugaaaacagucaucugaggcgggccaguguuggucgccgagggccgcccgccucaccugcacauugcucccguuaaggugcauccuucggaucaugcugcccuggguggucacaucuguccaguagaucaucugcucucgguagucaaaauccaaggcaacggcguuguucaggcccuggauuuggggagugaaggacagcagaagucgguuguggcaacaggggccacauuugcaucugggggagggaugguuggaccuaagcggggagacuugcaagggaggcugugcugggucugggagaugggcagcggggaggagggccuggguuugguaccugcuuaaguaacguguaguuggacccguccagguugagcuugcgcagguaguaccgguuggcgaagaucagaaacgguuccucgucugcagacagaggaucuugccucagcuccuggcacauucuagcggcccuggucuccugccugucuggagcucugccacccgggcagucccacacagccugggucaccucaugcccuccaagcgcgcaucucaccagucacagccuugcagcugugggggucgccgccgcggggugcauagcccuccacacacagacacuuauagcugccaugaguguugaugcagcgcuggcugcaggggaagguggugcugcacucguccacaucagcacacguccggccgucguccuucagccggaagccagggcgacagcggcacugcaggcacagggagccuugggcugggcauguggcagggucugggccucccacccuggagaccuggcucagagacuccaauucccucuacccggccucacuaggggcagcagcauauggguacugagcccacccagcuggcccacagugcaggccuccuucugugugcccccgagugucauuugacagagcugcgugugcccuccccauggaaaugcuuucuucucguggcuguucuccugccucagcagcugcuccuucucaggcucuucugcugguccccucacuucccugcuccuggcuguugcucagcucggggcucagacuuuggacuccucucuucuccaccuacacugcucccuugggaaucauauccaggcucacagauucaaauagcaucucuauggugauaacucccagacuucccucuccagccugggccucuccuugaacuccagaccuguguaucucuugccuacuugaugccucacuccucucuuccucucacacugcauaucucaucugucagcaaaucugcuggcucucuaccugccagauagaggcagaccccaaccaagcagauuucugucucauucacugcuguauccccacugucuaggggaugaaugaaugaauaaggcaguggagaaaggcguuccuggcacgucugggguguggaagcuccuccccagggcugggcauaccuugaagccgaucuugagguccucacaguccuggcugcagccacugagcuugcggcugagacacucauugauguggcagccacgcucguccgagcugucgccacagucauccuggccguugcagagcagugccucagccacacagcgcccacugcugcacaggaacugugacgaggcauugcacuugugcucugcggaggggcggaggcggcaggucagcggggucucaggcagucuggggagggggcagaggggagccaggucuggggcccaccuuggcuggugcaguguggguucuugggagccucgucacucuggucguggcagucauucucgccaucacacucccacuggcgggagcucagacagcgcccauuggcacagcggaacucacuggggccgcaggucggguacucugggggaggaauggaccugugaggcugaugcccuggcccggcagagggcagggccuccucccaccaccgccgaaggcucaccacacucgggggacucaucagagccaucugcacagucacggucguggucacacacgaagugcuuggggaugcacuggcgguucuggcacaugaacucacggucgucacaagugcuguuguacacuguggacagagguggacacagcccuucagcccugccuggccagcggccgaccgucccucacucuaaccuccugugguucuccugguagagugggcagggcacuggaugaggagucuggacaccugggcuacagcuauggcuccgcccccaguggaccccgcugaggcauuuccucuccugcaccccggcuuccccaucugcaaagugagacuguggccauuugcuguccacccgcuccacguggccccgccacucacagcaaccagcugcgaugcucucgucugcaccaucagcacagucuuugucaccgucacagagccagcgcucggggacgcacacgugggugccagggcaggagaaggaggaggggccgcacgucuugccuucuguagggggagagagggccacugagagacuuaggagcggguagaucaggucuagcaguggaggugaugguucgccgucgucugcaggggugucugugugugggguggaguuggguggggucugucccucccuggggcaccucccccggcccaaucccagcuuccuuaccacagugagcagccucgucugagccauccccacagucaucgcugccgucacacagccacugcuuggagaugcagcgaugguucuggcacucaaacugggccucugagcagaacuugucuggggcagucagaagccacaguuagauggggaagggugggggucacccaccuggggaggcugaugccaugggaaggacaggagagaugcccacagcaccccucugugggggggcucagcagcagcuagaggcagagucucugagucugaccucaagaguugggguguggggcaggggguugaaggcucuggaugcccuuuuccaagggggcauuugcugggggggacuaagaaguggggcccagcaggcucuuggagcacugagugggugcaguggucacucacugcagugggucucguccucgccauguucacagucauccucuuugucacacguccagcucauggggaugcagcgcccacuagggcaggcgaaguaauucagagggcaucuggggcguuucacaccuggggggcgaggcaggugugagggcccugcucaccgcaggccaccacccaccacacaccugcccccgcccaccugggcagucgcgcucaucacuguaguccccacagucauuggcgccaucacacacccagcugggugcguagcagagugagguccgcucgcagggcuggaagagcacgcccuucacgcccaggcggaaguagcugcugcagucgguggcaccuggugggggcaggggugagggugauaccugguucccccuggaucacccccgacuggggcagcugccagcccuauggagccuucauguguuuccaaaaguugaacggugcccuucugguggggcacugucugcaccaucugcucacugcccccucucggaaccccacgagagcccaggagcaggagcgggauggggacagggccucagggagauggaggcugucagcggggaugagggaaggcagagaggaaugugggcaggugcaggagggccugaaggcgggagaugcagugagcgauggggaggagcccaggaggugccagcaaagggcgucacucacugcaguucaucucaucugaggcguccucacaauccacaaacugguugcagcggcuggaguucccgaugcaggucccgucccggcagcggaacucgcccacaccacaggcugucucuagaacagugcccgccccguaucgucaggccagaguuuucucugugggggccagaaggacgcaggacagagcuccuggcccacagcaccugcccuggccugucacagagugccuugaaccagacaccacggggcccagggacaaagcuuggccagggagggguggggcaggaacugagguacagauggguuaugccagugcgccucacucacuguugcaagggaucucgucagagccauccccacagucgucggccccguugcaccacagcauguuggacacacagcgcccauugcugcacugccggaaagucuucuugcagcggcgggagucugcaaauggaggaguaggcugcgugucagccacaggcacagggaaagggcugccucccugagacgucaugcacguguccagcuggccacccccaaacccaaaggcccaguccaggcuaacagugguucugcccuucaugagcucccaaaacucauggucaggaagcuggguccugauccugcuccauccugcaggggccugggggaggaggaccugggcucugggccuggaagaggcaggggcugcagggggcuccuuacugcaguaggauggcuucucaucggacuuguccuugcagugggggacgccgucgcaggucaggcugaaguugaugcacucgccauuggcacacucaaacucaucuugugcucggcaagaggaauucaccgcuggggagggagguggagggagcuuucugagccagcgcugugggccccagugcccacgccuccucccccggggagcugaggucaucaucagcgucuucuuggcaaaaggcuuuggggggcugggcuggagcauguaggggagauggucaccaucccuggugugugcuuggguuccccgccagccccucccccccgccucucucaccucggcaggugaggucauccuggaggauucggcccccucggcaugagcaguugacauggcccuggugagugagcagacacagguccuggcagccaccguuguugauucggcauggagagaguucaccugagcagggacagggugggcgcagggcuggagaguguucucugcugugcaugcacccagagugcacccacccauucacugacuucauggagcucccaagccucugcucagucacggcaggcacagcggcuugcagccaguggggagggcauggggauggcugcugugggagggccaggugcaugggguuuucggcaggugugccguugaggaugugugugcuuuuaggcagggcaccgugggcuuugaggaguguuucugagagauucgagucugagggcccugagaucacgggugcaguagugagccccagggcgcaugggagacaccugggaaagcugcaggucugugguggggggcgcuggggcauguacucgugcccacugagggcacgugcacccaggcucucggcugucuguguggcuccaagugaggagagugaccagggugaggguaggggcaccgagggcauggaugagcccugaggggcgggugugacaugaaugugugugugcaacguggaggagaugccaggcgugugcagaguccaucugugugcguagaugccuuggugggaagggguacaggagcacuggggguuuugcgguuccaaagguguguacagcugugugugucuguguaauggaggcccagggagagcaggaccaggcaaguguguguggggugugguguguggggugugggguguuuauaguaugucugugagauguguguguguguguguggcauguuugugguacgugugguguguggugugugugugugcuguguggugugugugugauguguguugugggugguagguguguggcauguguauguguguccuaugugugguguguaugugucaugugugguguguguaugugguguguguauguggugugugugugguauguguaguguguguggugguguguguaugugguauguguggggugugugugguaugugugguguguaugugguguguggugugugugugguauguguguggugugguauauguggggugugcaugugauaugugugguguguguaugugggguguguauguguguguauguguuggggguguauguguauguggugugugggggguguguauggugugguguguauguguugagugugugggaggggugugguguguguauguggugugguguguguaguguaguaugugugggaugugugugugugguauguguagggugcgugugguaugugcgaugugugugugggguguguguuuguauguccaugcacgacaggcaggagggugaggcagcuggcggcagccccacucacagcuguuggugucguuggccacggcgaugaugcccaugggcugcugggggauguccacgcgcagcagcuucauguugcugcccacgugcuuguuggcccgcugcacugcccgccgcacccagucaguccagaaaaugugcuccccauacacggccagcccgaagggguggacaggcucugacuuuaggaucaccuguggagacagcaccaucaccgucacagcaucgcucaggccucuugcccagucuccaccggaccacagccuggccuggccucugacagcuacagaaugagggcccgcagaggcauccugcuaucucccucgucuagcugaugaggagcaagcuggacagggugggguugaccgaggcuggggccuggaggcacucaccuccucccagcuguucccaccaugucugugccuggacggucuugguugacggcugacccuggcccuggccuccccucagccgcccgccagcucacccaccccgcagacucacauagcggugggagccgucauacucgcaccgcucgaucuuguccaggguggcgucagagaaguagagcuucucggcacgguggucgauggccaggccauuggggguacggauguccuucucgauaagggucaggacauuggcucccgagagcgccgcccgcaugaugcugggaugcugcucauuccaguugguccagaacaugaggcugggggaagaggguccagagaucaggaggcaaagccugagaauccacaacagagggcacaggccaggacgcguaggcaccuggaaccuggaagccugccagggcaaagccaccccagagccauagaggccagcagugccccaaugcccaggaagggccccacuauugcacagacaguucacacacgagguggcugagugugaggggaugagggccaagugugagauauucacauugcaguaucugggcagugaccgucuacuugcugagaagagagccggugcagccaagugagacaggcccugggguuccagcccuggcuccaccacccaccagcuaggugcccuuaggcaacuuacucaacugcccugugccucaguuuccuccucuaugagguggggaugguagcaccaccugccucgcaggaugugagaguggaagaaguuaaucuccaucuuaaggacagauggcacacacuaugugaguauuucccaggaguuuauucuuaacugcucucuucugugcagggaggcuggcugucuuccagaucauucaggaagcccuuguggagcugaguguggcaugugucccagguccugggguauguggguccuauccucaagcagcucucaagaguccccuucuccguacuuugaggccuuugcauguuugggguuggagccaccguucugccucguaacggcuccaacuuugaaugagccugucgccccucugagcccugguuuccucucaguaaaggaggcaaugggaacagccagcccccaauuaugccgugcuccuugugggguggugcugaggcuggaggggggcuguggaaggccucagggcuggucaugcacuacccugggugugacagagugguccuuggaccaccggcauuggauggugagcccuggguccucggucccagagcuugucacucagcuaggcccagggcggggcaggggacuccacauucucuugcuccuaggcgauccuuaggcacaguggagucugagaccaccaagccacacaaaagccagcuccguucuccaguucccuaacaggaccugcccccgcccccaccccagugccucuggccuccuccuaccucugccccucaccauucuggccacagaucuguccucuggccugugaacuugucuccucagaccucuccaggucacacccuucuugcccacccccagcgucuccagcaccauugaacuaucccgccuucugcugggcucacguaggaaaauggugcugcucugccccucuggagacacuggcugcccugagccucggcgagcucgugagaagcucugaucuuaagggccucauccuggaggagagcagggguuugcgguggcucuggaaucgggauguaaguugggagggaggcggcguguccuucuagccuccauaagggaaaauggguauccuggggcaguggccagucaucuuccuggcuugucaggauuggacuuggccugucaguccccaccaggaacuccuacaccucaggugaaacuacucacaccugcagugagaagugguuuuccuccuggcgucaacaaacuccuccaugugacacaacuguggucugggugaaccugcuucccaggaauggggcaggagggagagagaggcuuuccugggguaggugcucaguguccaggaacauggcggaccuucuaacuauccuacugugagcucuacagggccaucagugcuccagugcugacgcggggagggcucaggaggaggcuggguuguuggagucuccacuugccccugcccucuccacugggguccacacuggcuccuucugauuccccgaaagugccugcuccuuguggccagggggagggccccuccugccagcucagcucuuucuccugggcacugggaccaugcucccacccagccacuccugccauccucagacgcuggcuaacaugccgccucuucaaggacacguucccugacuuccagguggggccaguccucagcacacagccacgaagcucuucaugacgccccucgcgcuccccacuggguccucugcaccuucuuugcccucaaaagccacucgcugaaugcgugauggaauccccuggccucauaagaaaggagcuuggugggcagccagggggucacguccucugggacgagggccaggcagccuugcuggacccuccagggaagcuccagacucaugagggacaggcucugaggccauccccagacaggugaggcagccgagggucauggaaggggggacuggaccuucaucaucagcugcagaugugccagaugacagaggcaggaggaaacagaggguccuugagccagguuggaggugacugacauugggggacugguggggggaaucuggguucgggacacucacguaucuauacagcugcuuuggguuguguuuacuaguuuccuaguaaagcuuuugaaaaacauuccaagcacugcugaauugggaaaaaaauguugcuaacaugugggccuggaucccuaaggcgaggggguggcucacuagaggcccaaacagccgggaugagggcugccccugcgggagaacagagcaggcugacugcgggugaacccuccagggggagcacccacccccgggugcuuucugccaccuguccuggcuugugcuccuaacuccuccgcacccugaccucacuuccuggcugggcucaggccugccuaugcucuauggcaugcagaggucccccucuguccucccugccuugaauuugccuuucuucaggcuuuugcucaaagcacuuccccuguccgagcuggccuuccuugucuuuuccaguuccaggcucugggccaaucuacugccuucaugacaccuguggucacccguauacagcccugugccaguuaccauuacuucccacaaguaugacuucucaacccagcuagguggcuugguaggcccagccuuaggcuucuguacgaaggguucgacaaacauucuuugccugaagcuuuggaucccagagcuagaggcccuacccugugccuccaacauggugcucugaugaaugaaucaaucacaaaggcagagcgucccccacaguccugaugcucccuuuggugcaggcagcuggaaucuuagccagcuuguaucacagaagaggaaccugaagcuuaggaagcuuuugcaccucuccccagaucacacagcagggaaggguggagcucaagugagggccugccucuccugcacccccgcuuggaucugccuggggaguuucugccaccccgagucccaccucucccugcuacccccauccccaggcagcagcucacuucuggcacucguccaaaacgaaggcccguggguggucaucuccagacauagugaugacggucucacgcucgaaggccccugggcgggucugguccacuguguggcgcgugaugguggaugucguguagcuuguccaauagagagugucccagccacggugauaggccaggccuuccacggagcccacgucugugaagagacaggagcagcgauuugucaggagggcccagagggcagccugcacaggagccgugggggacagccuggggcaggugcucuccuggcuggaaggcgaagugugggguaugggagugcaagaggugcagcagagagggcucgggggcaccagggucugacucagugcccccaaccucugcuguccucacucaaaugaccuguggucaccucucaacccucucccacugagggcaaucgggcuuucugguguguuugcacuuuccuggagcugcaguucugcugagcugagugcaauguagauuucuguaaaucaaauccugcuugggcuguacuggggagcccccuacuuaaaaagacccugagcuggauugauuauuuuauaaagcagacaucuuaaacucagguuaaagaaccaaggcacagugagagacacagccgaacagcaguguaagagaaaagacuagaguguuaguggcuauaagcgaugguggcugccaaagggccaugcugugguauggucugcagacagccggaggugaggggacaucccuuccaggggucuggggauugaugugccagucucuccugaucaagcuacgagcauggaguaccgaguuuagcuucggaugcuacauuuuuagacagacaugcaggcuggacuaugugcagcagaaaaugucccagaaaaggcugaaaggacaggucuguauacguagcaccuaguucggugccuggcaggucuuuauggaccagcugaaugaauauaugagcaaaugaaugagucaagggacccggugguaaccaggcugaagaagagaaaauguagcaggaugcaguuuucaaagagcugaaaggcuguccugugaugacagcccugacacuguaacugcucuuuccagagcacacacuccguccccagcaucacugagcuaagccuuccugcgcagcagcucgaggaauccugucucagaugagacacucauccacgcagaugagaaggcucaggcuuggcaagagcaggaaacugacccaaguuauugaaagcccaagugacuggagcucagccccaugucugcagccuggguuugugagcguugggcuccacagagaccucucgcuuguucugugcagcucugaaggcagaacuaggaccaguggcgggaggaagucgggggcugacgcugacuccaaaucaggagucauguaacugcgggggugcaguuggauucagcugaguuguagcugcugggauucagaccuaggguagagugccuggcuggggucuaagagucugugcugcuccccgccccaugucccacuuccugggaagacuuagggucugggcucacuuuccacaauggugauccuccuggagccaucgucguugaucuguuggauguucccaaaguggaugucgcugaagaagaugcgauugggggugcccggagaggugccugcccgguagucaaaggccagggcgaugacguucuucaugugcucaggguccucgaagggcugcacgggcgcauugagguugcgcucauccgacagguggauacucuugagaauggugcgcucugaguagagcagguagccggcauacucgcggcacgaugcuccgucuucagccagcaucccgugggcacaggcgcaggcccgcugcccacggccccgguacaggcacagcugcuggcacccgccauuggccaccgcgcacacguuggugccugggggaggggaggguacagagggcagggccugccuugggaaaggcucacuggugccuuugucauccaggcuuuggcgaaagcucugcccucugccucgguauucccagcuugaaugacccuccagggcccagaguccaaugccaagaucugucccagagcaccucagccuuuccuccccaucccugggucucucgggccaucggaaguugccccaugggucuaacuugucucccagcccucucacacuggguucccuggggagcacucucccaggccagagucccccucaccucuccaccccagcccagagccccagccucaccuuucugccggucccgguugaagacuuugaugucuuuaagcuggacgccgaugccgguucgcaggggcacggagucuguggcauugucuuugcucccgcgcuugauagagccguuggcaugaguccugagggaaggacagggcacaagcagggcaucaguggaggcaggagggaaggaagagaucagcugaggaggccaggacagaagcccucaccugucacuccaguagaugaaauccucaaacacagacacugaaaacauguccauguuguugcuggacagaaccaccucgcgguucucaccugucuccaggucgauccguucaaucuugucuguccgugcaucgcaccaguacagcuucccauccuacaggccagaggcacccaccucaccuccagggcugagcucgcugccagccccaugucuggggcagcagggagugccugggccagagugaggcccucaguucagccuccccuaacucacuccugccuccugcauacacuccugcccacugcccugcugauaaggugaccuccaggcaucucuccacucccccacuccccacuucugagcgaccccugcccaucaucucugugguagcaggaguccuacucuggguggagggcugggcugggagacccugugacuuccccugggcuccaaguccucccagaaugggcucaucacagggaacaggagccugggucaggggucuaccaucggauccaaggccaaguuggcgugcgaaccugguaguccacugagaugccguugggccagcugaugcugacguugaccagcaccacacgcuccgugccaucuagccgagaccgcucaauacgcggauacugaccccacucaguccagaacaaguaccuguaggguggggguggaagugggggucaguccucagacccuggaggagacagggccucaucagcaugggccaugggcagaaugacaaggccagucuuuccagcuccucacccuuucuccggguggacggugauggcccggggcuugucuagacccugggagaucaccacguagcggaaggagccauugagccgggcgaccucgaugacaucaaagcccuggucuguccaguagauguugccuaaggagggaguugguggggcucagggagguuaggugaggacagguggaccuggugucuccaagcucccaggcaccccuacagcuccucuuccugcucccgccaacuccuccucucacuucgucccccaguccucugccacaccccaagccccacaaaccugcccacugcucaccugcgauccaguccacugcaaugcccuccacacggccaaugccauuggucaccacgucuucacgccacgucuggucccgcuuggcccggcugaucgugcucaggcccauguccacccaguagauggugucauuuucuggagguggaggaggugacauggggaugcccaauaaggcagggguaaggugaggggucaaaaucucacaaggcucaagacagaggugagagagugccggaggggccaggugcuugaaggggagguggagucaggguggcagcuguagcaagugccccaccucaggccaauucaggcagccucucacuggacccucagggcacaccacaccaccccuaaagcuccuacgccacgcccaacucccucugccaccaaauggcucaccagcguggaagucgaugccgacagccagcgaggucccggacacugggaccagggcaucugacuugucauugggauccaggggaauuccccugauucccucaugcacagaguacaggagaaaggaaccuacgccugaaagacaaggaaacuuaaggcauggguaucgccaacacucccuuaaacuugguuccugucacccuccaacuguucucugcuucuccuuugauaucauccccccccaccaucaucccuauccuccacccagcacacacacccuagccugaggccagagcaugggccgggaggaagcgcaccuggcugguagcucuggggaaccaccugcaggaccccuagccaccaugagagggcagcagagacucggauuucucacccugugcucugccggccuccacccagcacaacccaacccugcaccccugcaaguuccuuagggaaagucugggaguucagaccagacaaucaggacuaggugacuccaaaaucuagacuuccaguuuggugcucagccugauccuaguuuccucuuuguccucccucugucuggucuaugccacacccucucuccaacaucaaaaacucaacccccuaaggucacuccgaagccagucucauucccaguuaucccauuucuuuuucuuuucuuuucuuuuguuuuucuuuguuuguuuuuuuugagacggaauuucacucuuguuccccaggcugcaguacaaugacgcgaucucggcucaccacaaccuccgcgucccagguucaagugauucuccugccucagccuuccgaguagcugggauuacaggcaugcaccaccaugcccggcuaauuuuguauuuuuaguagagacaggguuucuccguguuggucaggcuggucuugaaccccggccucaagguaauccgcccucuuuagccucccaaagugcugggaucacaggcaugagccacgcaccuggcucuuuuuuuuuuuuuuuuuuaauugagauggaguccugaucugucgcccaggcuggaguucaguggcacaauauuggcccacugcaacccuugaaccuucccgguucaagugauucuccugccuaggucuucugaguagcugggauuacaggugcccaccaccacgcccagcuaauuuuugugguuuuaguagagacggaguuuugccauguuggccaagcuagucucaaacuucugaccucaagugaucggccggccucagccucccaaagugcugggauuacaggcuugagccacugcgccuggcccaguuuucccaugucuugaggcaccacuacccaugcaccucagaauccucccuugccuuuaucccuuugauacagcacaucccaaagugaauccccacauggucccugguugcucagacucagugaaaaaaaaaugaauggucaagugaguuuuggaaaaccccaaacgcuugaaaaauucuuggcacacauaaacauauucaaggcucugagaaguucugcagcacaaaacacuuuuaaacuuuguucaacucagaguuucuuuugguaaaaucuacccacaucaaagagggaggcuccuaggaaugcacuuuugggaaaugcugucccccagcaagcucauaaaucaguuagcagguucuugugaaaugcgucuggguuucauuucuuuucuucaacccuuacugagcccagcccaggcccaucaucucacacucugauuacuccuaauggccuccuaacugguuuaaccgccucuguuucuuccccaccaccauugcggccagguugaucuuccccaaacaucacuuuccaggcacuccuggcucagaacacaggagccccgccuagcucacagccuuaucuccaggacuuccccacacuuugcccaccacucuuggcuggggcuccugcacacaccuugccuuguguauaguucccucuccuuugaacaaugcauccaaauccuacuuguccuagaaaacccagcucagagcaugccucuuccaugcagcugccccgaucugccugcugacaucuauuuuuccaaaauccuacuggaggcacuggagagucauagccacuucauaguccaguguccccuacacgacgaauguagucuuguccccaagguaagaagaggaagguggggcuguaggguaggaggggucaggguuggggagcugggacaaggcugggaggaaagccaggcacugacccucgcaggccugcuggccacuccggaggcuauagccggcugugcacaugcaggagcgggucgucucugacgugggcaggcagagcugggagcagucaccguuguugacacugcagggguuggugcccuuauggucugggggcaggugggaggcagagggaaaggguuagguggcccuccuugggaccucagggucaggcuugggcugcucagaaacaggauggucacugacuacccuggaccuaaugggggucaccacccuacccagcucucagguuuucuguccuccugggccccuggccuugugaacagggcugcugggagccuacaaggcgccuuugugguaaggaaacaaggagccccuuugggugguggguacagccuaacccacuuacucccuugccccauggcccugcagccugcagcucuggacggcuccccuguugccccugagcccccagcggccgcccggccucgcaccuacccagcuggaugcucucgucauagaccuucaugugcaucaccaggguggugcuguuccgaaggaccacggagcccgagccgucagccuugcugcaugugcccaucuuuuccgacaccugaucagcccaccacagcuuguccccuggggcagcaggaggggaugagacccuugggaaggccccacacccagcucuccugaagggcccauuggcccuaagucaucaggcccgccccacauggugagagacugccccaagccagccccugucucccaguaggucuggccuggccugcucugcgucaucucugcuucgcccagcagcccucacccaugauggccagggcgguggccuugcccagcuggcuccgcauggcaucgaugaccuccagcccacucccauccagguugcagcgguugaugguaugguucccggagcugauccaguagaguuugcuuucagggaagucaauagccaggccuggaaaagggggagucacugccggggagucuggcccagggcuggggauccagggaagggagcagauggugagaacaggcacuaagcuagggcucuggggaggcugaggggcaacugaaggacccugcaagcaccugcuggucaaggaauuagggaggggcugugggggugggcagggaagcucguacccacggggcccuucuggccacugaagagcagggugcgauugcugccauccauguuggccaugcugauguugucaccaucgguccaguagagcuuccuggggggagggugccaagagggaaaggucaggguccucuucuucccagccccacaccccaugcuccccggcccugggcccuagacugacccacgcagaggguggacgacaaggccauggggcugcuccaggcccugcaccacugcguucuugaaggagccauccagccgggccacauugaucugcuucuuauuggugucauagcuuguccagaacagguuucgggagacccaguccacagccagcccgugggcauuuggcaagucugggggcacaaguagggagucaguuguugggugucugcagggcagugggucaggaggggagccagugugccuucuggagaaaagggaucaggaaaccaggcuggagcacugagggggaacaggacugggagaaggaccacucggaccaaguagaccaggguugggagcaaggggcggguggaggugcccauguccacuggugggcauccagggccaggaagaaccugcagagacgacugucuccacgccugugccguugaugaaggcccgcuugauggccuguguccgcacgucagaccaguacacacgcugcucgcgggcaucguagucuagcacugugacguugucgaugucgggcaccgugaaggagaugauguaguuguaguagggagcauccagguccacaccucggaucuccaucugacgugcguacagcaggaacuucuuaaacucuguggggcaugggcuggucacugaaggcagucccugccucugugcuucccaccaauccgguuucaggcccugccuucuucuggauccgucuguuugcuacuggcccuuggcuccguggacauaccccgcugggugcagccccccuggcagaccugcagccccuucucacaguggcugucucuggagccucuccuaucgggacccucccgacugggacucugccuuagcugacaaccgggauccuggggccugcggccuucccuccagccucaguugcucacuggcucuggagggaggggcuccuaccauagcaggugguguuguccuuguggagcuucaugaggugggggcaggcgcaggacacgguccgguuguaguugaugagacacaggugggagcaggggcccuggcccccauuggccucacagggauugggagcugggggcaggguggagaagagaagaagccagagcauccugugacuugcugcucccuacauggaccaccccuuccucgcccacucuccucccccuguuccagcagccgcuacuacuagacccuucucugcugcuagacagugccucugucaacagccggccuaccccugccaucccagcacagacuugcuccuguucucacugcccucuccucuccuaagagcuucuacagcuucuaaagaggcugcuggcucccuuccggcugcucgaggccccgagccccuuacccaugggcuggcgggaggggugguacaccugcaggucaaagggcuggguguugguccucuguaccacggugacauuguggccgguccacuuguuggccuuagccaguguguuuguucgccagucaguccaguagaccucccccccguacagcgucacugcaaacgggugcgacaggaacucguguccccgaagcaccuccauguggccagagccgucguaacgggcugaguaaauggcaucugaccuaagagcaugauggagcagaaugaggaugccagcugggaucucagcccucagagcucugcccaggugcccacccucugggcccuggccacagcccucccagcgaagagcaugggaccauucccuccccuaagccuugcuggccagagcagacagacagaaggaccaaggugugagaacccaacagguccagguuucaccucucaggccccgauucccaagccccaagggaaucuuucggucacuucuccccagggcugcugucagcacucagggcuuugaugaaagucagaaaaaggcacccucagcgugaaccccggggggcggagccugcagugagccgagaucgcgccacugcacuccagccugggcgacggagcgagacucugucucaaaaaaaaaaaaaaaaaaagaaaagaaaaaggcacccucccugggcagaccaauuagaaagaaguuuccccucccucugggcagacacagccccagcagagggaacagaguggagaggacaggugaguggagaggaugguacagugugaauaaccacagcugauggcccugcuuccgccuccucuaccugcccccuccccucggcccuggccuccccacgccccuccguccuccuccuccugugcccaguccuuugccaccguuccuaguucuagaucccuugguccuucucaucacccucaucaccacagguuccuccccaccccguccuggugccacagacuugggccuucucagggcacagagggugcugaccuggcgucaauccaaaggaugcgcuucuccagguaguccacggugagcccguugggccagcccccagagccggucucccggugcacggugcggcgcccagccccacucauggaggcugccucaaugcggggcaggcuggcaucccagucuguccaaaacaggauccuggggaguggggaggggucaggagggcuaaagucagggcccucagggagcgacuguggugggaucguagguagagggugggaggaggcagauggcacugaggaguaaggugucccuggccaggcugaaugggacuucaggggggccauggggccaggagaaggcugggcaagguccucacccaucccggggauccagugcgauugcccuugggugcucaaugucaccggccagcagggugguccggagggucccauccagcuuggccaccucgaucugauccagguuacucuccacccaguagauguugccugcaauccagucuacagccaggcccucggguguggccaggccauacugaaucaccaccucgaaacuagucagggcuggagaagagagggcagugaaagguuagcgucuccuggggagcugugcaugaaugugugaaauccugggagcccucgaugacccacccucaacccuggcacuucugccaaaguuucugaugugcccauauucaagaguaggacuccuauugucuccccaacuuuuuuuuuuuuuuugagacagggucuucugucaccaaggcuggaugcaguggcaugaucauggcucacggcagccucaacugcuugagcucaagugacugccauaaagauuuuuccaugcuaauacauuaugugugugccucauuguuuuagagacuguugcacaguguggauaucaucacaguuuacuuagccuccccccucguugauggacauuuguaaugguuucaaauucaaguuuguauuauuacaaacaauacaaacuucucuaguaaaaugugccucuuagaagccuuugcucagaugucaccuucucaggggaccuuccuugaccacacaacugaaaacagccuguuuugaucacugcugcaugcccacugcccaguguguacagugggcacucacuauugugugugacugaaggaagucuggggugcaccacgcugccugggacagaaagcagcguucagguacgccacuccuaaguggcuuuuuucuuucaagccugcaauucuagaucuggggagcagagcuccaggccauucaaagguaaggcugaucauuuuguuaauuaucaggcuggcaguucugcugacgauaauuacggggcgucaggcauggagacccacagcaaaaucuaacccaaugaacagaagugugggggaugggggagccaagccucugcuuuggggccacuuggaugggaccuguggccccuagcgccugagcgcuccgccugugugcauccugccuggcagcaaucgguggucaccuccguuguccagcagcuucccgcgguagaucuuguccuccaccacgucgguccaguagagggcgcucuggcugagguggaaguccagggcgaugguguugcgcaggccgggcaccaggacgcuguagucuccuuugugaagaucgaugcgccggauuucauggcgguuggagaaaaugaugaacggcuugaaggggucugggaugggagggaugugauggggucagcaaggggcuagcugccugugugccacccguccuggcgcaggcaggucucugcugguccgggcacugggggcuaggguggaaaacucagccuuuggcaccuggccaccaagcccaacccacugcagcucagaggccugccucggccugccccaccacaccucacuguugucucacccaggcugcggcagcucucgccgucagguuccaggacccagcccucguagcaggagcacuucacgcugaacuuguucuggucgcacuuuuggcugcauuugagaugcuuggcacaguagcucuggaucuggcaggugugguugucgggccccagcuccaugcccagagggcaggaacacacaaugccuucgccaggugccacugagcaguuguggcugcagccaccguuauucagagagcacuggucuaggggaggggcaggcauggaacagacccagggucagaagcugagaggaggcaagaccacggcccugcugggccccaaguccugggcagccuggaccaaguccuugugcccugcccacggccccauucgucuccauuccugcugagcuucaggcugagcuucagcccaggacuuccugggcucccucaggaccagaguugggacccuugcacccaccagcuggcaccauaccuccccuucccacagggagcaccccucaauaucucugucuggucucgauauguuccugccuucuugggcccagggcgggggccccagcuuuuugccucccugggagggacccugggagguccuuagguccaguccccuugugcugaucucuccugauuuggagggguuugggguggggugcagcagggccuauaccacccuugguccucuggcacacccuggaaacugccagccugacugauagccugucggcaguucucccagccagucccuguggccuuaucuuccacuccucccuuccaaggaacugggggcucugccuggcuaagaggaccagauaaggcugcucugcuccucauccccaagucacaccacaugguccucccugacuccuggacucccccaaccucaucucuuuuggucuugaaugggcacccuccuccccuugccuguuuguuuguuugggauggggucuugcucugucgcccaggcuggagugcaguggcaggauguuggcucacugcaaccuccgccucccagguucaagcgagucuccugccucugccucccaaguagcugggacugcagacauguccggcuaauuuuuguauuuuuagcagagacaggguuucaccauguuggccaggcugaucucaaauuccugagcucaagugaucugcccgccucagccucccaaagugcuggaaugacaggugugagccaccgcgccugcccccaugccuucucacucacucugcaaguacugccuguccuugggaaccccaugcaauccccacauccuccaggaagccugcccugaccaucagcagucaacccuggugccuuugucuccacaagagcacuccgcaucucucugugguaugcaugugggcaaggggucugagucuccacagcaguuuaggagcuguacuaccuuggcccaagucugggggaccacuauggaaccccuccaugccucagugcucccaucugucaaacggagaaaacagagcaccuggcccccagggaugccuuguggauaaacugcucuaauggcguggcucacucagcacagcgccauggggagcgccagguccacacaggcugcuggugaccacucugggugcugcucgccugcccggcugccagagcugcucucuccuagacucaggucccccaaagacuguccuuggcccagacuccuacccagccacccucccuacccuucuccugggaccaggccucaccgcagagcucgcccucaucugagccgucgccacagucgucguugccaucacacagcuugucagggggcaggcagacugagguguuguuggcacaagggugcgaggguggccugcaggccagggacucgcaguucuccucguccgaguuauccucacagucauugucgccaucacacacccacgcuuugcugaugcaccgagcugagggacaggugcacuaugagggcccaggcccggggacuggggcucccccugcccuuccuuccagacccugugggcuucucuaauagggucaggauugcaacgcugugggguccacgaggaaccccgaggcuuuuugggucaaauucacauaggcaacaaacaaggcaggaaucugcagcaggaggugcugaagcucaacucugguaggguuuuggcuucucagguccucugugcaggcucuggcccuucaugccuucccccacccaugacacacaagcuuccucuggacugccuuuugccuugcacuguccccagcaccacuccacacagcacagugccauccccuuugccgcuacucugcucucaacacggucuccuccugcccacauugugcuguuccagacgcccuccaaccauccucuucaccugaguccuugcagccaaacuugacacugggaucgcagacgugggucacucccucacagcucuucucaucgcuggaguccaugcagucaguguccccaucgcagcgccaccgcagggggaugcauaguccauccagccggcacuggaacucaucaguguggcagccaccagggggccucguggcugcagagggacaguggagggccucaggagggagggguugcccaggucagcccuccucaucccugugcccugccaccccgguaagcccagccuggggauaugagcagaggcaggccuggagagucugccaagcuuugcugacacuccuuggaagcaccaacucaguaguagagucaggaggcaucacaccuccaagggccccacaaucaccucaucuaauccccccauugacaccggagaucucagcuggagaagcaauuugcuaaggccugagcccaaaugcccaccuccuuagccucuauuucauucauucaugccacaaauguuuacugagugccuccugugugccaggcgcuguccuggggccagcacugaaccagacaaagucccuacccucauggagcuuagguucuaauggggaagagagacaagacauaacccauaaaucuagacuguaauuucagguauugauaaagcuauggagauaaagcuggguagaagcugagagggaugggggugaucugucagguaagauggucagggaagaccucugggcagaaggaaucugagcagaggccugcaugaagagcgagugagcccagaggaucccuggaggcacacuccaggcaaggggaacagccgcugcaaagucucaucuccgagauaggacuacgccagcacuucagaaaacagcacacaggccaggcgcgguggcucacgccuguaaucccagcacuuugggaugccaaggcgggcggaucacgaggucgggagaucgagaccauccuggcuaacauggugaaacccugucucuacuaaaaauacaaaaaauuagccaggcgugguggcaggcaccuguagucccagcuacuugggaggcugaggcaggagaauggcgugaacugggaggcggagcuugcagugagcugagauugcgccacugcacuccagccugggcgacagagagacuccaucucaaaaaaaaaagaaagaaaagaaaacgccacagcugcccgggaggcagagcuugcagugagccgagaucacgccacuguacuccagccugagcgacagagggagacuccaucucaaaaaaaaaaaaaaagaaaaaagaaaacgccacagcuggaguagagugcagggggaggggagggcaggaaugcaggucagagggguaggggugggggcccugcaggccgugcagaggggcuuggcauuuguuccaagggugcagggagccaguacaggcuggagggcagggccagggcaugaucugacuuauguugucaggaucacucuggcugcuguccugagaucugacucaggaggccaggagaggagcaggagcacugccugguggagccccacacucauacacucaugcugccacagacaccccgcuccucccccuucccuacccuggacccagcugaugcucucaucucaugccgggacuuucagcagcagucucugaacugauuuuccuuucuuggggccccugaaccucuucucaaucuaaucuuccucuagggcuguguuccgaaaucaccuccuacaucacagcaccuuccggcuuggaaauccuucaaagguucccagugccucccaaaucaagccucucacgauuuacaccugcugucaucaucugcccccuuugaggacagccucauuccccacugucccugcacgagccuuucccucggucugaacggcuccaccuggccccacugucacccuacggaagugcucaguuucacccucuaagucuugacgacagcauucuccggaccaugccauccccacuggaagacccucccuccuguccauuuaccugcagucuaaacacaacuccuccugaauggucccagaccauccagcucauaccauaguuaacaacugcuaccaauagugacacccugcuccuccacgccaggccucacauaccucagcucauuucauaaaggaggaugcccaggcucaggggaagcaacuuguccaaauuugcccagcuuaucugggagcggcagggagcucuucucaccacaccacacagccuccagaggccccuucucagaacccuaagggauaucaccugugccccucacccuccccuucacagagauagcccuggagacgcaauuacuauuucccaagcuuccuguggccuucucuguccucccucucagggcagggcucaaggugggcacucaacgcuguccagucuucuccuacuagggugggaaugugcccuaacucuauaaggcagaggcuguaaucuagugguccaugggucagaugaggccugcaggaagaguuuggucuguaguuuuuuuuaaacuuuuuuuuucuuuugagacaaggucuuauucugucacccaggcuggagugcaguggcgagcucacagcucacugcagccucaaccuccugggcucaaccucucaccucagccuucugaguagcugggacuacaggcaugugccuccaugcccagcuaauuuuguuuauuuuuuguagagaaaggggucucacuauguugcccaggcuggucuuaaacuccuggaaacaagugauccuccugccuugccucccaaagugauaggauuacaggugugagucaacacacccagccuuuuuuuuuuuucuuuucuuuuuucaagauggguucucccuauguuaaccagguuggucuugaaccccuggccucaagugauccucccacuucacccucccagagugcugggauuauaggcaugagccaccaugccuggccugcacccagccuuuuaaaacuucuaaaaucaacugccaguugguauggcuugaauuguguucccuaaaaagauauuaguccuaucccauaauaccugugaauaugacuuuauuuggaaauagugucuuugcagauggucaacuuaagaugaggucauaaggguguauccuaauccaauaugacagguguccucacagaaaggggaaauggggaucuggugacagacaugcccacagggaggacaccgugugaagaugaaggcagagaucgggucaagcuucgacaagccaaggagcugcaaagauugccagcaaaccgcggaggcuggggagaggccugggacagaaucucccacacggccucagaaggaacccacccugccaacaguugggucugggacuuccagccuccagaacugugagacgagagaaacuaauacuguaguguuaaaaauuugguaguuuucacauaaaaaucugcacaucuuccagagcuaggaagccagcauuccuugagagggcccaucccuccagaaaacuagguccccaccgcccccgaggcugggccccagaggccagggcacugggagccuuguggagccaggcccucucuccucugucucuucaggcucauucaucccugccugcagcauccuuuucucaagcuacuauuuaccaaacacaggccgugugcugagcacuuuucgugcgugaucucacuaaacucccacaucagcgcugugauguuggugcuauuauuaccccacuuugcagacgaaacucacagaggcccauggagauuaaguaacuugcucaaggccacccagauaauaagcugcagagcuggagcucaaacccaaggccaccaacugcaaagcgcaugauauuaacagcguguggcaaugauuuuucggcaaccucccucucccacaggaccgggagcuccugaaggacaagagccaugccuaggcuaccucuggcucccagaugguggccgacacaccgugggucugaaagacagauggauaggcugggugucugaugcagggggcucgaucucauccccaccccacgggccccuggugcccacccugguuggugcaguuggcgugugucucaucacuguagucuccgcagucauuguccccaucgcagguccagugcucggggaugcaacgcccgcuguugcacuugaacugggugcuagaacaggaguggcugcagccggcuucgucacuguuguccccacagucauugucuggcggugggggaagaaggggagaggcaaagcgggaguugguggagcagccuucucugugaucccagcuugggcccccugcccagaacccacccucagcccacccuaacccccccacugggaaaauaacaaacagaaaagacacagaaacugcauagacugcagcaugcaccauggcccacguggucaggaugaggaggaggagaaggcuccuggagggccccucacugaagcucagaaaggcugggugcagggaacauuaaacauuucauuuccccuuucuggcaggugugggaacaggggucugcuugcuuuugggggaaaggcagggguuucucuaguuuuggagggagagagguagguggggugcaggcguggccggcuugagacaagcuuuacaggccugcccugaggcuggcacugcugaauaccaugcucugggugccuggcuuacaggggcccugccuguggcuggcaagagugggggccacuucuggaccaagcucgcugaggcuggcugaaggaagcuccugcuuucucagcauugggugggggcugcuugacuugacccucuguauuuaugggacaugugguggagacugggguuuggguuauguuccugccucuuuuccaacuggauuugcuucucuaacucucuccuccccuugcaucuugggcuuuuugucaccaccucucugucaucuccuuuccucagaggcucccucugccgucucugcuucuuuccugaccacuauuugcuuucucccucuguuuucugcucucccuccucucuguugcuuuuucuucauauccuagcagcucuggaguaggggccuggagaaccugcagggggcuggggccagcugagcucugggugauggugcaugugcuucuaugcacugaccggcaggcucaggacaggucuguucgucagagccguccccacaauccuucucugaaacacagaaaccgccggggcaaccauuggcaugcgagacacagaaaaagugaggggcaacguggcacugacccaacacauccgcucacacaucagcugggacaggaaccacuggggcagcacgucacaacacaacacagacagaacagagcccugagacaccacacacggcagucaccugcccgcacauuuacacacauacuagcccugguggcucaaggcugacaucaccugguccauggcuaucugccaggugggcuucugagccugaagcccagagccugaggggugcaccaaggacuccaggaaauggggguuugcaaggagaaaggagucaggcaccgguuucuccuugcucugccucucuggcccaucucacucaucucucccuggccuccgagcccuacuagagggugggcagcucaggcccugccugggguaggaaugacacuaaaaggugauggucuccccuugguccaucguggcucccuccaggcauuucugacuucuccuguuuucucccaggcaacccagcagggauucaguguccuggagggaggcccugcuggauucugaagcccuuugccuucccuggagggccuggcuguagccucuagcugucuuaggaaucagcaggugaggagagcaagcucuuaccauugucgcaucuccaguugauguugauacaucugccauuguugcagguaaacugagucagggggaagcaggugggauaggcugugaggaagaaagaguagcugaguagggccuucacgauuacacagcaucacaguacugggcaggugagugcagcggcccucccauaaccagcagcccuuagcccagucaggaaggguggggaaggccccgcagcagugccucggcuggaaacuccacucacucauccccaugagucagcagacacaggaccugugcugagugcuuuuccugcaugaguuugcugagacacaaugcugugaugauggggcucuccucucacagaggccaccgagauuaacucacucaaggccacccaagugcuggguugcaggugucuccggcacccccaacuggcaugcucucaggaugccccucccccaggcccagccugacucccucugcccaucccucuuaccacacgaagcagacucaucagagcgguccccacagucgucauccagaucacacguccaggagauggggaugcagcggccacuggcacaggagaacugguugggggggcaggugcgggcuggggggcagggaugggugugaguacucauuguccugacccucucuucacugccucuucuucccuauuauucucugccuuuggugucccuuauuuccaaggauccaaaaccauuucucuuagagaauucaaaaccaucucucuggucucacuggaugcuuuacucuuucucucaaggggucucugguauccucccaggaggagaucuacccugccuuguuccuccucuccagucuagagcuaugcucuguccccugcaagcucagcccucucaguuucccaggcugggaaggggauagcagaccccacuccugcucagggcuccauccccucugcccuaaauucuuuugcuccuuucauuuuauuuuuagagacaggucucgcucuguugucuaggcuggagagcaguggcaugaccauggcucacugcagccucaaccucccaggcucaagugauccucccaccucagccucucaaguagcugggacuagaggugcacgccaccacgcccggcaguuuuuuuaaauuuuuuuuguaaagagugggaggucucacuauguuggccaggcuggucuugagcuccugggcucaagugauccucucaccuuggccucccaaagugcugagauuauaggcaugagccacugaaccuggcccccucgucuccccugccuccuugacugaggggugccucgugugaucugagccccgcuccacaccugaacaaguggcauuggacucaucuucacuguucccacagucauuguccccgucgcagagccagcgguuggggaugcaccgguuguucucgcacuugaaucgguccgaggggcaggugugcugaucuggggagggaaugagucaggggucagcgagaaguugggugcccccagcuuccugcccgcuccaguauaggcacugccagagccgagcugcccugcaggccugccauccaacaggguggggcagggcgugugacucacggcagagggcuggggccucaucacuguuguccaggcaaucguugucuccgucacacuuccagcgcuccuggaugcagcggcuguuggcacaggcaaacucgccuggcuggcacugggguggaggcacguaggauggguucgcugugggcaccacaggaucgugagggggaaagucagaccccggucgugggacaaguacuaagcccuuugcaccauuuuuguuuguuuuacuauuuuuuaauaauacaaaguaauuuuuucuaguacaaaauuccucaugaaacaaauuaucuggauggaaacugcaauucuuucccaagcaacaauagugauguuuacucuacuuaaugcuuacuguacuucagugugaccugagaaucaaaugguguccaagagagcccauggccucuauaccucugucaccaccgaacaggcucuccccacuccuucccugacuucuccaugaacuuccccuuggaagucaucuccgggaaccccagggcccugccccggucccuggacuuuuuauuucacaguuucaucggucccaccagcagaagugaagauggcaccacauccgcgcaggcuccacccauccuguccccagaacguaugccucaccaucacuaucugucuuggcccauuagcagcuaaaucacgacguccuuugucugugccuugguaaccuccacaagugcaggcuccugugugagcccggucuccagaccucacagcugggcgcuugccuggucugacucaucucccaccccucucuaaucucugaaacuucccauggccccauggguggcgauuuccccucccguaucccauggaccauggaccuggaggcugguauguguccuccuugcuccucacugcuguucccuggacuguucuuccccuuacaucaugcuucuguaccaaccucuacuucuggaaggcucccaggcugcacccugucaucuguaaggguuuuuagcuccuggcucaccagcacuuucuccaaaaucacuccugguucaguucuuggugacuucaacuuccauguggaugauccucccauuaccuuggccccuccauuccuuaacccucucagccaacgcccucuccugaccccagccacucccuccuagguguacacuauggcugcacugacccauuuucacuuccgggauucuauccuaaggaaaccauccagaauaugggcaggcaugaugaugugacaaauagcagaggcaugauuacaaaacaggcucugggucaaacuucauggguuuaaauccugcucuaacuuugggccucaguuuuuucaucuguaaaauggggauaauaaaaccacuuuucccaccaggauguuuuuagggguaaacaaauuacugcaagggaaauguccaugacagugcugagcacacaguccaugcucaacaaacauggguugugauuauaucaaaaaacuggaaacaaccuaaacauccaacaguagagaaacgguugaguaaauuacgugaaauuuaucaaaugaaauauauuuuagccauuaaaaaugcugcuuauguacucguuacauacugucaagugacaaaagcaggaaacagaacaguaugugcagcacgacuccauuuaugugaaaguaaaucauagggaaacauuugggaggugguucccccaaaugguaacagugguuaucuacaggugguggaaucugggaugauuugggcuuucuccuuuguguuuuucuauacuguuuacuuauuucauuguuuuguuuugcuuuuugagaugaugucuugcucugucgccaggcuggagugcaguggcacaaucucggcucacugcaaccuccgcuucccagguucaagcgauucuccugccucagccucccaaauagcugggacuacaggcgugugacaccaugccuggcuaauuuuuguguuuuuaguagaaacgggguuucaccauguuggccaggcuggucucgaacuccugaccucaagugauucacccgccuugggcucccaaagugcugggauuacaggugugagccacugugcccggccuuacuuacuccguuuuacaaugaacacaacccauuuugaauaaaaaacaaggcuuguuaaaaucaugcaauaacaacacagaaaaugcugugacacuugaaccgaaaagggcagaagacauuuuauaaacagaugauuacagcuauguaaaaaacaauuauaaccccccugaggaaaaaagaaugguguucacuuuaccacaaugcuaacaauauauggugcucacuggugggauuugggcuuuuuucuccucucuaauuuccaacauauauauuauauguauuuuuuaauguuaauuuuuuuuuuuuuugagacagagucuccaucugucgccuaggcuggagugcaguggcaugauuucggcccacugcaaccuuugccuccgggcuucaagugauucuccugccucagccucccgaguagcuaggauuacaggcaccugccaccacgcuuggcuaauuuuuguauuuuuaguagagaugggguuuugccuuguugaccaggcuggucuuaaacucuugaccucaagugaucagccugccuuggccucccaaaguaauuuccaauauuuggaacuauuuauuauuuuacuuuaguaauggagaaauacauuuaaaagaagugaaggauaauuuccuccuuccauccauagcuguccauucuucacucaguuuccccuaauugccauccccucacaagucccucccagccucccaucuucccuaaacucccuccuagcccccagagccuuugcucucccccucccuugcuuccuguuggcccccuaagggccccucauugccuccuuaaucucugacugggacccuggauccuccccuccccacucuucggcauccuccugauggggucugcuucccacucccacccagccaggcaccucauacccaagcaagugacgccgucugcguccaacaccugguccucagcacaggcgcacuggcggcucccagggguggccaagcacaggcugcugcagccgccauuguucacccggcauuuguuggugccaacuguggggaagggccauggggaaaggcaaagggaggaagaggugaggagaggucagagaagggauaggggaggagacacauuaagauguggggacagaaagaggaaauauggagaggaagaagaucauguugaagaacaggagacacagacauggggcaggaagggaaauggggaacagagaaucagauuguguugggggaguucucuucucaggauccucaaaagucagagccuaggaucccugggaagugccuucacucccagggaagucucaaaucaaugccuaagucccaccaccccuuccaggucccacgcugcccccagccccaaggagguaccuugcugcugcugggcaucauacauucggaucucaaagauggggggccgcucacugcgcagaagggucacaguggggggugcgccuccuacaccccguuccaagcgguagacacugccacuccgauacucaguccagaagagguaguugccauggugacacaggccaaaggcgugguucagcucaggaccuucauacacaaucuagggauggagaggauguuacuaaggaguuggaagaaaauugagggaggccugugagaucacuguuuuguacauucauuugucuauguccugggcauggguuuugcuuuguuucccccauuagccugggagccccagagagugauaguuuugcacacagugggaugguagauccugaagccagcgggugaucgagugauccagcaaggaugcugauggugagguuguccauaugguccucuccugggcucauuccuauucauucauaguccccaaacacacacacgcacacauacgugcacacacacacacacacacucauaugcgugcgcgcacacacacacacuaaugagcagacgggcaguauucauccauucauuucuucaacauuuaccaggaucuguuaggggcugagcuguaguagguaguaagaggugaaaacgacacgaucucugcccuugagcuucccacugucucagauagggcacauacgggugauccagugugaagaggggucuggagaugacauccuaggggagguagccccugagcagucugccaggggaagaggagcuggggugaacauuccauguggaaugaacugcaugaguaauggcacagagggcagaugcucugugacgugugcugggaggagcaagcugucuagugcugcuuguucaaagaguguugggaugaaggaaguggggagaaaagagaccagagagggggucaggggccauaucaugaagggccuuauauacuagaacacguacaugacucgugaagcacaugacaacccaaaugaccaaguguagagauaugccgucccuaggcccucacacuugcagagagugcagacacacaccaaggcaugccguguaucuaugcacacacaugaggaggcgcacaugguguguaugcagagacuggcacauggacagucaacuucacagacaacacgaauagacacaaagagacgcaaauggaggcaauccucaaacaaacaacacaauacauaagacaugcaagcucacagauguacacaucuauagaugcacagaaaaauagaugcacacaucuauagaggcacacaggccuggacacacacagauacccacauacucacacagaaccucauccacgcccaagcauggucuagcaacacacacagauucccccacacaggcacaugccugcccaccuuccggucugugccauugagcaguaucgucucgaugcggucguagaaggcauccacccaguagaggcgcccagccgggauguccaggcuuagcccauugggccaaagcacugucuuggaggugacaaagaugucucggugugagccauccauccacgcccucuccagccgcccacgccgacuguccuugggguccuccucccagucuguccaguacauccaccugugggcagcgacuggucagcaucaccugggcacccccgccaucaacagccuccccugugaucccaauccaugagugcugucccagagcuccucacaggggucuccuguccugcucaucacuggaccacacauuucauucauucacuccauucaacaaauauuuguugagugccuguaaguugggcacaguuuuggcauucauggaugcaguggagaccaaggcagccaaggucccugcucccacggagcucccaucccacaagaaacaggucaaucaagguuacauggagagcgauaaaggccaggagggaaauaaagcagggugaugggguggagagugaccgggcugcaggugggggugucaggggagugauggagaaggccaccaugaggagguggcaugagugagacuugauguagagaagaagccaguccggcaaauaucugggaguuccaggcugaggaacuccaagagcaaaagcccugaggcaggaggagccggggugcuuguuugagaaacagacagcaggcaguggggacagaacuucaagugugggaagcgggaugcagaugaggucagacaagggccaggcagacacuguggggcugugcaggccugacaagaacgugggccucauucucaggguaaggggagcugguggaaggcccugaacugggagugacaggaucagauuucuucuauguuuaaggaaucacucccauuucccugaagacagggacuccuucuccccuugcagacucucauuccugcuaaaguaucccgccucaccugccuuccccugcuucccuguccauuucauccuccaguuaucugaggcccacacacucccagcuccucccaccccaaggccugggaggacucacccauugaguggauccaccacaauagcccuggggugugucauuuugcccucgauuaaagucuugcgggucugagcagcuuucuccagccuggccacgcugauugucuuuuugggcccaucguccguccaguacagauugucucccauccaguccacggccacacccuccacauuguggaugccuguugggggaagagggaccagugaugaacagcuucaaaggaaguucaaagcugccugccucuggcccucccggacucagguaccuuugagcagucugggcuacagaggggugcagggacccucuggggcccuagacagauggguggggguagggacaggaggcuggaaaaggaauaggggaaagcccugugugcugccauuuguaucagggcuagccucucaaaaccacacguggcagaugguaaacuacauggcugaugugggcucucgugugagggcaucuggcccgugccugcauggagagcugaaacaacgggcauguggcucugggcacaagugugacaucauauccuaggccuaaaaauccugaacuaacaaaaugaauaaauuaggaagugauuuuucacuuagccaaagccuucacuccaaguguccuuuaaauagcaguucccuugguauagggaccccuaaucuuuuccugaugaguuacuuuugauuuccccaaagucuugugauaugauugcugacuguugauuuucucugaacuacaguguggauggggugcagggcaaagguuauaacuggcauccaccagauugauggggaggcggccugauccugaggcccaagugcagauuuggggcagaacucguacagcucagaauccuucacauagacauuaaaaagacaaugcacugugaaccugcccaagcagcucagagggaagaccuggaugcaacucacaaaacacaauuuucucaggacacauuagcaugcaguuuuuggcgacugcaaggucagcugcacagacccugugugcgcacauacaugugggugugcccuguuuugaucuggcaggccugucuccaauucaagaccucaguuguccccuggcugugugcugugugcagcuccagggcucuaagccaaugcagacagacccugaguuuucccaagggcuggcaaggacggcccaugcugccuaacccauccuaacccugccucuuuggcucagccaagaagggggucacacaggggucaaucugucuauccccucaucuccaugccaaccagugcagccagccagucagcaggggaccauccugcugagagggcaccgagaaacagaugccugggccccagcccccuuccauccccaugggccacaucccuaggagcccauaccguccuucaggauggucucccgcucagugccaucaaucuucuggcggccaaugagguagcugguggugucggcaaaguagaugaagccggucucagcguggaaguccagggcucggggguucaugagguuuucaauggggaucaugugcucauccgggaccuuggcccccauauccaugccccggaugaugccuggccggcccuugccauacacgaggaacagcucaugcuccggcucuagagcaggcacaagccaggguacagucagacacacacaugaccaucauccccacccaggggcugcggccaaggggcugcaaugcccuagcugugaugggucaggagacguuagggaugcgaggcucugggucagauggacagaccacgcacacgcuaacauacaggacgauggguccuggccgcaauacccuggggucugaccucugcacuccaaggguaggaaaugagggaagaauagcagguuuucagcuaagugcccacugaucagucaugaaaucagugguauaaaaggaguaccuucaaaauauguuggagucacaucacuguuuaccacuuccucugcugccauccuaguguaaaccacaucacuucuugcccacuacacugaaagucuucuggcuacuucccuacugcccaucccccacccaguagcagcgugacuuuuauacaaaugugaauccaaucaugucacuuccauucucaaaagucacuaugagcuuccuaucccagauauaauaaaauccaaccccugccuccuucucugcccucacaccacucagccccgcuggccuucgugcuguuccucuggcuugccacacucacacuggccucagggccuuugcacuguugauuuccucugccggacaugcuccucccucagggaguuacaugguugcccucuucauuucacagagagcuuggcucaaacaccacauccucagagaggcccuugcucuccucauuaacucuauucucugcuuuauuuauucauuuauuuuuaauuuuuugagaugaagucucgcucugucauccaggcuggagugugguagcgccaucucagcucacugcaaccuccaccucccagguucaagugauucuccugucucagccuccccaauagcugggauuauaggcacgcaccaucacacccagcuaauuuuuguauuuucaguagagacgggguuucaccauguuggccagccugguguggaacgccucaccucaagugaucugccugccucggccucccaaagugcugagauuacaggcauaagccaccacgccugacuauucucuguuuuauuuucuucauaaccacuuauuaccaccuaaaguuacauuuauuuguuuccccaacuagacuauaagcuccaugaggccagggacaacaucuaucucguucgcugcuuaauccugaugaccagaacagugccaaacauguagugagugcucacugcucacuagacacuugcugaaugaaucaguuuaguuuucugcagaguccggugggugagugagaaaagcacuuuuuucgaauauggauucaagucccaucucugcccucacuagcagguacacucugggacacuuccuucaucucccugcaugucagacagaggcagccgggcugugggggacaccugaggaacccucccgcagccucccaaugggcacacacccccuucccugucacucacucuugcaugacuucccgucacugcccaggcugaagccggaacggcagcggcagguccgcgccuuguggcuguuggccagcaggcagaugucagagcagccacccggcuucccauacuggucguuuucacaggcauggcuccucacugggggcagggugaagagcuguuaggaccccucagagccccugugccaggccuugagaaggcuuccugaaucugaccacacccccugcugcuguggucuuugugcuugcuaucccauuuuaggauuuggaagccacagggguggaaacccucugccccccaacaacccagccuucaaacucuuggagugggggcuucaguagucagggaagagaguuccaggguugcccauggccaggugcuacugcuccagacuggcaaggggaaugggagggacagagugggaucuggaggcugaguggguggaugggggcuggcaggggaagcugaggggccagggcagguagcccgaguggcuggcuaggagaaucggucaugacaugaaagaagccaggguccccacaggagggcccagagaggggcugugaucccaaggucccagagccaucaugggguaaagccagcuuuggaggggccauggagcccugcucaccucggggcugacgccucuggugguagauguggagggcaccacccuuguccacccgggugacaaccugguacucggugcuguuaaagcgguucacacggaucacacucgucuucugcugggcauuggcauuguccgaguugguggcauagagauaauucucaaacacagucaggccguacaggugcucaaucugagacgggcaggcaagaauggacagcaugagaugacagggguuccucccucuguccuggagauccccucagcuuccuccagacuucaugaccugcauuccccaauucauccuguaguuuuuaauuuuuauuuauuuauuuugagacgggaccucacucugucacccaggcugaagugcaauggcacgaucacggcucacugcagucuccaccuccugggcuuaagcggcccuccugcuucagccuccugaguaguugggacuacaggaacauaccaccacaccuggcuaauuaaaacaaauuuuguguagagaugggguuucccuauguugcucaggcuggucucgaccuccgaggcucaagcacuucuccugccucagccucccaaagugcugggauuacaggugugggcuaccgugccuggccccaccauuuuuuaacucaaugcuuuacuccugucuccucuggcuggacuaaccuauucugaagauuuuugcuuaccaagaucccacucauccucuacagagcaugucuuuaaagaauuuauggaaucuucuaaccagagauguuuucuccuucuauacauccuccgugacacugcuaucuauccgugucuggcacagugauuuguggacuuaucucacccacucuacucagaccccuugagggcagaaacccuguccuucacagaauuaggcacucguuagacacuuuagugauuuuagacugaauuagagaugggcucuaaacucuguccacagaggacauucuuagucuguuaugagggcuaagaggacacacuugccccaagcaaguccuguaacaccccugacuacccacauagcuuaucugcgguggccaacuguccuaguuugccuaagacaaagguaaggguuugcuggcuuaccagacuuucagggcuaaaacugggacaguccuaggcaaacugggcugguugcucacacuaauuaucccacaauggagaugccaccucugagccagcaaggcuucuagaacaaguuccagugcuaucacccggcuuuguaaacacaggcaaaucaccuaaccucuuugauccugcuuuuucaucugcugaaagggaacugaaccaccucccuguucaucagcuagggguuauuauaagggucaaaugagaaacaggaaguaaacagaagugguguuucuaaaaugacuguucccaucacaguggaacccguaucuuguccuuucucugcaguauucaagcccaccccacucccacuagaggccuggggcauccacgcucuuuaccaggagacucagagaacgguuccccuacagaggcuuccccccucaccagaaggcccuggaucaugguucccccacaaaaccucagacaguagcucccucaccaggaugcccuggaugauggucuggcggcccuugcccucauaguccaccacuucaauauaguccagauaggcaucugcccaguagacaaggcggcugaccagguccagcgugaugccaugaggaaacacaaucuugcugucgacgagcuuggugcgguucugcccauccaugucacagcguuccaccuuugggaucugcccauagucagugaaaaacaccuuccugugggaagaugcauguuaaauggggucuggacauugggcacccuccuuaccacuguagccucagccucccaccuuccagggccagaaccccgccugccacucucaccccauggcaggguccagggcaaugcccuugggguuguagaguuccaggucuagcaaugugacacauguguccccauuucuguugcagacaaagauccuaucaucgaugucauccacaaaguagaaguugccugucagccagucgauggccaucuguuccacgucuggagaguacgaaugaaagagccauggggugggguaggcccucuugcagagaugcccacccuuugcuggugagaacccacaccuggaagcccaccuucucuggacgcccucccacccaacacccccaugcuuagcucagaguggauauacaggagggcuugcguaaaugcuggcuggcugguugacugacagacuucccaauucuagcccauccuugaaaagggaccaucuucuuggggcaccaaaagguagagagcacagguccacuagcucaguccaguuuuuuuuuuuuuuuaacuuugcuuuuacuugggauaagagcacugaggcuaccaaaacauuacacaucuuugcuuuucacuggacuuuuaucuaccaucuacaguaaaucuaguuaucucaugcuaaccagaagcacugacuggaagcuggacauauggcauaaauuuuuaaaguggaaaagcaggguacacgcuaauaaacccaguuugggagaaaaguauuucaaaauaugaacucuacagagaugccaaagggaagauccaugggggcaaaagguugggcaccagugacaugggccaaacuuccucuacucagccccaguccccuguuccugcaauguccuuauugcucaauguccucauguccuggggagggucagaagagguggggaauaagucauagggcuggaggagagagagucuaggaggagggccaugaaagaauccucagggcaaacugaggcauggcucagaaagagauggggcuuaaggaugaugggagugggggaaggagauggagcccagcugccuagacucaguuucaggcaugguucuggaggagauggaagaagccaagaagagccaaaggaaagagaggcagggcaaggguggccggaagucaaggaggcaggaagucuggggacagggacacaugcuggccuccucugggcuccuccucuccaggaccacuggcuuccuuccaucuacucacuacccccuucaacuaccaccaucagagauggugccucuugcaaacugggaaacuccuaaggcagugacuuucugggaccccugccuggaacuccaucuccaacaguuuccccaacaaguaaagaaaucuuugggcuaccugcuuugggcugaaacucauccuccauuacccauacucaacccaguagggauucuucugcccccacacagcuacagguauaaugacuugcuguucugcuugaccccucccuaauucccccuccuccccacagggauucaggggcugcucccuaacagugggugaggguggggugggggcaaaaagaacaggaacgccgcucucaaggaacuuggcugggcccugacacugacucagagucacaggacaggaagggaaggagccaacugagggcuucaucaaacuaguuucuucuucagguccucucugcuaaaucccaucccaaugccuggagaacaaggccacagagacgagguauuacccccguaaguauucaugcauccccaagcccagccacucuuuccucugggcccccaguacugucccauccucacaagauuggagagagggggaagaguagcuugaggaggccaaggcccuguaggaagagggccuagugcagggguaaggcaaccaaauucuuugccccacacgcuguaaccacagagaaaacagauucaaaugaaugcugcugggcugccuccaaaggaaaucgaagucucaaagcagggaccugccugcauccccuggcagccagcaggguggcuggaagucaaacagggcugcgugcccuuuacuuggugggcacggcaggggucugggggcugcuggcauguguaugaacuucaucagugaaagcuguuuucccagcaccagcuggcgcagcuacggccggccuucucuccgacuuccugaggcuucccugagucacugcccagcccuagggcuggcaauacccugccccugcucccccuauccacccuucucuuggcaagagagagaaggaagaaaccugcagagaucugaugccgcuaucccaggugcagcuccacaaucagcccccccagccucaggauguggccuggauucccucccaauuccgggaaggaaggcagagagaucaucccugcucucagauauuuacccuuggccggucucccuuccaccuccccaaaggccaggcagggccccacucagcaggccggugaggaguuggcaagaacuggaguccucggccugccuggccuccccuuugguauuuuugcagcuggagacuauuaguugcaagcaaaaauccuuuguuauccaacccccugcaccacauuauuuuucucucuccuaaaguucagauuccucugccugccccaccacacacacacgcacauacgcacguaugcacacacaaaugcacgcacaaucacacacacacacauacacuuggccaccacuccaaggccaguguagagagaugggcucaaagggagaggaggaaccuugccuccagggcugcccuauaggcaguaucugggccaccccucucugucuuaugaauugggguccagguggaguccugggcuucagcccagagauccugagcauucuggcuccaccaacccugaggggagccguccccuugucgcccagccuucuaagggccaaccaccugagcgcaccuucugaagaggcucuggccaaaggccgaaaauccugaggacaggagaaucucaaauaaaccaaaggggagagagggaggcuguguuguggaaggaguuggggguggucuaggggcagaggggcaggggauuccagcaugaagagggaggcuaggaagcagggaagaggugcaggagucagacgagagaccacagcugcccauuauggcacagaggacuuucaguuccaggccccagaauagaccugguguccuggcaccccaucccacugcucagcaucugcacucacuacaacuccagcuuuucucaacuucuccaucauucccauuguucaagaggcauuuccauacaugguggcugcuuucccaaacacaugggacccaccccaugcccaaaaagacucuagcuucagcugcaggauucuagucaccugcucuaaaauaaggaaaucggaaggaaggaagaagccuuuauguccugagaaaaugucacccaacacaucuacacacccaagaguguauacacauccaaagaggucccuggaccucuauccacauccccagggagcacacuagauucuggcccuuguuccaggaaccuccccaccucuccucauaucauucugcucugcccuggguccaacugggcccuagacacugacagccugaguuugaauucugguucugucaccuuccaacugaggcuaugagcaaguuacuuaaugccucugagucucuguuuccucauuuguaaaacuggaugguacacuaacugcacuuagcaugaggccuggugcaugauaaacacuccccacaugggggcugcgguucccaccauguccuccccucccugaacccauccuuucccaccuuuuccaccaagucgcccucugugccuccagccagagcccuguggccuccugacucuaggugggcccuccaggugggccauuuggggcuaacaccuacuacucgucaagacucggcucaggcucccagaaggaagcuugcccuauuagaaggaaguuuucaaggccaggcucaguggcucacgccuguaaucccagcacucugggaggcugaagcagguggaucaugaggccaggagaucgagaccauccuggcuaacaugguaaaacucugucucuacuaaaaacacaaaaaauuagccaggcgugguggcgggcaccuguaguccuagcuacucgggagccugaggcagaagaauggcgugaacccgggaggcagagcuugcagugagccaagauugcaucacugcacuccagccugggcgacagagugagacuccaucucaaaaaaaaaaaaaaaaaaaagaaggaaguuuuccuguuacaggcuccauaggccucuggagcuucuuugaucauggccucuucaccugacugcaaauacuguaaggagagcgcugccuuuugucuuugucucaggcgucugacacacauguauugauccauugaacaaauauuuauugaagacugagucuguuguucuagagcugggacaucauuuucccccucucuucuacugccaggauccugccucucuggccuugggacacuccaagacagugggagaggacagucugucuaguaauccuacucagggaucucgccugggccugggagagauggcggagagucugaggacuucgaaggugggaaggagaccuccuggcgagccuggcagaagcucugcuaaacgauguggccucaugcuccuuguuuccugcugggucccgacuucagcucuuccuuccaccagccagucuggagcuuagccguguugugucaccucguucuccugggcucucuuccugcuccugccugugauuccagccugugguuauguccugcuaccuuccccugccuggcuuagguccccaagaggcauuucgaccuagaucccagggaugaugccuggauuccacucagcccaucuuagggucuucccucuauugagaaauccuugccgggcucuaaaacacaucucucuugcuuaaguuacuuccuuuggcuugaaaacagcaaggggagugcugggagcagucuggguggagaggcaauuucaaggagacagcgggggaggagaggacagggcuggaucugggccgggagacacagggcuggcccgggccaggagagaggaggagcaagagugagcuguuaaaugauuaggaaacucagaacaggaaugggaagcaaaagugccaggaugcagggggccuaaggccaaagagugggguggcuagagccaccccuccccaaacagccuggcaucccaugggucagaaaggccaaggaugggcaugguuagcuuucacaugugaagucuggaagugcuuuguaggcagggugggaggcugagaggguccaggggugcccagcacaguggggagguagcaccccuuccagcagcagcagccaguucauuagacucagagggacugcugucugccccuucuuugccuccccucuagacaaaucacuaccccauuuccuguugugauuucgaaaacacacacacuaaaaaaauaaauaaauaaaagaaagggagaggaagggaaaagugaaguuggccagcuggaccugggacccauuucgcaaccuugcugccugcagccuaggggcccuuugcugagcuccccagccaccuccuucuuccccaugcagcauggugcagggaggggaacccugagaccucugagagccccuucagaccauccuuucacacacaguccaaacuccugagugacuucagcaaacccgauuuccuucaaggccucuauuuacaaccucagaaccuccccucaccauacacacccauguucccaggaccccaaucuugcagucugccucauucuuucuacagugguggcauccuccaaggugaagggaauacagaucagaggagcucagcuuaggaaaugcagggcugggcuggggucgguagacugcaccaccaggccugcccaggggcagccuggcaggaggcuggacaaagcuggguuacaggcuccauaggccucuggagcugagagacuggucagaggugggggugagagugcgcaggccugguuccugacuaagggacuaucaggccuguugaucccucugggccucaauuuucagaacuuuagucuuuuguguaucacuuucaaaaugucuaccaugcuuauguacagcuugcgcuacuguuuauuaccaguuauuucaauuaacuuacuuuucuuauuucgcugcaugcuaaacaauugcugaaguaacagauuugaugugcuaguuacaggaguuuccuaaugcauaucaaauaaaaacguaacuauaacaguuaaaaaaaaaaaaaaaaagcuuguccagguaccaucuaaaaucaaaucaaugcauagccccuuugagaaagcaguagugaaagccagggcugcucuugguacuggccaagggucuugccuucucuuccggcucucaccauggaguucucuggucuuggaauucgagccucauagaccuccccaaaccacugggccagcggcagaggggagggggagguaaucucaggugggaggaaaagagaugacccacccaauccagggggauaacacugggccugaggcaggagggucagcagcccuggggcauugaagaggaauguucacacacugcagggccucaggggggcccucgggggcucucaggacuccacaacaggucugacucacauggcccaggacacaugugaaccaggcucauuuccuggccuccuuccuucuuucuauucuauuucugcuuccagaguuuucucuggggcaggcucccccuucugccugcaccagcgggcuggccucgcuggcucgaacaccccucaauugucagacuccucccucugugugcaccccugcugcaugaggcucagccccagggguccaacagaggucacagucacagcacagaauggaaggcuugcagggagggcugcccuggagggcagagugaaagcaggggaaagcugcagccuuucuucuucguccuccuuggggagcuaauuacaggccagcagccacugugcaggugagugccugggaccagccacccuacacaccagggcaggccagucagcaucuccuggggagggggaugacccagaaacugggggaggggcuaggggagagacacugacguccucaguuugggacccauaauuaguuugugggagagagcaaaacaaccauccucagggugacagccagacauucaggcggcagggacguggagcagggggagggcagggaggaagggacagaagcugggaugagagaaacccacucauuuaccccacaagcauuuccccuuggacucuucuagccuccuggacucugccccugagaggcccagugaguuuagcagacugggaggcaaggcaaaucuguuugccaagggagggguaccagcuucuccuggggaggaagucagauaaggagaugaggccagaguagaaguugagaagguuaccuccaggacaccccauagccaccuacccagaagcccacuguauggcaagaugcagggcuggggaggaaacugacaagcugucugcccagacaggccuguugaguaggucaguggacaaggaacagggggagggcagcugcacaagagggucuagcaccaaucccaccccaucagccaugggguucccugagucgcccacucguuaagagcucagccaaccaggcuugacagcccccagcucagcaccccaaggaggacacaugucugaucacaggugagcuguggacagcagcagcccaaggacgcuaucagggaugcucuggaggagccaaaggcagaaaugugaaccuuacgcugaggccacggagagugagggcucucagaggaaccccugcucgccaccaucccggggaggggccuuucucucucccagaaugaaucccuuguaaccuccugggaucuuucuuuucaucacaagaaccaaauaaagaaacuugaagaucuucuagagaggcccaagguucacaauccucaacuucaaagugugcuguccuuuaccacuggcuuucacuccaguuaaucugaucuagacagacaagcucaaacccauuaugcagauuaggaaaccaaggcagagaugggaauucugguuuacuaaacaguuacagaucaaguuaaucucccuuagggggucagaucaaccacaggccagauucuuccucucagcccuguggugcauuucuuuggaaaugugaugcugccagauguugacuuuuaagguugcugguguaacagccucugagaugggcagggcuguucccggcagugggucuacacccagcuaugcucgugccccuuucugugacaccccuucuuccacaacuaggauagcaaaaguguagccuagggagaagccugaauggaagcauccaggauauucuaaaaucucauguggcucacgcuccucucccagccucauucacugccacaaagccacagagaaauaaccucaguacugcccucccccgauggcagcagagaguccauuggcaaugguccccgagggaaacgauggcccauggagacagagcagcugggccccagcuccuuuacccucagcugcagccuaacagggcaccucaggcuuccgcuccuucuuucccuagccuuggcucccacugcaccggaaagucccucugcagucuagucaacacuccccucucagagaagggacagucccuggucucuggagauugaccauucacugcccccucagcccuuggccagaaaugcaggggccauccagacacuugcucagagagcugggagggagcgugccgguggcucugccccugccucaaacacacaccauuguauccagccuccugcuucuccugccccagacaggaccauccuguguaacucccggccucuguucaagauaggguccaccuucccugucuccccuacccuccccagcccuccaagcugagagcaggugacucacggugcagacugagggagauguugauggugugcucauccacgaagcccuuuaggccaggcaugcgggcacacuugagcugcgucugagcagcacuguccccaacaugcacccagcauacggucucguuggcauagcugaaguccauggcuguggucugccgcgugcucguaggugugaugguagacaccugggccccacucagguacguggccaagauguucugggaguuggcuaucaacagcacagggggccggucuacuggcucugggaauggggaagagaagaguccgugcagccagggcucuaggaccaccucucaggccaccacccaccagggaacagcauugagggggcuuaguuagcacuguggccagaggcaaccccacccaccguucuuggccuugcaggagcgguuauccggcugcaggagguauccuucaacacagccacauaugaaggagccgucuguguuggugcauagcuggcugcaggugccguacacugagcacucaucaaaaucugccgaggaaagggcaagaauguggucauuuccagugugacaagggcaacgaagugggugaucaucagacaugaucaacauguccauccuuacagcuaccuugaaggacaguucggcagaaucuauuacagcaugaaaugugcaaaccuuaacacccagcaaguccagucuuggaauccacucuagagaaacacucguguacauaucacucauccacgcagggaagauuuauugagucccuacuaugggucaggugccaggggugcaucagugaacuuuaaaauagacccacauugcuguccucaugaaacuuauauucagauaauaaaugaaauauaguuacuauaauaacauaugaaacaaaguaaauaaaguauacauuagaggugcuagugcaaugaaaagagaacagggauagagaaugcagauggcagggaugcaguuuuagaggggucgggggacggcuucacugagaagguggcauuugcacaaagacccgagggaggcaaauuuaaaacagaaaaguuugcauugcuuguagcagugaaaaauugggaacaucucacucaucaacagggaggugaccaaguaaacugugguaaaagucauacgucauagugguuucuaaaagaaugauguagaucuuuacauauuaacacagaaaaaaaaauuguggaacauacugaugagugaaaaacauugaaaauaauauacacaguauacuauuguuuauguaaaaaagagcacgcaguacucuugagcaguacuuccaauuagauuuucugugaauacccagagacaaaugcacaaaaaagggccugaaagagagagagcaaacugauaauagaguugaacuccagggagaugggaaggggaccggaauugagggggauuugucaaaggggacuuugguuuuaucuguuaaugcucuaauuuuuuacaacagaaaaauuuacauauaaacuauaauuuuaaggugaauuuuuagaagucuaguggaagcaaaugguuagggcucacagucaugcccuggggugguggcacccccucucuugcaccuuccuucuaguuucuuauuccagccaggcccccuaccccucucugccccucccugcccaccucaacuggcuacuggcacacacacaugcacacaggcacaugcacucacauaccuuugcaggucuugccaucugccugaagcugaaagcugcuguugcaguagcaggugggcccaucgaguguggggacacaauggugcuggcagcccaggcgagagcaguugccuuggagcucugugugggggcaggagagacacauauucaggccgccagaucuggcagcuccacgcaggccacaaccuuccccuaaacccagucaaccuucagaaaccacuucuaagggcugcagugucagagacagaagggccuuaggaagcaucuaccauauuucacaagugaagaaacugaagcccagagaggcuauaagacaagcccaaggucacacagccagugauggcuuagaacccacaugucucuguucuggauguucugggcuaccucuguccccauggagagggguucuggcacuuuguuggggucaacaggaagaggggauggugagucuuaucccuuugauaugccucucaucuacacugccuggggauuacaauguuggcuucagcuggggcugaaaagugggcauggaaucgugucuguccccacaggaucccagcucuggccuggaagcaccugucuaacccauccccggagcccuagaggccucagagagaaggccuaaggcccagguagaggacaggaaggaggagcaaaacugguccccucuggauucuuuucuaaucuuucuccugccacugacccacuuccacaggggagacagaagggaaugagacaggaggggggagaggugggagagcaguugcccccccagaccagcgacccaguuaauggccuugcguggggccaggcagccuggccacaaagaccccuuuguccagcggccucacacccuggcuucccacuccacccccaccuaggagagagagccgcccaagaugcuaagacguuuagaggcacuaagccugccaggaagaguugggauggggggccaggccccagcgauucuuucuccuccccacuuccacccgagagccauucaugcugccugcccagccuuucuccacagagggggaaaauaucauuugcucuggaaaaccuagaaaagaguaacuuuucuggauauagggugagggaaugaggaggccgauuucuguaauaucagagaaggaaauucagaccugagguuuuugaaguucucuguuguuuuagagacuguaaagguacucaaaaggaaguaagcuugaacacacaccacacgagaggaaggggugcgcguggucauuuaagucagcccccaggcccgcauucugcaucccgucccaggagcuucagaugaaaacaugcaaaaucaaccaaagaaagggagaaaaaucuuccacaaacuccuuugcuccauccucccugcuccuagugaacaggauccagaugagucuccucccacagacagauguuuucucaggcacacagcacaggacacugcccccacacccaagcacagccccuccccuagggcuacgcucauggccucucaaagcuggccucuugcuccgggcccagaccccgaagaaaagagaagggagaagccacuauucccuaacacgcaggcuugaggcucugccuccccggacacgacucuuaaaugcucacgcugugaccggacucuccauggcccacagggcccuuugggggaaagacuguagagcuggugaccugagccacaggcuggaagcagucugacuugucauccuaauguucccaccucggccuggauggcuuuccuaucaaccaccucagacagucuagacugucagagagggagggaccaaggcagauuuagggccccucaaagaucugcagcuccugggggaugccuucuagggcacccguaggggcggcagguggacuaaacuagauggcuaagcuuuagucacagcaccucugcuccucccuguguucacacucagguuucaugcagaaaaccuuuugaagaaaggaucauacuauuuuuaaaaaaguaugaaaacacugaucucucaucuuacagaagaaaaacugccaccuggagagagguagugacuaguccaagaacacauagccagagggaagugcccaggcuacagcccacggcugaggcccacagggcugucugaccaagcuccaggcccaaggggcacaucaauuucaucugcucucugaagguaaaucuaggcaggggaccaggacaaggccucauccccacugaaggugccaggacaguccucggaaggugggcugauaauaugcugcauccagacgggagaguagagaguggaaaaguccuuaccucggcaguggggccccucaucugagccguccaugcaguccuggaccccauugcagaggcgggacaugggaacacacagcucaguacccaggcaguuaugcucguuuggcuggcaucgcugggccuuacucuguggaccugagggcagacagaagggugggcaugaacaagcuggcuaugguggcucucuggucagcuguucacuggggaugaggggagauaaaacugggguuucagaucucaggaggccucggggcuaguuagacucuuccaccuggaacucuuuuacaauauuccccacaguagccacacaccuguaggcaaacagguggagguagaaacuaggccuucaguagaguccacccuccaaaugccccauucccauggaccccagugccucaacauucuaugcucaggagacaggcugaagacagccugguuuuugaugacgacugaggucaguaaaagguuuugaugaugccgggagugauggcucacaccuauaauccuagcacuuugggaggcugaggcgggcagaucacuugaggucaggaguucaagaugagccuggccaacauggugaaaccccgucucuacuaaaaaugcaaaaaauuagccaggcaugguggcaugcaccuguagucccagcuacucgggaggcugaggcaggagaaucgcuugaacccaggaggcagaaguugcagugagcugagauugcaccacugcacuccagcgugggcgacagagcgagaucugucucaaaacaaacaaacaaaaaaaaagguuuugaugagcugagggaagcaggguccauggcagagaaacuccaaugauaaagaaaaacuccuucccauagcucccagguugcagaacccagggccaagaguggugccaaaucuucuagaccuucacugcccaauacguagcccagucacauguggcuaucaagcacuugaaaggcggcaaguucaaacuguaaguauaaaauguacacuggauuuugaugacuuaaugucagaaaaaugcaaaagaucucuaaagguuuuauaugaauacacuguacuaaagugauaauauuuuggauccauuggauaaaauauucaaauucauuucaucuguucauuuuuaccuuuuuuaaguggcuacucgaaaauuucaaaauagcacauguggcuugcaauacauuucuauuggacagcacuauucuagacuuccaaccccacagcaacaagccugauagaaggauuugggaagaaucaaagguuguggucuggccaggcaugguggcucacgccuauagucccagaacucugggaagcugugucaggaggaucacuugaggucaggaguuugagaucagccaaggcaacauagugagaucccaccuuucaaaaaaagaaaaaaaaaaagguuguggccaacuggucauaucaucucugcaacuuccuuuguugcucaagaggauggaugagauagagagaccacugucuauuggcccccaagccuggacacggugugugagugacagugucuaugacccaugugugccuggaugggagucugcuuacacaacugaugguguggcuguauagcaugcagcgguagguagugagaguguaucugugugucuuucuguaugcugguguaucuggccucagugaguuuccaugugaaucaaucuggguuugugugugugugucucuauguugguaugugugucuggggacaucucucugaguauagaguguguuucugcauccacauuugagugugacucuguguuacugugagaauguguuugugccuuugggugggaggugggcucaucagugccaggugggucugugugugauguuaugaguccgggggguaugagugugaacagagugguaaugcauauaaggugagguuuacagcaaauugaaggaagaaugaacaaaaagaggcagaucugacccuucugcauggcuuucuuuacuucuaacgcccaagcaucagggucaaaagugugggggugcagguggcaccagacaagaagagacuccaggcugaagcaccaugccguagauauacuugcugaauaccccuggcccccacccuccagggcagaguguaggggugaggcagagcccacuaguggcucccuuuccagcccuaaaauuaccccugauaauuacggguggggguguggggacaggacaccagaugggacuggagcaggauaaagcccaagagagagaacagagacggaccuaggaaugcaggggcgcuuugacccuggcccagauuaaccaagcaggggagaggcuaaaaguggagccaccaggacugugccagcuacccaggacucuggggucccaccaacaaguucuccacuucccuuggcagggcaaaagcugggcggggaccuuucucccaguuaaaacagcugccuccgauuacaccacuuacugggggcaggggaaggcggggguagcgggaagagcacagggguggggcuucugguauggggcugagcaagugccaguggccucuggccugggagccaaaggacagaggaagaucugaggauccgacaagaccuggggccaaucaucaagggucagggaggcugagagguggaauaagggaagagcuggaaggaaagggaggccgggccaucuucuagcaaagcugucagcccagagaacacugucuuggggugcagcacuugagggagaaaucugaggugccauuucuaagcccaacaggcaccaugccaagcauuuugaagggguguaaaggacaguuuuagcugugucauggacaaauacaaucacugagcaagguccacaucaggcuagggaucagcuguccuccucccaaacaucugccaaaggaagagggauaaguuaaggguuuggggagaagaauccagaaaagguacuuacaaaucucaggggccucgucagauccgucugggcagucccucucaccgucgcaccgccagcccuuugagauacagguuauuugaucucugcaggcaaacugcuuggggcugcaagucuuaggggcuagggcaaggaaagaaaaggggauauaaaugaaggauggaggccaacucugugaacccaaaguccccuaguacugcucuuccuucccuagcaucagucuccaucuggcccagacccucagccauggucuaugugccugggggugucaggggguggcuuuggguaguuccuagacacuguguaucugcgguggggguggggaggauccagaagcacauuuuacugcaccccuccaaguccucuaggcugccuguuccugggagucagggucaaagccuuugcuauucuugguuacucucaucagacaccagcacccccuggcuuugaugacagagugauggugaaggggggugcauuuaggccuugacauguuuucucuuugucuuccucuaacuccuacuacuagaggccccgagcuggucuuaucuaaccucucugcuucccugccuucugggacacuccugguccccugacccaucaccccauccuucccaaccccuaaucacuaggcccccagaugggagcaguggggagggaugcccuuggcacacacaguaguaguuggagaugguauuagcagaggcacaggagggcaaggcugggcaggaaugggcaggguagagagccuugcuuccauuuccauucccuauuuuuuuuuuuuuugagacaaggucucacucugucccccaggcuggagugcaguggcacaaucucagcucaccgcaaccuccaccuccugggcccaggcgauucuccugccucggccuccccaguggcuggaacuacagacaugcaucaccauguccagcuaguuuuuguauuuuuaguagagacgggguuucaccauguuggccaugcuggucucaaacuccugaccucaggugauccaccugccuuguccucuccauucucuaaagacacagccucccuugguuagaccucagggagacuuucaguagacauccuuagaguuaagaagcaccuaaagauuuucaagauaucagaauuggggagcagaggcagggggauggcugaaaugaacucuaggaacugguuucaguccaguccaacuaguuagcuacuauauucaggaccucuuggcccuacccucccaccccaaucaggcuucuuccacuccuaccccauucucuucccucaucccccaaggaggaauuaagaauggugacaacuaacucuguuguuuuuuuuuuuuuuuugagacagaguuuugcucuuguugcccaggcuggagugcaauggcacgaucuuggcucacugcaaccccugccucccggguucaagugauucuucugccucagccuccagaguagcugggauuacaggcaugcgccaccacgcauggcuaauuuuguauuuuuaguagagacgggguuucuccauguuggucaggcuggucucgaacucccaaccucaucugauacauccaucucagccucccaaagugcugggauuacaggcgugagccaccgcacccggcugacaacuaacucuuauugugggcucaguaugugccaggaacugugguaaagcaguuuuuuccauguaucaucauauuuaauucccuccacaguaugacaaauagggacaacuaauaccaccauuucacagaugaagaaauugagccaggugacuuggccagggucaaauagcuggcaagugacaaaaccagcuaagcugacuccaagcucugaaccagugaaauccacaccaguccuccgaauucccacuccucccaaccucuaucaccacauccuccacaggaggaacagucacccaccccuucucccccacccaaggcugagcucccagucuccuggccuuucguggcuuuuccucagacugugccaucacauuucuauucugcuggcacacacugaaggccagcucuaugccaggcacugcacuaggcaucagggugccaaggagggugagaugacccucugcccugcaggagccagagucgccugagaagacagcuguacccaacuaaugcaaaugcagggcagagacagaaguauaaggaaaauggcggggggggggggcucuuaggagggagggagucugaugggagccucacugagaugucuucccuccuaacccccaccgcuggcaggggagacggcacucaggccccuggccaaaaugaccgaguucaggaaacacaucaaggauggccuagccaggcucccccuucagccucccuccccuggcccccacccugagccuggaauaaaggccccuugaggagguggauaaugcugaguucauugccccacugggccagcugugaggucuucccgggaaacacagcccgccagccuaguuagcaugccggagaaccguccgcuuccccugaccagccguggccggcugagggggaagaggggggcuggaaugggacucagaggcagaugagauguuuggagcccagaaacagacccccgugccacccaccugggacuugguccaugcccugcuccucccaggggcagagcgcacagccacggccugaggucaccggguggucaccuaaccuccccuccauuccacaucccagccauggugcccccuccuuuagcccucacugagucccccccgcugucccccacccccauuuuuggccugaacuccacagaggaaacagcagcuggcaaacuccaaaagcuggaaugagagagauucacaaaccagaugugcucuugcagggaggggaugggggaugggacaagugaaaggaagaggagggcccaggccccuaucccacagcagcaccgggggagggggccacaucucccgagggccuggccagcacaaggauugcagagagauacgugaaagaacuuccugucagggcugguguugaagggcccaggaaucuggagcgagaaggcugaggccugucuuugauuuccuucagggggagagggaagaaagaaacaaauaaacuacuuugggacagucuacacagccaagggaagccucacucagagcugggagagagcugaguugggagcgggguaggacccuuauaaucugcuuagagggaaagccaaccccacuccccucagcagagccuucugugucugaauccagcacccagaaaacccaccuuuguggccugcaguuuagaugagagaacaacauugcccuaaggucaaaagcaacuaaggccuuccccgccuccuggcccgcaugagagaacccggaggucucccugaccgaugggagcuaaccuuuuucaccuugcuaaccaccagccacugauuggaaauacggugacuauuaacucacuuagauacuauaacccugugaggugggugcccuugcggccccccucucacacaugggggagcugaggcacagggugacugguaacugagcaggugguuuccucauaggucaugggaugcagccggguuaagaaaggaaaccaggccgggcaugguggcucaugccuguaaucccaguacuuugggaggccgaagcaggcagaucaugaugucaggagaucgagaccauccuggcuaacgcggugaaaccccgucucuacuaaaaauaugaaaaauuagcugggcgugguggcaggcgccuguagucccagcuacucaggaggcugaggcaggagaauggcgugaaccaggggaggcggagcuugcagugaacugagaucgcgccacugcacuccagccugggcaacagagcgagauuccaucucaaaagaaaaaaaaaagaaagaaagaaaggaaaccagaugggcgcaguggcucccgucuguaguaccagcacuuugggagguggaggcggagaugggcggaucacuugaggucaagaguuugagaccagccugggcaacauggugaaacccugucucuacuaaaaauacaaaaauuagcaggaggcggaggucgcagugagcagagaucacgccauugcauuucagucugggugauggagugagacugugucucaaaaacaaaacaaaacaaaaacaaaaaacaaggaagggaaauugcagggagaacgcugucguucucuggcccuggcaguggggagaggauuuuaagggguggccuucagggcuccucagagaggagggaagggcauaggggagacagagaggagcaagaaugggacagaagaaggggaagacaggcaggagaagaagaaggagagaucuagagaggaaggagagagagcgaguuuggaggaagaacaccaggacacaggggccgucuguucucggcuuugccugaagaugaaugugacugccaugcuaacuuggccaacacccugccccacccccccaaacccaggcacccagcccagccacgguccccagggccaccaagcuggagccagggcaggagguguagaguugggugugcguccagacacaacacagaccccacugcccugcuugacccuuggcugucauucugugucccauucugggaccuuggggguggggaaguggggugagaaugccuggccagagagggugacagcgaaguccaacccugaaggagucuucuccagaggaggggaacccauccuuugauacccccuugagggagcgagagcaaggaagagagcuaagaccuuagaggugcuucuuaaaggacaaggagacucagggacugcaaaagcaugacagggacucuuggggcccuuuuuaagaguggacacagcagaaggagagauaggcuccccucugagcuaggugagagggggguucucuaaagggaaccacaugauauagcuaagggaacagagugggaggaggaugcucaaggugcgggggguggggugggggggcggcgcggggacagagccugcaggaaucugaauuuucgaccuuauggggguggggcagcaagggccucccaaacccaaaccgagagguuuucacugaauuuuuuguauuuuggguguugcccaguggcucuuuccugaggcucagacacauuuuugucauuccugagucugggccucugcuuugcggccuggacagacagacagacaggguggcuuggacagccaggggaggggaagggucuccgcuuccauucugagucaauauugaugcagcaggacauuagccugacccgugaccucccccaccagcuuuuccuuuccccacaaauaaaagccagacccccagaaggccuccagaggucaccauaucacucaccaggcauuucuaagccuccucuccuucuccccccaccccagccacacacacagcuuaugcucaccagaguaaaagcuccaaguucuugacucacuccuuacaucuuucuccaguucuuaggcuccuggucaggaggaaguucugccagaagucuaaccucccuccuuccuucugaaauaccuccuuucucccucuuagcccacaaaggguaucaaguuccuuucuuccagaaacauucucuccaaaacccauuccccaaauuaguggagggggaagaagaaagaggaagucggaggaaaguggagaggaaacuuuuggugcugaacuggacacugggucuggccaggaagggggaaaaauagccaaaacagaggggagggagccagggggugagugggaaagcccagagagacucuugcucccaagaagcuuuugggauaccaagaggccuggauggggguaaauggagacaggcagagaaaaauaagacaagugacagagacgcagaaagcagggcagagaaugucacaaagguucggcaguaagagaugaacugagagggugagagacagagagguucuaaaaagccaagacagcgcacacuaaugacagacagacagaaagacagacagacagccagaaaagccaggaagggggcucaguccagagauugccaaggggaugacacaguuguccugggaugaacccagagaaugacuaccccgcugagccuagaguagggugggagcaagaucuguccuaucuuggagagacagagucucggcccuaggcagugccugacucaagggagacccagaauagggaccacuaccaccccuggagucaggaggguagaaaggagggaggaaaauggagcucuucagccagggaagcuaaggccuggugggagagggagaggcuuucaucuccccuaggggagcaagagggacaacucuccacauauaccccucaccucuuucccagggaggguuuauauuggugccugaggccauugcaccggaaacacuccaaagccaacugcuuccuucuccaaacaaugcaggauccugcuaaccaggcugaaaucugggacagaagagggaggcagguucucuaucgcucauacccagcacuaccaagucaggggccuuccugcaguaccauucagcugcacccagaugccccaagagcaaugagcccacacgcagagcuggaggaccugaaagguaaagagucugaggagugaggaggacccugagaagagaguacugggcgggaauaaaccuaggcuuggggguucugaugugcaagggcucacacugcagcaggaggaaagagagauagacuugaguaaggaagggcuucccaaaagguaaggaagggguuuugaagaaugggggcaucuggacaggaacugacucuggccaggaccugggcugucauccuuugggaggcucagugguggaagggugguugagaaaaugaagagaggagagagaacaagaucagaagaaaaagaugucuagugaagcagcccuaaacaucaaaauaucccuccaaccccaaaaugaauuucuuacacauucuugcuuuaaaagacaacgaggcaaagggagacguuuaggaugugagucugaucagggagaaaggaguuuagaacuuucucucagggauccaggaagcuaacaccccagcuucauaacucacuuccacuguaccuacucuaguaacugguaauaugccggcucaaggggguguguggaggaaggucaggaaaaagggagggaggaagucagccuuauucugugagcuguauuugucugggggugcccuccccacuagaaaauguuccccaaucucagcagggcccucaauagucccauucuccaccccaucuuucugcaaccucuccagcagcagguacacucaauuuugucgcuaguggggagugacguuacuccccaaagggcaggggaccccagaggcaguuucaggcauagaagagaaagcagaagaggugggaaagccccuaggauugcugcccuggagagaaagcagcaaggcugugauagcaggaggaagguaacauacuaagucaggugagcugggucaucuccauucucuggaaaguaaacaagaaaguucaauguugauggacccugaggcaagagggcagggguuagggauaagggauccccuaggcugccucuggauagaguugaacuuacauuucuaugcaauuccccuuucucaccacccuguacccaagagugggguggagcugauuauuuauauucccacucccaaggcagaaauauugguguguguuuggggagggguccucuccuggggcuuuggauaguuugaucugagcuggagauacagagggggcgugggugaacauuuuaagaaaggguagggagauaguuaaggagaacauguccagucucucucuuccacuaacuugguguggcaaauagaacuccuuuagagcccugggagugaugcuaucuggggucccuuccugaccuucccugcucuccacagaaacccucuugcuucugccuaacucuagccacccuccuucaaggggcuccugaugggucucucucucucucaaauuuuuuuucuauuccucccagaagcggcugcaaccccaaucucccugccucgauuucccuucucaccucacagggcugagaacaagagaaaaacacaugauaaugacaggaguuauaggcagaagccggcugugcggcaucuggaggauauucaggaaaagccccucuccuccuccggggcagcuaauugguggggugggggugggggguagagaguccccaagauggcacaacugagggacacuaaauauguuuuuuggggacacagcugcuuccugacccuguaagucuccucccccaauugaagcaaguuagggagagggagggagauaaucugguuucagagaaaaacuuucccaaucccaaucuggcaagacagaggaggggguguaugaugguauccagcccaguuuugucuuuggaugagagggcuaagaugacaggaggggaugagaucccaccccuucucaaaucagggaccuagcccagcccaaccccaugaccccagcuuaaugcuuaaagcuugggcaagacuugaaccagugacucacaaguaggagaaaaaaacagcugacaaaaaaagggaagagaggcaccccauuuccccaaaaggaugcaguucuagccuaagccuaacucugcaauauacaaaguguguguguaugggguuuugggcuuggaggggugcagggaauaaacagauuuacuaaaggagugugggggcacagccauaauccccauccaaccuccaacucuccuuccaauccaaacugugaugaagccagaagucaggaagaaggcagccucccccacccuccuaccccagcauuccaggccauucuccaguccccuuccccagugaugacaucugacguuuuuucaucucaaagcucccaggaauuaagaaggaaaauucaaagucacauaguauggcgagcucccccucucugccccccaacacagcccuaccccaggcuacugacagaggcccugagagggggaagagccuacuucagcacccaggccuccagccggggcucuggggucgauuccacgcccaagcagggggcccucccucuccccacccacagccuucccgggccugccugcccucugcccggcaggguaccccuggccuggcuccccuuucgagcuacagaggccagugcaaaagccaccccccccacccccacccccuuuugcagccgaacauugcaaauccggauuccuucacaauucagauggggggugggggguugugaggauguaggggaggcggaggcccuccccgaacagagauaggaaaagaaggccucuccuccccaggaucagaaaaauggggagcccucuucucucuacccaggccucuggucuuuguuugugcuggggggccccggaagcaucauuugcccagggcccccaucccccaaaucggaccccauccccgcccccagucgggccgcugcugugucagcuggacugggauaacaaaaggcacccccucccgcgucucccuuccccauccguaugcaggagugggggcuggggagagggugcccccagggguccaagggggacgcggaaucucacucaccgucgauagccgccgcgaccagagcugagagcaggggcagcagcaggagcaacggcggggucagcauggugugggcugaugcaagcagcagccccuuccccucugguccugcuacuucucuccuucaccccccccaguuggggggucccccuuuuccuccuuucccccuccuccuucucuguucuuauucuuuccuucggcaaagcgcaccaggggcgugggugaagagguagaguuccgagccccuuggggagggccugcugacgggggugcgcccccugccccgaaauccaaacccuucaccccacccccccgcuucacuccucgcugcucuuucccccuccccgggcgaagcucacagccccaucucggagccgccuccggcugcaaaaaugcacaauugggaggaggcggggaggggggguggggggcguggaccggguaggggagccuuuggagggggcuugauggagcucugggggcuccccuuguuuccgccuccucagugcaugggccuggagcucgcaccgcuguuccccggacugaag

SEQ ID NO: 16444 - RNA, 84910 nt, Homo sapiens
cuucaguccggggaacagcggugcgagcuccaggcccaugcacugaggaggcggaaacaaggggagcccccagagcuccaucaagcccccuccaaaggcuccccuacccgguccacgccccccacccccccuccccgccuccucccaauugugcauuuuugcagccggaggcggcuccgagauggggcugugagcuucgcccggggagggggaaagagcagcgaggagugaagcggggggguggggugaaggguuuggauuucggggcagggggcgcacccccgucagcaggcccuccccaaggggcucggaacucuaccucuucacccacgccccuggugcgcuuugccgaaggaaagaauaagaacagagaaggaggagggggaaaggaggaaaagggggaccccccaacuggggggggugaaggagagaaguagcaggaccagaggggaaggggcugcugcuugcaucagcccacaccaugcugaccccgccguugcuccugcugcugccccugcucucagcucuggucgcggcggcuaucgacggugagugagauuccgcgucccccuuggaccccugggggcacccucuccccagcccccacuccugcauacggauggggaagggagacgcgggagggggugccuuuuguuaucccaguccagcugacacagcagcggcccgacugggggcggggaugggguccgauuugggggaugggggcccugggcaaaugaugcuuccggggccccccagcacaaacaaagaccagaggccuggguagagagaagagggcuccccauuuuucugauccuggggaggagaggccuucuuuuccuaucucuguucggggagggccuccgccuccccuacauccucacaaccccccaccccccaucugaauugugaaggaauccggauuugcaauguucggcugcaaaagggggugggggugggggggguggcuuuugcacuggccucuguagcucgaaaggggagccaggccagggguacccugccgggcagagggcaggcaggcccgggaaggcuguggguggggagagggagggcccccugcuugggcguggaaucgaccccagagccccggcuggaggccugggugcugaaguaggcucuucccccucucagggccucugucaguagccugggguagggcuguguuggggggcagagagggggagcucgccauacuaugugacuuugaauuuuccuucuuaauuccugggagcuuugagaugaaaaaacgucagaugucaucacuggggaaggggacuggagaauggccuggaaugcugggguaggagggugggggaggcugccuucuuccugacuucuggcuucaucacaguuuggauuggaaggagaguuggagguuggauggggauuauggcugugcccccacacuccuuuaguaaaucuguuuauucccugcaccccuccaagcccaaaaccccauacacacacacuuuguauauugcagaguuaggcuuaggcuagaacugcauccuuuuggggaaauggggugccucucuucccuuuuuuugucagcuguuuuuuucuccuacuugugagucacugguucaagucuugcccaagcuuuaagcauuaagcuggggucaugggguugggcugggcuaggucccugauuugagaaggggugggaucucauccccuccugucaucuuagcccucucauccaaagacaaaacugggcuggauaccaucauacacccccuccucugucuugccagauugggauugggaaaguuuuucucugaaaccagauuaucucccucccucucccuaacuugcuucaauugggggaggagacuuacagggucaggaagcagcuguguccccaaaaaacauauuuagugucccucaguugugccaucuuggggacucucuaccccccacccccaccccaccaauuagcugccccggaggaggagaggggcuuuuccugaauauccuccagaugccgcacagccggcuucugccuauaacuccugucauuaucauguguuuuucucuuguucucagcccugugaggugagaagggaaaucgaggcagggagauugggguugcagccgcuucugggaggaauagaaaaaaaauuugagagagagagagacccaucaggagccccuugaaggaggguggcuagaguuaggcagaagcaagaggguuucuguggagagcagggaaggucaggaagggaccccagauagcaucacucccagggcucuaaaggaguucuauuugccacaccaaguuaguggaagagagagacuggacauguucuccuuaacuaucucccuacccuuucuuaaaauguucacccacgcccccucuguaucuccagcucagaucaaacuauccaaagccccaggagaggaccccuccccaaacacacaccaauauuucugccuugggagugggaauauaaauaaucagcuccaccccacucuuggguacaggguggugagaaaggggaauugcauagaaauguaaguucaacucuauccagaggcagccuaggggaucccuuaucccuaaccccugcccucuugccucaggguccaucaacauugaacuuucuuguuuacuuuccagagaauggagaugacccagcucaccugacuuaguauguuaccuuccuccugcuaucacagccuugcugcuuucucuccagggcagcaauccuaggggcuuucccaccucuucugcuuucucuucuaugccugaaacugccucugggguccccugcccuuuggggaguaacgucacuccccacuagcgacaaaauugaguguaccugcugcuggagagguugcagaaagaugggguggagaaugggacuauugagggcccugcugagauuggggaacauuuucuaguggggagggcacccccagacaaauacagcucacagaauaaggcugacuuccucccucccuuuuuccugaccuuccuccacacacccccuugagccggcauauuaccaguuacuagaguagguacaguggaagugaguuaugaagcugggguguuagcuuccuggaucccugagagaaaguucuaaacuccuuucucccugaucagacucacauccuaaacgucucccuuugccucguugucuuuuaaagcaagaauguguaagaaauucauuuugggguuggagggauauuuugauguuuagggcugcuucacuagacaucuuuuucuucugaucuuguucucucuccucucuucauuuucucaaccacccuuccaccacugagccucccaaaggaugacagcccagguccuggccagagucaguuccuguccagaugcccccauucuucaaaaccccuuccuuaccuuuugggaagcccuuccuuacucaagucuaucucucuuuccuccugcugcagugugagcccuugcacaucagaacccccaagccuagguuuauucccgcccaguacucucuucucaggguccuccucacuccucagacucuuuaccuuucagguccuccagcucugcgugugggcucauugcucuuggggcaucugggugcagcugaaugguacugcaggaaggccccugacuugguagugcuggguaugagcgauagagaaccugccucccucuucugucccagauuucagccugguuagcaggauccugcauuguuuggagaaggaagcaguuggcuuuggaguguuuccggugcaauggccucaggcaccaauauaaacccucccugggaaagaggugagggguauauguggagaguugucccucuugcuccccuaggggagaugaaagccucucccucucccaccaggccuuagcuucccuggcugaagagcuccauuuuccucccuccuuucuacccuccugacuccaggggugguaguggucccuauucugggucucccuugagucaggcacugccuagggccgagacucugucucuccaagauaggacagaucuugcucccacccuacucuaggcucagcgggguagucauucucuggguucaucccaggacaacugugucauccccuuggcaaucucuggacugagcccccuuccuggcuuuucuggcugucugucugucuuucugucugucugucauuagugugcgcugucuuggcuuuuuagaaccucucugucucucacccucucaguucaucucuuacugccgaaccuuugugacauucucugcccugcuuucugcgucucugucacuugucuuauuuuucucugccugucuccauuuacccccauccaggccucuugguaucccaaaagcuucuugggagcaagagucucucugggcuuucccacucacccccuggcucccuccccucuguuuuggcuauuuuucccccuuccuggccagacccaguguccaguucagcaccaaaaguuuccucuccacuuuccuccgacuuccucuuucuucuucccccuccacuaauuuggggaauggguuuuggagagaauguuucuggaagaaaggaacuugauacccuuugugggcuaagagggagaaaggagguauuucagaaggaaggagggagguuagacuucuggcagaacuuccuccugaccaggagccuaagaacuggagaaagauguaaggagugagucaagaacuuggagcuuuuacucuggugagcauaagcuguguguguggcugggguggggggagaaggagaggaggcuuagaaaugccuggugagugauauggugaccucuggaggccuucugggggucuggcuuuuauuuguggggaaaggaaaagcuggugggggaggucacgggucaggcuaauguccugcugcaucaauauugacucagaauggaagcggagacccuuccccuccccuggcuguccaagccacccugucugucugucuguccaggccgcaaagcagaggcccagacucaggaaugacaaaaaugugucugagccucaggaaagagccacugggcaacacccaaaauacaaaaaauucagugaaaaccucucgguuuggguuugggaggcccuugcugccccacccccauaaggucgaaaauucagauuccugcaggcucuguccccgcgccgcccccccaccccaccccccgcaccuugagcauccuccucccacucuguucccuuagcuauaucaugugguucccuuuagagaaccccccucucaccuagcucagaggggagccuaucucuccuucugcuguguccacucuuaaaaagggccccaagagucccugucaugcuuuugcagucccugagucuccuuguccuuuaagaagcaccucuaaggucuuagcucucuuccuugcucucgcucccucaaggggguaucaaaggauggguuccccuccucuggagaagacuccuucaggguuggacuucgcugucacccucucuggccaggcauucucaccccacuuccccacccccaaggucccagaaugggacacagaaugacagccaagggucaagcagggcaguggggucuguguugugucuggacgcacacccaacucuacaccuccugcccuggcuccagcuugguggcccuggggaccguggcugggcugggugccuggguuuggggggguggggcaggguguuggccaaguuagcauggcagucacauucaucuucaggcaaagccgagaacagacggccccuguguccugguguucuuccuccaaacucgcucucucuccuuccucucuagaucucuccuucuucuucuccugccugucuuccccuucuucugucccauucuugcuccucucugucuccccuaugcccuucccuccucucugaggagcccugaaggccaccccuuaaaauccucuccccacugccagggccagagaacgacagcguucucccugcaauuucccuuccuuguuuuuuguuuuuguuuuguuuuguuuuugagacacagucucacuccaucacccagacugaaaugcaauggcgugaucucugcucacugcgaccuccgccuccugcuaauuuuuguauuuuuaguagagacaggguuucaccauguugcccaggcuggucucaaacucuugaccucaagugauccgcccaucuccgccuccaccucccaaagugcugguacuacagacgggagccacugcgcccaucugguuuccuuucuuucuuucuuuuuuuuuucuuuugagauggaaucucgcucuguugcccaggcuggagugcaguggcgcgaucucaguucacugcaagcuccgccuccccugguucacgccauucuccugccucagccuccugaguagcugggacuacaggcgccugccaccacgcccagcuaauuuuucauauuuuuaguagagacgggguuucaccgcguuagccaggauggucucgaucuccugacaucaugaucugccugcuucggccucccaaaguacugggauuacaggcaugagccaccaugcccggccugguuuccuuucuuaacccggcugcaucccaugaccuaugaggaaaccaccugcucaguuaccagucacccugugccucagcucccccaugugugagaggggggccgcaagggcacccaccucacaggguuauaguaucuaagugaguuaauagucaccguauuuccaaucaguggcuggugguuagcaaggugaaaaagguuagcucccaucggucagggagaccuccggguucucucaugcgggccaggaggcggggaaggccuuaguugcuuuugaccuuagggcaauguuguucucucaucuaaacugcaggccacaaagguggguuuucugggugcuggauucagacacagaaggcucugcugaggggagugggguuggcuuucccucuaagcagauuauaaggguccuaccccgcucccaacucagcucucucccagcucugagugaggcuucccuuggcuguguagacugucccaaaguaguuuauuuguuucuuucuucccucucccccugaaggaaaucaaagacaggccucagccuucucgcuccagauuccugggcccuucaacaccagcccugacaggaaguucuuucacguaucucucugcaauccuugugcuggccaggcccucgggagauguggcccccucccccggugcugcugugggauaggggccugggcccuccucuuccuuucacuugucccaucccccauccccucccugcaagagcacaucugguuugugaaucucucucauuccagcuuuuggaguuugccagcugcuguuuccucuguggaguucaggccaaaaaugggggugggggacagcgggggggacucagugagggcuaaaggagggggcaccauggcugggauguggaauggaggggagguuaggugaccacccggugaccucaggccguggcugugcgcucugccccugggaggagcagggcauggaccaagucccagguggguggcacgggggucuguuucugggcuccaaacaucucaucugccucugagucccauuccagccccccucuucccccucagccggccacggcuggucaggggaagcggacgguucuccggcaugcuaacuaggcuggcgggcuguguuucccgggaagaccucacagcuggcccaguggggcaaugaacucagcauuauccaccuccucaaggggccuuuauuccaggcucagggugggggccaggggagggaggcugaagggggagccuggcuaggccauccuugauguguuuccugaacucggucauuuuggccaggggccugagugccgucuccccugccagcgguggggguuaggagggaagacaucucagugaggcucccaucagacucccucccuccuaagagccccccccccccgccauuuuccuuauacuucugucucugcccugcauuugcauuaguuggguacagcugucuucucaggcgacucuggcuccugcagggcagagggucaucucacccuccuuggcacccugaugccuagugcagugccuggcauagagcuggccuucagugugugccagcagaauagaaaugugauggcacagucugaggaaaagccacgaaaggccaggagacugggagcucagccuugggugggggagaaggggugggugacuguuccuccuguggaggauguggugauagagguugggaggagugggaauucggaggacugguguggauuucacugguucagagcuuggagucagcuuagcugguuuugucacuugccagcuauuugacccuggccaagucaccuggcucaauuucuucaucugugaaauggugguauuaguugucccuauuugucauacuguggagggaauuaaauaugaugauacauggaaaaaacugcuuuaccacaguuccuggcacauacugagcccacaauaagaguuaguugucagccgggugcgguggcucacgccuguaaucccagcacuuugggaggcugagauggauguaucagaugagguugggaguucgagaccagccugaccaacauggagaaaccccgucucuacuaaaaauacaaaauuagccaugcgugguggcgcaugccuguaaucccagcuacucuggaggcugaggcagaagaaucacuugaacccgggaggcagggguugcagugagccaagaucgugccauugcacuccagccugggcaacaagagcaaaacucugucucaaaaaaaaaaaaaaaacaacagaguuaguugucaccauucuuaauuccuccuugggggaugagggaagagaaugggguaggaguggaagaagccugauuggggugggaggguagggccaagagguccugaauauaguagcuaacuaguuggacuggacugaaaccaguuccuagaguucauuucagccaucccccugccucugcuccccaauucugauaucuugaaaaucuuuaggugcuucuuaacucuaaggaugucuacugaaagucucccugaggucuaaccaagggaggcugugucuuuagagaauggagaggacaaggcagguggaucaccugaggucaggaguuugagaccagcauggccaacauggugaaaccccgucucuacuaaaaauacaaaaacuagcuggacauggugaugcaugucuguaguuccagccacuggggaggccgaggcaggagaaucgccugggcccaggagguggagguugcggugagcugagauugugccacugcacuccagccugggggacagagugagaccuugucucaaaaaaaaaaaaaauagggaauggaaauggaagcaaggcucucuacccugcccauuccugcccagccuugcccuccugugccucugcuaauaccaucuccaacuacuacugugugugccaagggcaucccuccccacugcucccaucugggggccuagugauuagggguugggaaggauggggugaugggucaggggaccaggagugucccagaaggcagggaagcagagagguuagauaagaccagcucggggccucuaguaguaggaguuagaggaagacaaagagaaaacaugucaaggccuaaaugcaccccccuucaccaucacucugucaucaaagccagggggugcuggugucugaugagaguaaccaagaauagcaaaggcuuugacccugacucccaggaacaggcagccuagaggacuuggaggggugcaguaaaaugugcuucuggauccuccccacccccaccgcagauacacagugucuaggaacuacccaaagccacccccugacacccccaggcacauagaccauggcugagggucugggccagauggagacugaugcuagggaaggaagagcaguacuaggggacuuuggguucacagaguuggccuccauccuucauuuauauccccuuuucuuuccuugcccuagccccuaagacuugcagccccaagcaguuugccugcagagaucaaauaaccuguaucucaaagggcuggcggugcgacggugagagggacugcccagacggaucugacgaggccccugagauuuguaaguaccuuuucuggauucuucuccccaaacccuuaacuuaucccucuuccuuuggcagauguuugggaggaggacagcugaucccuagccugauguggaccuugcucagugauuguauuuguccaugacacagcuaaaacuguccuuuacaccccuucaaaaugcuuggcauggugccuguugggcuuagaaauggcaccucagauuucucccucaagugcugcaccccaagacaguguucucugggcugacagcuuugcuagaagauggcccggccucccuuuccuuccagcucuucccuuauuccaccucucagccucccugacccuugaugauuggccccaggucuugucggauccucagaucuuccucuguccuuuggcucccaggccagaggccacuggcacuugcucagccccauaccagaagccccaccccugugcucuucccgcuacccccgccuuccccugcccccaguaagugguguaaucggaggcagcuguuuuaacugggagaaagguccccgcccagcuuuugcccugccaagggaaguggagaacuuguuggugggaccccagaguccuggguagcuggcacaguccugguggcuccacuuuuagccucuccccugcuugguuaaucugggccagggucaaagcgccccugcauuccuagguccgucucuguucucucucuugggcuuuauccugcuccagucccaucugguguccuguccccacacccccacccguaauuaucagggguaauuuuagggcuggaaagggagccacuagugggcucugccucaccccuacacucugcccuggagggugggggccagggguauucagcaaguauaucuacggcauggugcuucagccuggagucucuucuugucuggugccaccugcacccccacacuuuugacccugaugcuugggcguuagaaguaaagaaagccaugcagaagggucagaucugccucuuuuuguucauucuuccuucaauuugcuguaaaccucaccuuauaugcauuaccacucuguucacacucauaccccccggacucauaacaucacacacagacccaccuggcacugaugagcccaccucccacccaaaggcacaaacacauucucacaguaacacagagucacacucaaauguggaugcagaaacacacucuauacucagagagauguccccagacacacauaccaacauagagacacacacacacaaacccagauugauucacauggaaacucacugaggccagauacaccagcauacagaaagacacacagauacacucucacuaccuaccgcugcaugcuauacagccacaccaucaguuguguaagcagacucccauccaggcacacaugggucauagacacugucacucacacaccguguccaggcuugggggccaauagacaguggucucucuaucucauccauccucuugagcaacaaaggaaguugcagagaugauaugaccaguuggccacaaccuuuuuuuuuuucuuuuuuugaaaggugggaucucacuauguugccuuggcugaucucaaacuccugaccucaagugauccuccugacacagcuucccagaguucugggacuauaggcgugagccaccaugccuggccagaccacaaccuuugauucuucccaaauccuucuaucaggcuuguugcugugggguuggaagucuagaauagugcuguccaauagaaauguauugcaagccacaugugcuauuuugaaauuuucgaguagccacuuaaaaaagguaaaaaugaacagaugaaaugaauuugaauauuuuauccaauggauccaaaauauuaucacuuuaguacaguguauucauauaaaaccuuuagagaucuuuugcauuuuucugacauuaagucaucaaaauccaguguacauuuuauacuuacaguuugaacuugccgccuuucaagugcuugauagccacaugugacugggcuacguauugggcagugaaggucuagaagauuuggcaccacucuuggcccuggguucugcaaccugggagcuaugggaaggaguuuuucuuuaucauuggaguuucucugccauggacccugcuucccucagcucaucaaaaccuuuuuuuuuguuuguuuguuuugagacagaucucgcucugucgcccacgcuggagugcaguggugcaaucucagcucacugcaacuucugccuccuggguucaagcgauucuccugccucagccucccgaguagcugggacuacaggugcaugccaccaugccuggcuaauuuuuugcauuuuuaguagagacgggguuucaccauguuggccaggcucaucuugaacuccugaccucaagugaucugcccgccucagccucccaaagugcuaggauuauaggugugagccaucacucccggcaucaucaaaaccuuuuacugaccucagucgucaucaaaaaccaggcugucuucagccugucuccugagcauagaauguugaggcacugggguccaugggaauggggcauuuggaggguggacucuacugaaggccuaguuucuaccuccaccuguuugccuacagguguguggcuacuguggggaauauuguaaaagaguuccagguggaagagucuaacuagccccgaggccuccugagaucugaaaccccaguuuuaucuccccucauccccagugaacagcugaccagagagccaccauagccagcuuguucaugcccacccuucugucugcccucagguccacagaguaaggcccagcgaugccagccaaacgagcauaacugccuggguacugagcuguguguucccaugucccgccucugcaaugggguccaggacugcauggacggcucagaugaggggccccacugccgagguaaggacuuuuccacucucuacucucccgucuggaugcagcauauuaucagcccaccuuccgaggacuguccuggcaccuucaguggggaugaggccuuguccugguccccugccuagauuuaccuucagagagcagaugaaauugaugugccccuugggccuggagcuuggucagacagcccugugggccucagccgugggcuguagccugggcacuucccucuggcuauguguucuuggacuagucacuaccucucuccagguggcaguuuuucuucuguaagaugagagaucaguguuuucauacuuuuuuaaaaauaguaugauccuuucuucaaaagguuuucugcaugaaaccugagugugaacacagggaggagcagaggugcugugacuaaagcuuagccaucuaguuuaguccaccugccgccccuacgggugcccuagaaggcaucccccaggagcugcagaucuuugaggggcccuaaaucugccuuggucccucccucucugacagucuagacugucugaggugguugauaggaaagccauccaggccgaggugggaacauuaggaugacaagucagacugcuuccagccuguggcucaggucaccagcucuacagucuuucccccaaagggcccugugggccauggagaguccggucacagcgugagcauuuaagagucguguccggggaggcagagccucaagccugcguguuagggaauaguggcuucucccuucucuuuucuucggggucugggcccggagcaagaggccagcuuugagaggccaugagcguagcccuaggggaggggcugugcuugggugugggggcaguguccugugcugugugccugagaaaacaucugucugugggaggagacucaucuggauccuguucacuaggagcagggaggauggagcaaaggaguuuguggaagauuuuucucccuuucuuugguugauuuugcauguuuucaucugaagcuccugggacgggaugcagaaugcgggccugggggcugacuuaaaugaccacgcgcaccccuuccucucgugugguguguguucaagcuuacuuccuuuugaguaccuuuacagucucuaaaacaacagagaacuucaaaaaccucaggucugaauuuccuucucugauauuacagaaaucggccuccucauucccucacccuauauccagaaaaguuacucuuuucuagguuuuccagagcaaaugauauuuucccccucuguggagaaaggcugggcaggcagcaugaauggcucucggguggaaguggggaggagaaagaaucgcuggggccuggccccccaucccaacucuuccuggcaggcuuagugccucuaaacgucuuagcaucuugggcggcucucucuccuagguggggguggagugggaagccagggugugaggccgcuggacaaaggggucuuuguggccaggcugccuggccccacgcaaggccauuaacugggucgcuggucugggggggcaacugcucucccaccucuccccccuccugucucauucccuucugucuccccuguggaagugggucaguggcaggagaaagauuagaaaagaauccagaggggaccaguuuugcuccuccuuccuguccucuaccugggccuuaggccuucucucugaggccucuagggcuccggggauggguuagacaggugcuuccaggccagagcugggauccuguggggacagacacgauuccaugcccacuuuucagccccagcugaagccaacauuguaauccccaggcaguguagaugagaggcauaucaaagggauaagacucaccauccccucuuccuguugaccccaacaaagugccagaaccccucuccauggggacagagguagcccagaacauccagaacagagacauguggguucuaagccaucacuggcugugugaccuugggcuugucuuauagccucucugggcuucaguuucuucacuugugaaauaugguagaugcuuccuaaggcccuucugucucugacacugcagcccuuagaagugguuucugaagguugacuggguuuaggggaagguuguggccugcguggagcugccagaucuggcggccugaauaugugucucuccugcccccacacagagcuccaaggcaacugcucucgccugggcugccagcaccauuguguccccacacucgaugggcccaccugcuacugcaacagcagcuuucagcuucaggcagauggcaagaccugcaaagguaugugagugcaugugccugugugcaugugugugugccaguagccaguugaggugggcagggaggggcagagagggguagggggccuggcuggaauaagaaacuagaaggaaggugcaagagagggggugccaccaccccagggcaugacugugagcccuaaccauuugcuuccacuagacuucuaaaaauucaccuuaaaauuauaguuuauauguaaauuuuucuguuguaaaaaauuagagcauuaacagauaaaaccaaaguccccuuugacaaaucccccucaauuccgguccccuucccaucucccuggaguucaacucuauuaucaguuugcucucucucuuucaggcccuuuuuugugcauuugucucuggguauucacagaaaaucuaauuggaaguacugcucaagaguacugcgugcucuuuuuuacauaaacaauaguauacuguguauauuauuuucaauguuuuucacucaucaguauguuccacaauuuuuuuuucuguguuaauauguaaagaucuacaucauucuuuuagaaaccacuaugacguaugacuuuuaccacaguuuacuuggucaccucccuguugaugagugagauguucccaauuuuucacugcuacaagcaaugcaaacuuuucuguuuuaaauuugccucccucgggucuuugugcaaaugccaccuucucagugaagccgucccccgaccccucuaaaacugcaucccugccaucugcauucucuaucccuguucucuuuucauugcacuagcaccucuaauguauacuuuauuuacuuuguuucauauguuauuauaguaacuauauuucauuuauuaucugaauauaaguuucaugaggacagcaaugugggucuauuuuaaaguucacugaugcaccccuggcaccugacccauaguagggacucaauaaaucuucccugcguggaugagugauauguacacgaguguuucucuagaguggauuccaagacuggacuugcuggguguuaagguuugcacauuucaugcuguaauagauucugccgaacuguccuucaagguagcuguaaggauggacauguugaucaugucugaugaucacccacuucguugcccuugucacacuggaaaugaccacauucuugcccuuuccucggcagauuuugaugagugcucaguguacggcaccugcagccagcuaugcaccaacacagacggcuccuucauauguggcuguguugaaggauaccuccugcagccggauaaccgcuccugcaaggccaagaacggugggugggguugccucuggccacagugcuaacuaagcccccucaaugcuguucccuggugggugguggccugagaggugguccuagagcccuggcugcacggacucuucucuuccccauucccagagccaguagaccggcccccugugcuguugauagccaacucccagaacaucuuggccacguaccugaguggggcccaggugucuaccaucacaccuacgagcacgcggcagaccacagccauggacuucagcuaugccaacgagaccguaugcugggugcauguuggggacagugcugcucagacgcagcucaagugugcccgcaugccuggccuaaagggcuucguggaugagcacaccaucaacaucucccucagucugcaccgugagucaccugcucucagcuuggagggcuggggaggguaggggagacagggaagguggacccuaucuugaacagaggccgggaguuacacaggaugguccugucuggggcaggagaagcaggaggcuggauacaaugguguguguuugaggcaggggcagagccaccggcacgcucccucccagcucucugagcaagugucuggauggccccugcauuucuggccaagggcugagggggcagugaauggucaaucuccagagaccagggacugucccuucucugagaggggaguguugacuagacugcagagggacuuuccggugcagugggagccaaggcuagggaaagaaggagcggaagccugaggugcccuguuaggcugcagcugaggguaaaggagcuggggcccagcugcucugucuccaugggccaucguuucccucggggaccauugccaauggacucucugcugccaucgggggagggcaguacugagguuauuucucuguggcuuuguggcagugaaugaggcugggagaggagcgugagccacaugagauuuuagaauauccuggaugcuuccauucaggcuucucccuaggcuacacuuuugcuauccuaguuguggaagaaggggugucacagaaaggggcacgagcauagcuggguguagacccacugccgggaacagcccugcccaucucagaggcuguuacaccagcaaccuuaaaagucaacaucuggcagcaucacauuuccaaagaaaugcaccacagggcugagaggaagaaucuggccugugguugaucugacccccuaagggagauuaacuugaucuguaacuguuuaguaaaccagaauucccaucucugccuugguuuccuaaucugcauaauggguuugagcuugucugucuagaucagauuaacuggagugaaagccagugguaaaggacagcacacuuugaaguugaggauugugaaccuugggccucucuagaagaucuucaaguuucuuuauuugguucuugugaugaaaagaaagaucccaggagguuacaagggauucauucugggagagagaaaggccccuccccgggaugguggcgagcagggguuccucugagagcccucacucuccguggccucagcguaagguucacauuucugccuuuggcuccuccagagcaucccugauagcguccuugggcugcugcuguccacagcucaccugugaucagacauguguccuccuuggggugcugagcugggggcugucaagccugguuggcugagcucuuaacgagugggcgacucagggaaccccauggcugauggggugggauuggugcuagacccucuugugcagcugcccucccccuguuccuuguccacugaccuacucaacaggccugucugggcagacagcuugucaguuuccuccccagcccugcaucuugccauacagugggcuucuggguagguggcuaugggguguccuggagguaaccuucucaacuucuacucuggccucaucuccuuaucugacuuccuccccaggagaagcugguaccccucccuuggcaaacagauuugccuugccucccagucugcuaaacucacugggccucucaggggcagaguccaggaggcuagaagaguccaaggggaaaugcuugugggguaaaugaguggguuucucucaucccagcuucugucccuuccucccugcccucccccugcuccacgucccugccgccugaaugucuggcugucacccugaggaugguuguuuugcucucucccacaaacuaauuaugggucccaaacugaggacgucagugucucuccccuagccccucccccaguuucugggucaucccccuccccaggagaugcugacuggccugcccugguguguaggguggcuggucccaggcacucaccugcacaguggcugcuggccuguaauuagcuccccaaggaggacgaagaagaaaggcugcagcuuuccccugcuuucacucugcccuccagggcagcccucccugcaagccuuccauucugugcugugacugugaccucuguuggaccccuggggcugagccucaugcagcaggggugcacacagagggaggagucugacaauugagggguguucgagccagcgaggccagcccgcuggugcaggcagaagggggagccugccccagagaaaacucuggaagcagaaauagaauagaaagaaggaaggaggccaggaaaugagccugguucacauguguccugggccaugugagucagaccuguuguggaguccugagagcccccgagggccccccugaggcccugcagugugugaacauuccucuucaaugccccagggcugcugacccuccugccucaggcccaguguuaucccccuggauugggugggucaucucuuuuccucccaccugagauuaccucccccuccccucugccgcuggcccagugguuuggggaggucuaugaggcucgaauuccaagaccagagaacuccauggugagagccggaagagaaggcaagacccuuggccaguaccaagagcagcccuggcuuucacuacugcuuucucaaaggggcuaugcauugauuugauuuuagaugguaccuggacaagcuuuuuuuuuuuuuuuuuaacuguuauaguuacguuuuuauuugauaugcauuaggaaacuccuguaacuagcacaucaaaucuguuacuucagcaauuguuuagcaugcagcgaaauaagaaaaguaaguuaauugaaauaacugguaauaaacaguagcgcaagcuguacauaagcaugguagacauuuugaaagugauacacaaaagacuaaaguucugaaaauugaggcccagagggaucaacaggccugauagucccuuagucaggaaccaggccugcgcacucucacccccaccucugaccagucucucagcuccagaggccuauggagccuguaacccagcuuuguccagccuccugccaggcugccccugggcaggccugguggugcagucuaccgaccccagcccagcccugcauuuccuaagcugagcuccucugaucuguauucccuucaccuuggaggaugccaccacuguagaaagaaugaggcagacugcaagauugggguccugggaacauggguguguauggugaggggagguucugagguuguaaauagaggccuugaaggaaaucggguuugcugaagucacucaggaguuuggacugugugugaaaggauggucugaaggggcucucagaggucucaggguuccccucccugcaccaugcugcauggggaagaaggagguggcuggggagcucagcaaagggccccuaggcugcaggcagcaagguugcgaaaugggucccagguccagcuggccaacuucacuuuucccuuccucucccuuucuuuuauuuauuuauuuuuuuaguguguguguuuucgaaaucacaacaggaaaugggguagugauuugucuagaggggaggcaaagaaggggcagacagcagucccucugagucuaaugaacuggcugcugcugcuggaaggggugcuaccuccccacugugcugggcaccccuggacccucucagccucccacccugccuacaaagcacuuccagacuucacaugugaaagcuaaccaugcccauccuuggccuuucugacccaugggaugccaggcuguuuggggagggguggcucuagccaccccacucuuuggccuuaggcccccugcauccuggcacuuuugcuucccauuccuguucugaguuuccuaaucauuuaacagcucacucuugcuccuccucucuccuggcccgggccagcccugugucucccggcccagauccagcccuguccucuccucccccgcugucuccuugaaauugccucuccacccagacugcucccagcacuccccuugcuguuuucaagccaaaggaaguaacuuaagcaagagagauguguuuuagagcccggcaaggauuucucaauagagggaagacccuaagaugggcugaguggaauccaggcaucaucccugggaucuaggucgaaaugccucuuggggaccuaagccaggcaggggaagguagcaggacauaaccacaggcuggaaucacaggcaggagcaggaagagagcccaggagaacgaggugacacaacacggcuaagcuccagacuggcugguggaaggaagagcugaagucgggacccagcaggaaacaaggagcaugaggccacaucguuuagcagagcuucugccaggcucgccaggaggucuccuucccaccuucgaaguccucagacucuccgccaucucucccaggcccaggcgagaucccugaguaggauuacuagacagacuguccucucccacugucuuggagugucccaaggccagagaggcaggauccuggcaguagaagagagggggaaaaugaugucccagcucuagaacaacagacucagucuucaauaaauauuuguucaauggaucaauacaugugugucagacgccugagacaaagacaaaaggcagcgcucuccuuacaguauuugcagucaggugaagaggccaugaucaaagaagcuccagaggccuauggagccuguaacaggaaaacuuccuucuuuuuuuuuuuuuuuuuuuugagauggagucucacucugucgcccaggcuggagugcagugaugcaaucuuggcucacugcaagcucugccucccggguucacgccauucuucugccucaggcucccgaguagcuaggacuacaggugcccgccaccacgccuggcuaauuuuuuguguuuuuaguagagacagaguuuuaccauguuagccaggauggucucgaucuccuggccucaugauccaccugcuucagccucccagagugcugggauuacaggcgugagccacugagccuggccuugaaaacuuccuucuaauagggcaagcuuccuucugggagccugagccgagucuugacgaguaguagguguuagccccaaauggcccaccuggagggcccaccuagagucaggaggccacagggcucuggcuggaggcacagagggcgacuugguggaaaaggugggaaaggauggguucagggaggggaggacauggugggaaccgcagcccccauguggggaguguuuaucaugcaccaggccucaugcuaagugcaguuaguguaccauccaguuuuacaaaugaggaaacagagacucagaggcauuaaguaacuugcucauagccucaguuggaaggugacagaaccagaauucaaacucaggcugucagugucuagggcccaguuggacccagggcagagcagaaugauaugaggagagguggggagguuccuggaacaagggccagaaucuagugugcucccuggggauguggauagagguccagggaccucuuuggauguguauacacucuuggguguguagauguguugggugacauuuucucaggacauaaaggcuucuuccuuccuuccgauuuccuuauuuuagagcaggugacuagaauccugcagcugaagcuagagucuuuuugggcauggggugggucccauguguuugggaaagcagccaccauguauggaaaugccucuugaacaaugggaaugauggagaaguugagaaaagcuggaguuguagugagugcagaugcugagcagugggauggggugccaggacaccaggucuauucuggggccuggaacugaaaguccucugugccauaaugggcagcuguggucucucgucugacuccugcaccucuucccugcuuccuagccucccucuucaugcuggaauccccugccccucugccccuagaccacccccaacuccuuccacaacacagccucccucucuccccuuugguuuauuugagauucuccuguccucaggauuuucggccuuuggccagagccucuucagaaggugcgcucaggugguuggcccuuagaaggcugggcgacaaggggacggcuccccucaggguugguggagccagaaugcucaggaucucugggcugaagcccaggacuccaccuggaccccaauucauaagacagagagggguggcccagauacugccuauagggcagcccuggaggcaagguuccuccucucccuuugagcccaucucucuacacuggccuuggagugguggccaaguguaugugugugugugugauugugcgugcauuugugugugcauacgugcguaugugcgugugugugugguggggcaggcagaggaaucugaacuuuaggagagagaaaaauaauguggugcaggggguuggauaacaaaggauuuuugcuugcaacuaauagucuccagcugcaaaaauaccaaaggggaggccaggcaggccgaggacuccaguucuugccaacuccucaccggccugcugaguggggcccugccuggccuuuggggagguggaagggagaccggccaaggguaaauaucugagagcagggaugaucucucugccuuccuucccggaauugggagggaauccaggccacauccugaggcugggggggcugauuguggagcugcaccugggauagcggcaucagaucucugcagguuucuuccuucucucucuugccaagagaaggguggauagggggagcaggggcaggguauugccagcccuagggcugggcagugacucagggaagccucaggaagucggagagaaggccggccguagcugcgccagcuggugcugggaaaacagcuuucacugaugaaguucauacacaugccagcagcccccagaccccugccgugcccaccaaguaaagggcacgcagcccuguuugacuuccagccacccugcuggcugccaggggaugcaggcaggucccugcuuugagacuucgauuuccuuuggaggcagcccagcagcauucauuugaaucuguuuucucugugguuacagcguguggggcaaagaauuugguugccuuaccccugcacuaggcccucuuccuacagggccuuggccuccucaagcuacucuucccccucucuccaaucuugugaggaugggacaguacugggggcccagaggaaagaguggcugggcuuggggaugcaugaauacuuacggggguaauaccucgucucuguggccuuguucuccaggcauugggaugggauuuagcagagaggaccugaagaagaaacuaguuugaugaagcccucaguuggcuccuucccuuccuguccugugacucugagucagugucagggcccagccaaguuccuugagagcggcguuccuguucuuuuugcccccaccccacccucacccacuguuagggagcagccccugaaucccuguggggaggagggggaauuagggaggggucaagcagaacagcaagucauuauaccuguagcugugugggggcagaagaaucccuacuggguugaguauggguaauggaggaugaguuucagcccaaagcagguagcccaaagauuucuuuacuuguuggggaaacuguuggagauggaguuccaggcaggggucccagaaagucacugccuuaggaguuucccaguuugcaagaggcaccaucucugauggugguaguugaaggggguagugaguagauggaaggaagccagugguccuggagaggaggagcccagaggaggccagcaugugucccuguccccagacuuccugccuccuugacuuccggccacccuugcccugccucucuuuccuuuggcucuucuuggcuucuuccaucuccuccagaaccaugccugaaacugagucuaggcagcugggcuccaucuccuucccccacucccaucauccuuaagccccaucucuuucugagccaugccucaguuugcccugaggauucuuucauggcccuccuccuagacucucucuccuccagcccuaugacuuauuccccaccucuucugacccuccccaggacaugaggacauugagcaauaaggacauugcaggaacaggggacuggggcugaguagaggaaguuuggcccaugucacuggugcccaaccuuuugcccccauggaucuucccuuuggcaucucuguagaguucauauuuugaaauacuuuucucccaaacuggguuuauuagcguguacccugcuuuuccacuuuaaaaauuuaugccauauguccagcuuccagucagugcuucugguuagcaugagauaacuagauuuacuguagaugguagauaaaaguccagugaaaagcaaagauguguaauguuuugguagccucagugcucuuaucccaaguaaaagcaaaguuaaaaaaaaaaaaaaacuggacugagcuaguggaccugugcucucuaccuuuuggugccccaagaagauggucccuuuucaaggaugggcuagaauugggaagucugucagucaaccagccagccagcauuuacgcaagcccuccuguauauccacucugagcuaagcauggggguguugggugggagggcguccagagaaggugggcuuccagguguggguucucaccagcaaagggugggcaucucugcaagagggccuaccccaccccauggcucuuucauucguacucuccagacguggaacagauggccaucgacuggcugacaggcaacuucuacuuuguggaugacaucgaugauaggaucuuugucugcaacagaaauggggacacaugugucacauugcuagaccuggaacucuacaaccccaagggcauugcccuggacccugccauggggugagaguggcaggcgggguucuggcccuggaaggugggaggcugaggcuacagugguaaggagggugcccaauguccagaccccauuuaacaugcaucuucccacaggaagguguuuuucacugacuaugggcagaucccaaagguggaacgcugugacauggaugggcagaaccgcaccaagcucgucgacagcaagauuguguuuccucauggcaucacgcuggaccuggucagccgccuugucuacugggcagaugccuaucuggacuauauugaagugguggacuaugagggcaagggccgccagaccaucauccagggcauccuggugagggagcuacugucugagguuuugugggggaaccaugauccagggccuucuggugaggggggaagccucuguaggggaaccguucucugagucuccugguaaagagcguggaugccccaggccucuagugggaguggggugggcuugaauacugcagagaaaggacaagauacggguuccacugugaugggaacagucauuuuagaaacaccacuucuguuuacuuccuguuucucauuugacccuuauaauaaccccuagcugaugaacagggaggugguucaguucccuuucagcagaugaaaaagcaggaucaaagagguuaggugauuugccuguguuuacaaagccgggugauagcacuggaacuuguucuagaagccuugcuggcucagagguggcaucuccauugugggauaauuagugugagcaaccagcccaguuugccuaggacugucccaguuuuagcccugaaagucugguaagccagcaaacccuuaccuuugucuuaggcaaacuaggacaguuggccaccgcagauaagcuauguggguagucagggguguuacaggacuugcuuggggcaaguguguccucuuagcccucauaacagacuaagaauguccucuguggacagaguuuagagcccaucucuaauucagucuaaaaucacuaaagugucuaacgagugccuaauucugugaaggacaggguuucugcccucaaggggucugaguagagugggugagauaaguccacaaaucacugugccagacacggauagauagcagugucacggaggauguauagaaggagaaaacaucucugguuagaagauuccauaaauucuuuaaagacaugcucuguagaggaugagugggaucuugguaagcaaaaaucuucagaauagguuaguccagccagaggagacaggaguaaagcauugaguuaaaaaaugguggggccaggcacgguagcccacaccuguaaucccagcacuuugggaggcugaggcaggagaagugcuugagccucggaggucgagaccagccugagcaacauagggaaaccccaucucuacacaaaauuuguuuuaauuagccagguguggugguauguuccuguagucccaacuacucaggaggcugaagcaggagggccgcuuaagcccaggagguggagacugcagugagccgugaucgugccauugcacuucagccugggugacagagugaggucccgucucaaaauaaauaaauaaaaauuaaaaacuacaggaugaauuggggaaugcaggucaugaagucuggaggaagcugaggggaucuccaggacagagggaggaaccccugucaucucaugcuguccauucuugccugcccgucucagauugagcaccuguacggccugacuguguuugagaauuaucucuaugccaccaacucggacaaugccaaugcccagcagaagacgagugugauccgugugaaccgcuuuaacagcaccgaguaccagguugucacccggguggacaaggguggugcccuccacaucuaccaccagaggcgucagccccgaggugagcagggcuccauggccccuccaaagcuggcuuuaccccaugauggcucugggaccuugggaucacagccccucucugggcccuccuguggggacccuggcuucuuucaugucaugaccgauucuccuagccagccacucgggcuaccugcccuggccccucagcuuccccugccagcccccauccacccacucagccuccagaucccacucugucccucccauuccccuugccagucuggagcaguagcaccuggccaugggcaacccuggaacucucuucccugacuacugaagcccccacuccaagaguuugaaggcuggguuguuggggggcagaggguuuccaccccuguggcuuccaaauccuaaaaugggauagcaagcacaaagaccacagcagcaggggguguggucagauucaggaagccuucucaaggccuggcacaggggcucugagggguccuaacagcucuucacccugcccccagugaggagccaugccugugaaaacgaccaguaugggaagccggguggcugcucugacaucugccugcuggccaacagccacaaggcgcggaccugccgcugccguuccggcuucagccugggcagugacgggaagucaugcaagagugagugacagggaagggggugugugcccauugggaggcugcgggaggguuccucaggugucccccacagcccggcugccucugucugacaugcagggagaugaaggaagugucccagaguguaccugcuagugagggcagagaugggacuugaauccauauucgaaaaaagugcuuuucucacucacccaccggacucugcagaaaacuaaacugauucauucagcaagugucuagugagcagugagcacucacuacauguuuggcacuguucuggucaucaggauuaagcagcgaacgagauagauguugucccuggccucauggagcuuauagucuaguuggggaaacaaauaaauguaacuuuaggugguaauaagugguuaugaagaaaauaaaacagagaauagucaggcgugguggcuuaugccuguaaucucagcacuuugggaggccgaggcaggcagaucacuugaggugaggcguuccacaccaggcuggccaacauggugaaaccccgucucuacugaaaauacaaaaauuagcugggugugauggugcgugccuauaaucccagcuauuggggaggcugagacaggagaaucacuugaaccugggagguggagguugcagugagcugagauggcgcuaccacacuccagccuggaugacagagcgagacuucaucucaaaaaauuaaaaauaaaugaauaaauaaagcagagaauagaguuaaugaggagagcaagggccucucugaggaugugguguuugagccaagcucucugugaaaugaagagggcaaccauguaacucccugagggaggagcauguccggcagaggaaaucaacagugcaaaggcccugaggccagugugaguguggcaagccagaggaacagcacgaaggccagcggggcugaguggugugagggcagagaaggaggcagggguuggauuuuauuauaucugggauaggaagcucauagugacuuuugagaauggaagugacaugauuggauucacauuuguauaaaagucacgcugcuacugggugggggaugggcaguagggaaguagccagaagacuuucaguguagugggcaagaagugaugugguuuacacuaggauggcagcagaggaagugguaaacagugaugugacuccaacauauuuugaagguacuccuuuuauaccacugauuucaugacugaucagugggcacuuagcugaaaaccugcuauucuucccucauuuccuacccuuggagugcagaggucagaccccaggguauugcggccaggacccaucguccuguauguuagcgugugcguggucuguccaucugacccagagccucgcaucccuaacgucuccugacccaucacagcuagggcauugcagccccuuggccgcagccccuggguggggaugauggucaugugugugucugacuguacccuggcuugugccugcucuagagccggagcaugagcuguuccucguguauggcaagggccggccaggcaucauccggggcauggauaugggggccaaggucccggaugagcacaugauccccauugaaaaccucaugaacccccgagcccuggacuuccacgcugagaccggcuucaucuacuuugccgacaccaccagcuaccucauuggccgccagaagauugauggcacugagcgggagaccauccugaaggacgguaugggcuccuagggauguggcccauggggauggaagggggcuggggcccaggcaucuguuucucggugcccucucagcaggaugguccccugcugacuggcuggcugcacugguuggcauggagaugaggggauagacagauugaccccugugugacccccuucuuggcugagccaaagaggcaggguuaggauggguuaggcagcaugggccguccuugccagcccuugggaaaacucagggucugucugcauuggcuuagagcccuggagcugcacacagcacacagccaggggacaacugaggucuugaauuggagacaggccugccagaucaaaacagggcacacccacauguaugugcgcacacagggucugugcagcugaccuugcagucgccaaaaacugcaugcuaauguguccugagaaaauuguguuuugugaguugcauccaggucuucccucugagcugcuugggcagguucacagugcauugucuuuuuaaugucuaugugaaggauucugagcuguacgaguucugccccaaaucugcacuugggccucaggaucaggccgccuccccaucaaucugguggaugccaguuauaaccuuugcccugcaccccauccacacuguaguucagagaaaaucaacagucagcaaucauaucacaagacuuuggggaaaucaaaaguaacucaucaggaaaagauuaggggucccuauaccaagggaacugcuauuuaaaggacacuuggagugaaggcuuuggcuaagugaaaaaucacuuccuaauuuauucauuuuguuaguucaggauuuuuaggccuaggauaugaugucacacuugugcccagagccacaugcccguuguuucagcucuccaugcaggcacgggccagaugcccucacacgagagcccacaucagccauguaguuuaccaucugccacgugugguuuugagaggcuagcccugauacaaauggcagcacacagggcuuuccccuauuccuuuuccagccuccugucccuacccccacccaucugucuagggccccagagggucccugcaccccucuguagcccagacugcucaaagguaccugaguccgggagggccagaggcaggcagcuuugaacuuccuuugaagcuguucaucacuggucccucuucccccaacaggcauccacaauguggaggguguggccguggacuggaugggagacaaucuguacuggacggacgaugggcccaaaaagacaaucagcguggccaggcuggagaaagcugcucagacccgcaagacuuuaaucgagggcaaaaugacacaccccagggcuauugugguggauccacucaaugggugaguccucccaggccuuggggugggaggagcugggagugugugggccucagauaacuggaggaugaaauggacagggaagcaggggaaggcaggugaggcgggauacuuuagcaggaaugagagucugcaaggggagaaggagucccugucuucagggaaaugggagugauuccuuaaacauagaagaaaucugauccugucacucccaguucagggccuuccaccagcuccccuuacccugagaaugaggcccacguucuugucaggccugcacagccccacagugucugccuggcccuugucugaccucaucugcaucccgcuucccacacuugaaguucuguccccacugccugcugucuguuucucaaacaagcaccccggcuccuccugccucagggcuuuugcucuuggaguuccucagccuggaacucccagauauuugccggacuggcuucuucucuacaucaagucucacucaugccaccuccucaugguggccuucuccaucacuccccugacacccccaccugcagcccggucacucuccaccccaucacccugcuuuauuucccuccuggccuuuaucgcucuccauguaaccuugauugaccuguuucuugugggaugggagcuccgugggagcagggaccuuggcugccuuggucuccacugcauccaugaaugccaaaacugugcccaacuuacaggcacucaacaaauauuuguugaauggagugaaugaaugaaaugugugguccagugaugagcaggacaggagaccccugugaggagcucugggacagcacucauggauugggaucacaggggaggcuguugauggcgggggugcccaggugaugcugaccagucgcugcccacagguggauguacuggacagacugggaggaggaccccaaggacagucggcgugggcggcuggagagggcguggauggauggcucacaccgagacaucuuugucaccuccaagacagugcuuuggcccaaugggcuaagccuggacaucccggcugggcgccucuacuggguggaugccuucuacgaccgcaucgagacgauacugcucaauggcacagaccggaaggugggcaggcaugugccugugugggggaaucuguguguguugcuagaccaugcuugggcguggaugagguucugugugaguauguggguaucuguguguguccaggccugugugccucuauagaugugugcaucuauuuuucugugcaucuauagauguguacaucugugagcuugcaugucuuauguauuguguuguuuguuugaggauugccuccauuugcgucucuuugugucuauucguguugucugugaaguugacuguccaugugccagucucugcauacacaccaugugcgccuccucaugugugugcauagauacacggcaugccuuggugugugucugcacucucugcaagugugagggccuagggacggcauaucucuacacuuggucauuuggguugucaugugcuucacgagucauguacguguucuaguauauaaggcccuucaugauauggccccugacccccucucuggucucuuuucuccccacuuccuucaucccaacacucuuugaacaagcagcacuagacagcuugcuccucccagcacacgucacagagcaucugcccucugugccauuacucaugcaguucauuccacauggaauguucaccccagcuccucuuccccuggcagacugcucaggggcuaccuccccuaggaugucaucuccagaccccucuucacacuggaucacccguaugugcccuaucugagacagugggaagcucaagggcagagaucgugucguuuucaccucuuacuaccuacuacagcucagccccuaacagauccugguaaauguugaagaaaugaauggaugaauacugcccgucugcucauuagugugugugugugcgcgcacgcauaugagugugugugugugugugugcacguaugugugcguguguguguuuggggacuaugaaugaauaggaaugagcccaggagaggaccauauggacaaccucaccaucagcauccuugcuggaucacucgaucacccgcuggcuucaggaucuaccaucccacugugugcaaaacuaucacucucuggggcucccaggcuaaugggggaaacaaagcaaaacccaugcccaggacauagacaaaugaauguacaaaacagugaucucacaggccucccucaauuuucuuccaacuccuuaguaacauccucuccaucccuagauuguguaugaagguccugagcugaaccacgccuuuggccugugucaccauggcaacuaccucuucuggacugaguaucggaguggcagugucuaccgcuuggaacgggguguaggaggcgcaccccccacugugacccuucugcgcagugagcggccccccaucuuugagauccgaauguaugaugcccagcagcagcaagguaccuccuuggggcugggggcagcgugggaccuggaagggguggugggacuuaggcauugauuugagacuucccugggagugaaggcacuucccagggauccuaggcucugacuuuugaggauccugagaagagaacucccccaacacaaucugauucucuguuccccauuucccuuccugccccaugucugugucuccuguucuucaacaugaucuucuuccucuccauauuuccucuuucuguccccacaucuuaaugugucuccuccccuaucccuucucugaccucuccucaccucuuccucccuuugccuuuccccauggcccuuccccacaguuggcaccaacaaaugccgggugaacaauggcggcugcagcagccugugcuuggccaccccugggagccgccagugcgccugugcugaggaccagguguuggacgcagacggcgucacuugcuuggguaugaggugccuggcugggugggagugggaagcagaccccaucaggaggaugccgaagaguggggaggggaggauccagggucccagucagagauuaaggaggcaaugaggggcccuuagggggccaacaggaagcaagggagggggagagcaaaggcucugggggcuaggagggaguuuagggaagaugggaggcugggagggacuugugaggggauggcaauuaggggaaacugagugaagaauggacagcuauggauggaaggaggaaauuauccuucacuucuuuuaaauguauuucuccauuacuaaaguaaaauaauaaauaguuccaaauauuggaaauuacuuugggaggccaaggcaggcugaucacuugaggucaagaguuuaagaccagccuggucaacaaggcaaaaccccaucucuacuaaaaauacaaaaauuagccaagcgugguggcaggugccuguaauccuagcuacucgggaggcugaggcaggagaaucacuugaagcccggaggcaaagguugcagugggccgaaaucaugccacugcacuccagccuaggcgacagauggagacucugucucaaaaaaaaaaaaaauuaacauuaaaaaauacauauaauauauauguuggaaauuagagaggagaaaaaagcccaaaucccaccagugagcaccauauauuguuagcauugugguaaagugaacaccauucuuuuuuccucagggggguuauaauuguuuuuuacauagcuguaaucaucuguuuauaaaaugucuucugcccuuuucgguucaagugucacagcauuuucuguguuguuauugcaugauuuuaacaagccuuguuuuuuauucaaaauggguuguguucauuguaaaacggaguaaguaaggccgggcacaguggcucacaccuguaaucccagcacuuugggagcccaaggcgggugaaucacuugaggucaggaguucgagaccagccuggccaacauggugaaaccccguuucuacuaaaaacacaaaaauuagccaggcauggugucacacgccuguagucccagcuauuugggaggcugaggcaggagaaucgcuugaaccugggaagcggagguugcagugagccgagauugugccacugcacuccagccuggcgacagagcaagacaucaucucaaaaagcaaaacaaaacaaugaaauaaguaaacaguauagaaaaacacaaaggagaaagcccaaaucaucccagauuccaccaccuguagauaaccacuguuaccauuugggggaaccaccucccaaauguuucccuaugauuuacuuucacauaaauggagucgugcugcacauacuguucuguuuccugcuuuugucacuugacaguauguaacgaguacauaagcagcauuuuuaauggcuaaaauauauuucauuugauaaauuucacguaauuuacucaaccguuucucuacuguuggauguuuagguuguuuccaguuuuuugauauaaucacaacccauguuuguugagcauggacugugugcucagcacugucauggacauuucccuugcaguaauuuguuuaccccuaaaaacauccuggugggaaaagugguuuuauuauccccauuuuacagaugaaaaaacugaggcccaaaguuagagcaggauuuaaacccaugaaguuugacccagagccuguuuuguaaucaugccucugcuauuugucacaucaucaugccugcccauauucuggaugguuuccuuaggauagaaucccggaagugaaaaugggucagugcagccauaguguacaccuaggagggaguggcuggggucaggagagggcguuggcugagaggguuaaggaauggaggggccaagguaaugggaggaucauccacauggaaguugaagucaccaagaacugaaccaggagugauuuuggagaaagugcuggugagccaggagcuaaaaacccuuacagaugacagggugcagccugggagccuuccagaaguagagguugguacagaagcaugauguaaggggaagaacaguccagggaacagcagugaggagcaaggaggacacauaccagccuccagguccaugguccaugggauacgggaggggaaaucgccacccauggggccaugggaaguuucagagauuagagaggggugggagaugagucagaccaggcaagcgcccagcugugaggucuggagaccgggcucacacaggagccugcacuuguggagguuaccaaggcacagacaaaggacgucgugauuuagcugcuaaugggccaagacagauagugauggugaggcauacguucuggggacaggauggguggagccugcgcggauguggugccaucuucacuucugcuggugggaccgaugaaacugugaaauaaaaaguccagggaccggggcagggcccugggguucccggagaugacuuccaaggggaaguucauggagaagucagggaaggaguggggagagccuguucgguggugacagagguauagaggccaugggcucucuuggacaccauuugauucucaggucacacugaaguacaguaagcauuaaguagaguaaacaucacuauuguugcuugggaaagaauugcaguuuccauccagauaauuuguuucaugaggaauuuuguacuagaaaaaauuacuuuguauuauuaaaaaauaguaaaacaaacaaaaauggugcaaagggcuuaguacuugucccacgaccggggucugacuuucccccucacgauccuguggugcccacagcgaacccauccuacgugccuccaccccagugccagccaggcgaguuugccugugccaacagccgcugcauccaggagcgcuggaagugugacggagacaacgauugccuggacaacagugaugaggccccagcccucugccgugagucacacgcccugccccacccuguuggauggcaggccugcagggcagcucggcucuggcagugccuauacuggagcgggcaggaagcugggggcacccaacuucucgcugaccccugacucauucccuccccagaucagcacaccugccccucggaccgauucaagugcgagaacaaccggugcauccccaaccgcuggcucugcgacggggacaaugacugugggaacagugaagaugaguccaaugccacuuguucagguguggagcggggcucagaucacacgaggcaccccucagucaaggaggcaggggagacgagggggccagguucaguggcucaugccuauaaucucagcacuuugggaggccaaggugagaggaucacuugagcccaggagcucaagaccagccuggccaacauagugagaccucccacucuuuacaaaaaaaauuuaaaaaaacugccgggcgugguggcgugcaccucuagucccagcuacuugagaggcugaggugggaggaucacuugagccugggagguugaggcugcagugagccauggucaugccacugcucuccagccuagacaacagagcgagaccugucucuaaaaauaaaaugaaaggagcaaaagaauuuagggcagaggggauggagcccugagcaggaguggggucugcuauccccuucccagccugggaaacugagagggcugagcuugcaggggacagagcauagcucuagacuggagaggaggaacaaggcaggguagaucuccuccugggaggauaccagagaccccuugagagaaagaguaaagcauccagugagaccagagagaugguuuugaauucucuaagagaaaugguuuuggauccuuggaaauaagggacaccaaaggcagagaauaauagggaagaagaggcagugaagagagggucaggacaaugaguacucacacccaucccugccccccagcccgcaccugcccccccaaccaguucuccugugccaguggccgcugcauccccaucuccuggacgugugaucuggaugacgacuguggggaccgcucugaugagucugcuucgugugguaagagggaugggcagagggagucaggcugggccugggggaggggcauccugagagcaugccaguugggggugccggagacaccugcaacccagcacuuggguggccuugagugaguuaaucucgguggccucugugagaggagagccccaucaucacagcauugugucucagcaaacucaugcaggaaaagcacucagcacagguccugugucugcugacucauggggaugagugaguggaguuuccagccgaggcacugcugcggggccuuccccacccuuccugacugggcuaagggcugcugguuaugggagggccgcugcacucaccugcccaguacugugaugcuguguaaucgugaaggcccuacucagcuacucuuucuuccucacagccuaucccaccugcuucccccugacucaguuuaccugcaacaauggcagauguaucaacaucaacuggagaugcgacaaugguaagagcuugcucuccucaccugcugauuccuaagacagcuagaggcuacagccaggcccuccagggaaggcaaagggcuucagaauccagcagggccucccuccaggacacugaaucccugcuggguugccugggagaaaacaggagaagucagaaaugccuggagggagccacgauggaccaaggggagaccaucaccuuuuagugucauuccuaccccaggcagggccugagcugcccacccucuaguagggcucggaggccagggagagaugagugagaugggccagagaggcagagcaaggagaaaccggugccugacuccuuucuccuugcaaacccccauuuccuggaguccuuggugcaccccucaggcucugggcuucaggcucagaagcccaccuggcagauagccauggaccaggugaugucagccuugagccaccagggcuaguauguguguaaaugugcgggcaggugacugccguguguggugucucagggcucuguucugucuguguuguguugugacgugcugccccagugguuccugucccagcugaugugugagcggauguguugggucagugccacguugccccucacuuuuucugugucucgcaugccaaugguugccccggcgguuucuguguuucagagaaggauuguggggacggcucugacgaacagaccuguccugagccugccggucagugcauagaagcacaugcaccaucacccagagcucagcuggccccagcccccugcagguucuccaggccccuacuccagagcugcuaggauaugaagaaaaagcaacagagaggagggagagcagaaaacagagggagaaagcaaauaguggucaggaaagaagcagagacggcagagggagccucugaggaaaggagaugacagagagguggugacaaaaagcccaagaugcaaggggaggagagaguuagagaagcaaauccaguuggaaaagaggcaggaacauaacccaaaccccagucuccaccacaugucccauaaauacagagggucaagucaagcagcccccacccaaugcugagaaagcaggagcuuccuucagccagccucagcgagcuugguccagaaguggcccccacucuugccagccacaggcagggccccuguaagccaggcacccagagcaugguauucagcagugccagccucagggcaggccuguaaagcuugucucaagccggccacgccugcaccccaccuaccucucucccuccaaaacuagagaaaccccugccuuucccccaaaagcaagcagaccccuguucccacaccugccagaaaggggaaaugaaauguuuaauguucccugcacccagccuuucugagcuucagugaggggcccuccaggagccuucuccuccuccucauccugaccacgugggccauggugcaugcugcagucuaugcaguuucugugucuuuucuguuuguuauuuucccaguggggggguuagggugggcugaggguggguucugggcagggggcccaagcugggaucacagagaaggcugcuccaccaacucccgcuuugccucuccccuucuucccccaccgccagacaaugacuguggggacaacagugacgaagccggcugcagccacuccuguucuagcacccaguucaagugcaacagcgggcguugcauccccgagcacuggaccugcgauggggacaaugacugcggagacuacagugaugagacacacgccaacugcaccaaccagggugggcaccaggggcccgugggguggggaugagaucgagcccccugcaucagacacccagccuauccaucugucuuucagacccacggugugucggccaccaucugggagccagagguagccuaggcauggcucuuguccuucaggagcucccgguccugugggagagggagguugccgaaaaaucauugccacacgcuguuaauaucaugcgcuuugcaguugguggccuuggguuugagcuccagcucugcagcuuauuaucuggguggccuugagcaaguuacuuaaucuccaugggccucugugaguuucgucugcaaagugggguaauaauagcaccaacaucacagcgcugaugugggaguuuagugagaucacgcacgaaaagugcucagcacacggccuguguuugguaaauaguagcuugagaaaaggaugcugcaggcagggaugaaugagccugaagagacagaggagagagggccuggcuccacaaggcucccagugcccuggccucuggggcccagccucgggggcgguggggaccuaguuuucuggagggaugggcccucucaaggaaugcuggcuuccuagcucuggaagaugugcagauuuuuaugugaaaacuaccaaauuuuuaacacuacaguauuaguuucucucgucucacaguucuggaggcuggaagucccagacccaacuguuggcaggguggguuccuucugaggccgugugggagauucugucccaggccucuccccagccuccgcgguuugcuggcaaucuuugcagcuccuuggcuugucgaagcuugacccgaucucugccuucaucuucacacgguguccucccugugggcaugucugucaccagauccccauuuccccuuucugugaggacaccugucauauuggauuaggauacacccuuaugaccucaucuuaaguugaccaucugcaaagacacuauuuccaaauaaagucauauucacagguauuaugggauaggacuaauaucuuuuuagggaacacaauucaagccauaccaacuggcaguugauuuuagaaguuuuaaaaggcugggugcaggccaggcaugguggcucaugccuauaaucccagcacucugggagggugaagugggaggaucacuugaggccagggguucaagaccaaccugguuaacauagggagaacccaucuugaaaaaagaaaagaaaaaaaaaaaaggcuggguguguugacucacaccuguaauccuaucacuuugggaggcaaggcaggaggaucacuuguuuccaggaguuuaagaccagccugggcaacauagugagaccccuuucucuacaaaaaauaaacaaaauuagcugggcauggaggcacaugccuguagucccagcuacucagaaggcugaggugagagguugagcccaggagguugaggcugcagugagcugugagcucgccacugcacuccagccugggugacagaauaagaccuugucucaaaagaaaaaaaaaguuuaaaaaaaacuacagaccaaacucuuccugcaggccucaucugacccauggaccacuagauuacagccucugccuuauagaguuagggcacauucccacccuaguaggagaagacuggacagcguugagugcccaccuugagcccugcccugagagggaggacagagaaggccacaggaagcuugggaaauaguaauugcgucuccagggcuaucucugugaaggggagggugaggggcacaggugauaucccuuaggguucugagaaggggccucuggaggcugugugguguggugagaagagcucccugccgcucccagauaagcugggcaaauuuggacaaguugcuuccccugagccugggcauccuccuuuaugaaaugagcugagguaugugaggccuggcguggaggagcagggugucacuauugguagcaguuguuaacuaugguaugagcuggauggucugggaccauucaggaggaguuguguuuagacugcagguaaauggacaggagggagggucuuccaguggggauggcaugguccggagaaugcugucgucaagacuuagagggugaaacugagcacuuccguagggugacaguggggccagguggagccguucagaccgagggaaaggcucgugcagggacaguggggaaugaggcuguccucaaagggggcagaugaugacagcagguguaaaucgugagaggcuugauuugggaggcacugggaaccuuugaaggauuuccaagccggaaggugcugugauguaggaggugauuucggaacacagcccuagaggaagauuagauugagaagagguucaggggccccaagaaaggaaaaucaguucagagacugcugcugaaagucccggcaugagaugagagcaucagcuggguccaggguagggaagggggaggagcggggugucuguggcagcaugaguguaugaguguggggcuccaccaggcagugcuccugcuccucuccuggccuccugagucagaucucaggacagcagccagagugauccugacaacauaagucagaucaugcccuggcccugcccuccagccuguacuggcucccugcacccuuggaacaaaugccaagccccucugcacggccugcagggcccccaccccuaccccucugaccugcauuccugcccuccccucccccugcacucuacuccagcuguggcguuuucuuuuuucuuuuuuuuuuuuuuugagauggagucucccucugucgcucaggcuggaguacaguggcgugaucucggcucacugcaagcucugccucccgggcagcuguggcguuuucuuuucuuucuuuuuuuuuugagauggagucucucugucgcccaggcuggagugcaguggcgcaaucucagcucacugcaagcuccgccucccaguucacgccauucuccugccucagccucccaaguagcugggacuacaggugccugccaccacgccuggcuaauuuuuuguauuuuuaguagagacaggguuucaccauguuagccaggauggucucgaucucccgaccucgugauccgcccgccuuggcaucccaaagugcugggauuacaggcgugagccaccgcgccuggccugugugcuguuuucugaagugcuggcguaguccuaucucggagaugagacuuugcagcggcuguuccccuugccuggagugugccuccagggauccucugggcucacucgcucuucaugcaggccucugcucagauuccuucugcccagaggucuucccugaccaucuuaccugacagaucacccccaucccucucagcuucuacccagcuuuaucuccauagcuuuaucaauaccugaaauuacagucuagauuuauggguuaugucuugucucucuuccccauuagaaccuaagcuccaugaggguagggacuuugucugguucagugcuggccccaggacagcgccuggcacacaggaggcacucaguaaacauuuguggcaugaaugaaugaaauagaggcuaaggaggugggcauuugggcucaggccuuagcaaauugcuucuccagcugagaucuccggugucaauggggggauuagaugaggugauuguggggcccuuggaggugugaugccuccugacucuacuacugaguuggugcuuccaaggagugucagcaaagcuuggcagacucuccaggccugccucugcucauauccccaggcugggcuuaccgggguggcagggcacagggaugaggagggcugaccugggcaaccccucccuccugaggcccuccacugucccucugcagccacgaggcccccugguggcugccacacugaugaguuccagugccggcuggauggacuaugcaucccccugcgguggcgcugcgauggggacacugacugcauggacuccagcgaugagaagagcugugagggagugacccacgucugcgaucccagugucaaguuuggcugcaaggacucaggugaagaggaugguuggagggcgucuggaacagcacaaugugggcaggaggagaccguguugagagcagaguagcggcaaaggggauggcacugugcuguguggaguggugcuggggacagugcaaggcaaaaggcaguccagaggaagcuugugugucaugggugggggaaggcaugaagggccagagccugcacagaggaccugagaagccaaaacccuaccagaguugagcuucagcaccuccugcugcagauuccugccuuguuuguugccuaugugaauuugacccaaaaagccucgggguuccucguggaccccacagcguugcaauccugacccuauuagagaagcccacagggucuggaaggaagggcagggggagccccaguccccgggccugggcccucauagugcaccugucccucagcucggugcaucagcaaagcgugggugugugauggcgacaaugacugugaggauaacucggacgaggagaacugcgagucccuggccugcaggccacccucgcacccuugugccaacaacaccucagucugccugcccccugacaagcugugugauggcaacgacgacuguggcgacggcucagaugagggcgagcucugcggugaggccuggucccaggagaaggguagggaggguggcuggguaggagucugggccaaggacagucuuugggggaccugagucuaggagagagcagcucuggcagccgggcaggcgagcagcacccagaguggucaccagcagccuguguggaccuggcgcuccccauggcgcugugcugagugagccacgccauuagagcaguuuauccacaaggcaucccugggggccaggugcucuguuuucuccguuugacagaugggagcacugaggcauggagggguuccauaguggucccccagacuugggccaagguaguacagcuccuaaacugcuguggagacucagaccccuugcccacaugcauaccacagagagaugcggagugcucuuguggagacaaaggcaccaggguugacugcugauggucagggcaggcuuccuggaggauguggggauugcaugggguucccaaggacaggcaguacuugcagagugagugagaaggcaugggggcaggcgcgguggcucacaccugucauuccagcacuuugggaggcugaggcgggcagaucacuugagcucaggaauuugagaucagccuggccaacauggugaaacccugucucugcuaaaaauacaaaaauuagccggacaugucugcagucccagcuacuugggaggcagaggcaggagacucgcuugaaccugggaggcggagguugcagugagccaacauccugccacugcacuccagccugggcgacagagcaagaccccaucccaaacaaacaaacaggcaaggggaggagggugcccauucaagaccaaaagagaugagguugggggaguccaggagucagggaggaccauguggugugacuuggggaugaggagcagagcagccuuaucugguccucuuagccaggcagagcccccaguuccuuggaagggaggaguggaagauaaggccacagggacuggcugggagaacugccgacaggcuaucagucaggcuggcaguuuccagggugugccagaggaccaagggugguauaggcccugcugcaccccaccccaaaccccuccaaaucaggagagaucagcacaaggggacuggaccuaaggaccucccagggucccucccagggaggcaaaaagcuggggcccccgcccugggcccaagaaggcaggaacauaucgagaccagacagagauauugaggggugcucccugugggaaggggagguauggugccagcuggugggugcaagggucccaacucugguccugagggagcccaggaaguccugggcugaagcucagccugaagcucagcaggaauggagacgaauggggccgugggcagggcacaaggacuugguccaggcugcccaggacuuggggcccagcagggccguggucuugccuccucucagcuucugacccugggucuguuccaugccugccccuccccuagaccagugcucucugaauaacgguggcugcagccacaacugcucaguggcaccuggcgaaggcauuguguguuccugcccucugggcauggagcuggggcccgacaaccacaccugccagauccagagcuacugugccaagcaucucaaaugcagccaaaagugcgaccagaacaaguucagcgugaagugcuccugcuacgagggcuggguccuggaaccugacggcgagagcugccgcagccugggugagacaacagugaggugugguggggcaggccgaggcaggccucugagcugcaguggguugggcuugguggccaggugccaaaggcugaguuuuccacccuagcccccagugcccggaccagcagagaccugccugcgccaggacggguggcacacaggcagcuagccccuugcugaccccaucacaucccucccaucccagaccccuucaagccguucaucauuuucuccaaccgccaugaaauccggcgcaucgaucuucacaaaggagacuacagcguccuggugcccggccugcgcaacaccaucgcccuggacuuccaccucagccagagcgcccucuacuggaccgacgugguggaggacaagaucuaccgcgggaagcugcuggacaacggaggugaccaccgauugcugccaggcaggaugcacacaggcggagcgcucaggcgcuaggggccacaggucccauccaaguggccccaaagcagaggcuuggcucccccaucccccacacuucuguucauuggguuagauuuugcugugggucuccaugccugacgccccguaauuaucgucagcagaacugccagccugauaauuaacaaaaugaucagccuuaccuuugaauggccuggagcucugcuccccagaucuagaauugcaggcuugaaagaaaaaagccacuuaggaguggcguaccugaacgcugcuuucugucccaggcagcguggugcaccccagacuuccuucagucacacacaauagugagugcccacuguacacacugggcagugggcaugcagcagugaucaaaacaggcuguuuucaguuguguggucaaggaagguccccugagaaggugacaucugagcaaaggcuucuaagaggcacauuuuacuagagaaguuuguauuguuuguaauaauacaaacuugaauuugaaaccauuacaaauguccaucaacgaggggggaggcuaaguaaacugugaugauauccacacugugcaacagucucuaaaacaaugaggcacacacauaauguauuagcauggaaaaaucuuuauggcagucacuugagcucaagcaguugaggcugccgugagccaugaucaugccacugcauccagccuuggugacagaagacccugucucaaaaaaaaaaaaaaaguuggggagacaauaggaguccuacucuugaauaugggcacaucagaaacuuuggcagaagugccaggguugagggugggucaucgagggcucccaggauuucacacauucaugcacagcuccccaggagacgcuaaccuuucacugcccucucuucuccagcccugacuaguuucgagguggugauucaguauggccuggccacacccgagggccuggcuguagacuggauugcaggcaacaucuacuggguggagaguaaccuggaucagaucgagguggccaagcuggaugggacccuccggaccacccugcuggccggugacauugagcacccaagggcaaucgcacuggauccccgggaugggugaggaccuugcccagccuucuccuggccccauggccccccugaagucccauucagccuggccagggacaccuuacuccucagugccaucugccuccucccacccucuaccuacgaucccaccacagucgcucccugagggcccugacuuuagcccuccugaccccuccccacuccccaggauccuguuuuggacagacugggaugccagccugccccgcauugaggcagccuccaugaguggggcugggcgccgcaccgugcaccgggagaccggcucugggggcuggcccaacgggcucaccguggacuaccuggagaagcgcauccuuuggauugacgccaggucagcacccucugugcccugagaaggcccaagucuguggcaccaggacgggguggggaggaaccuguggugaugagggugaugagaaggaccaagggaucuagaacuaggaacgguggcaaaggacugggcacaggaggaggaggacggaggggcguggggaggccagggccgaggggagggggcagguagaggaggcggaagcagggccaucagcugugguuauucacacuguaccauccucuccacucaccuguccucuccacucuguucccucugcuggggcugugucugcccagagggaggggaaacuucuuucuaauuggucugcccagggagggugccuuuuucuuuucuuuuuuuuuuuuuuuuuuugagacagagucucgcuccgucgcccaggcuggagugcaguggcgcgaucucggcucacugcaggcuccgccccccgggguucacgcugagggugccuuuuucugacuuucaucaaagcccugagugcugacagcagcccuggggagaagugaccgaaagauucccuuggggcuugggaaucggggccugagaggugaaaccuggaccuguuggguucucacaccuugguccuucugucugucugcucuggccagcaaggcuuaggggagggaauggucccaugcucuucgcugggagggcuguggccagggcccagagggugggcaccugggcagagcucugagggcugagaucccagcuggcauccucauucugcuccaucaugcucuuaggucagaugccauuuacucagcccguuacgacggcucuggccacauggaggugcuucggggacacgaguuccugucgcacccguuugcagugacgcuguacgggggggaggucuacuggacugacuggcgaacaaacacacuggcuaaggccaacaaguggaccggccacaaugucaccgugguacagaggaccaacacccagcccuuugaccugcagguguaccaccccucccgccagcccauggguaaggggcucggggccucgagcagccggaagggagccagcagccucuuuagaagcuguagaagcucuuaggagaggagagggcagugagaacaggagcaagucugugcugggauggcagggguaggccggcuguugacagaggcacugucuagcagcagagaagggucuaguaguagcggcugcuggaacagggggaggagagugggcgaggaaggggugguccauguagggagcagcaagucacaggaugcucuggcuucuucucuucuccacccugcccccagcucccaaucccugugaggccaaugggggccagggccccugcucccaccugugucucaucaacuacaaccggaccguguccugcgccugcccccaccucaugaagcuccacaaggacaacaccaccugcuaugguaggagccccucccuccagagccagugagcaacugaggcuggagggaaggccgcaggccccaggaucccgguugucagcuaaggcagagucccagucgggagggucccgauaggagaggcuccagagacagccacugugagaaggggcugcaggucugccaggggggcugcacccagcgggguauguccacggagccaagggccaguagcaaacagacggauccagaagaaggcagggccugaaaccggauuggugggaagcacagaggcagggacugccuucagugaccagcccaugccccacagaguuuaagaaguuccugcuguacgcacgucagauggagauccgagguguggaccuggaugcucccuacuacaacuacaucaucuccuucacggugcccgacaucgacaacgucacagugcuagacuacgaugcccgcgagcagcguguguacuggucugacgugcggacacaggccaucaagcgggccuucaucaacggcacaggcguggagacagucgucucugcagguucuuccuggcccuggaugcccaccaguggacaugggcaccuccacccgccccuugcucccaacccuggucuacuugguccgagugguccuucucccaguccuguucccccucagugcuccagccugguuuccugaucccuuuucuccagaaggcacacuggcuccccuccugacccacugcccugcagacacccaacaacugacucccuacuugugcccccagacuugccaaaugcccacgggcuggcuguggacugggucucccgaaaccuguucuggacaagcuaugacaccaauaagaagcagaucaauguggcccggcuggauggcuccuucaagaacgcaguggugcagggccuggagcagccccauggccuugucguccacccucugcgugggucagucuagggcccagggccggggagcaugggguguggggcugggaagaagaggacccugaccuuucccucuuggcacccuccccccaggaagcucuacuggaccgauggugacaacaucagcauggccaacauggauggcagcaaucgcacccugcucuucaguggccagaagggccccguggguacgagcuucccugcccacccccacagccccucccuaauuccuugaccagcaggugcuugcaggguccuucaguugccccucagccuccccagagcccuagcuuagugccuguucucaccaucugcucccuucccuggauccccagcccugggccagacuccccggcagugacucccccuuuuccaggccuggcuauugacuucccugaaagcaaacucuacuggaucagcuccgggaaccauaccaucaaccgcugcaaccuggaugggagugggcuggaggucaucgaugccaugcggagccagcugggcaaggccaccgcccuggccaucaugggugagggcugcugggcgaagcagagaugacgcagagcaggccaggccagaccuacugggagacaggggcuggcuuggggcagucucucaccauguggggcgggccugaugacuuagggccaaugggcccuucaggagagcuggguguggggccuucccaagggucucauccccuccugcugccccaggggacaagcuguggugggcugaucaggugucggaaaagaugggcacaugcagcaaggcugacggcucgggcuccgugguccuucggaacagcaccacccuggugaugcacaugaaggucuaugacgagagcauccagcuggguaggugcgaggccgggcggccgcugggggcucaggggcaacaggggagccguccagagcugcaggcugcagggccauggggcaagggaguaaguggguuaggcuguacccaccacccaaaggggcuccuuguuuccuuaccacaaaggcgccuuguaggcucccagcagcccuguucacaaggccaggggcccaggaggacagaaaaccugagagcuggguaggguggugacccccauuagguccaggguagucagugaccauccuguuucugagcagcccaagccugacccugaggucccaaggagggccaccuaacccuuucccucugccucccaccugcccccagaccauaagggcaccaaccccugcagugucaacaacggugacugcucccagcucugccugcccacgucagagacgacccgcuccugcaugugcacagccggcuauagccuccggaguggccagcaggccugcgagggucagugccuggcuuuccucccagccuugucccagcuccccaacccugaccccuccuacccuacagccccaccuuccucuucuuaccuuggggacaagacuacauucgucguguaggggacacuggacuaugaaguggcuaugacucuccagugccuccaguaggauuuuggaaaaauagaugucagcaggcagaucggggcagcugcauggaagaggcaugcucugagcuggguuuucuaggacaaguaggauuuggaugcauuguucaaaggagagggaacuauacacaaggcaaggugugugcaggagccccagccaagaguggugggcaaaguguggggaaguccuggagauaaggcugugagcuaggcggggcuccuguguucugagccaggagugccuggaaagugauguuuggggaagaucaaccuggccgcaauggugguggggaagaaacagaggcgguuaaaccaguuaggaggccauuaggaguaaucagagugugagaugaugggccugggcugggcucaguaaggguugaagaaaagaaaugaaacccagacgcauuucacaagaaccugcuaacugauuuaugagcuugcugggggacagcauuucccaaaagugcauuccuaggagccucccucuuugauguggguagauuuuaccaaaagaaacucugaguugaacaaaguuuaaaaguguuuugugcugcagaacuucucagagccuugaauauguuuaugugugccaagaauuuuucaagcguuugggguuuuccaaaacucacuugaccauucauuuuuuuuucacugagucugagcaaccagggaccauguggggauucacuuugggaugugcuguaucaaagggauaaaggcaagggaggauucugaggugcauggguaguggugccucaagacaugggaaaacugggccaggcgcaguggcucaagccuguaaucccagcacuuugggaggcugaggccggccgaucacuugaggucagaaguuugagacuagcuuggccaacauggcaaaacuccgucucuacuaaaaccacaaaaauuagcugggcgugguggugggcaccuguaaucccagcuacucagaagaccuaggcaggagaaucacuugaaccgggaagguucaaggguugcagugggccaauauugugccacugaacuccagccugggcgacagaucaggacuccaucucaauuaaaaaaaaaaaaaaaaaagagccaggugcguggcucaugccugugaucccagcacuuugggaggcuaaagagggcggauuaccuugaggccgggguucaagaccagccugaccaacacggagaaacccugucucuacuaaaaauacaaaauuagccgggcaugguggugcaugccuguaaucccagcuacucggaaggcugaggcaggagaaucacuugaaccugggacgcggagguuguggugagccgagaucgcgucauuguacugcagccuggggaacaagagugaaauuccgucucaaaaaaaacaaacaaagaaaaacaaaagaaaagaaaagaaaaagaaaugggauaacugggaaugagacuggcuucggagugaccuuaggggguugaguuuuugauguuggagagaggguguggcauagaccagacagagggaggacaaagaggaaacuaggaucaggcugagcaccaaacuggaagucuagauuuuggagucaccuaguccugauugucuggucugaacucccagacuuucccuaaggaacuugcaggggugcaggguuggguugugcuggguggaggccggcagagcacagggugagaaauccgagucucugcugcccucucaugguggcuagggguccugcaggugguuccccagagcuaccagccaggugcgcuuccucccggcccaugcucuggccucaggcuagggugugugugcuggguggaggauagggaugaugguggggggggaugauaucaaaggagaagcagagaacaguuggagggugacaggaaccaaguuuaagggaguguuggcgauacccaugccuuaaguuuccuugucuuucaggcguagguuccuuucuccuguacucugugcaugagggaaucaggggaauuccccuggaucccaaugacaagucagaugcccuggucccaguguccgggaccucgcuggcugucggcaucgacuuccacgcuggugagccauuugguggcagagggaguugggcguggcguaggagcuuuaggggugguguggugugcccugaggguccagugagaggcugccugaauuggccugagguggggcacuugcuacagcugccacccugacuccaccuccccuucaagcaccuggccccuccggcacucucucaccucugucuugagccuugugagauuuugaccccucaccuuaccccugccuuauugggcauccccaugucaccuccuccaccuccagaaaaugacaccaucuacuggguggacaugggccugagcacgaucagccgggccaagcgggaccagacguggcgugaagacguggugaccaauggcauuggccguguggagggcauugcaguggacuggaucgcaggugagcagugggcagguuuguggggcuugggguguggcagaggacugggggacgaagugagaggaggaguuggcgggagcaggaagaggagcuguaggggugccugggagcuuggagacaccagguccaccuguccucaccuaaccucccugagccccaccaacucccuccuuaggcaacaucuacuggacagaccagggcuuugaugucaucgaggucgcccggcucaauggcuccuuccgcuacguggugaucucccagggucuagacaagccccgggccaucaccguccacccggagaaagggugaggagcuggaaagacuggccuugucauucugcccauggcccaugcugaugaggcccugucuccuccagggucugaggacugacccccacuuccacccccacccuacagguacuuguucuggacugaguggggucaguauccgcguauugagcggucucggcuagauggcacggagcguguggugcuggucaacgucagcaucagcuggcccaacggcaucucaguggacuaccagguucgcacgccaacuuggccuuggauccgaugguagaccccugacccaggcuccuguucccugugaugagcccauucugggaggacuuggagcccaggggaagucacagggucucccagcccagcccuccacccagaguaggacuccugcuaccacagagaugaugggcaggggucgcucagaaguggggagugggggaguggagagaugccuggaggucaccuuaucagcagggcagugggcaggaguguaugcaggaggcaggagugaguuaggggaggcugaacugagggccucacucuggcccaggcacucccugcugccccagacauggggcuggcagcgagcucagcccuggaggugaggugggugccucuggccuguaggaugggaagcuguacuggugcgaugcacggacagacaagauugaacggaucgaccuggagacaggugagaaccgcgaggugguucuguccagcaacaacauggacauguuuucagugucuguguuugaggauuucaucuacuggagugacaggugagggcuucuguccuggccuccucagcugaucucuuccuucccuccugccuccacugaugcccugcuugugcccuguccuucccucaggacucaugccaacggcucuaucaagcgcgggagcaaagacaaugccacagacuccgugccccugcgaaccggcaucggcguccagcuuaaagacaucaaagucuucaaccgggaccggcagaaaggugaggcuggggcucugggcugggguggagaggugagggggacucuggccugggagagugcuccccagggaacccagugugagagggcugggagacaaguuagacccauggggcaacuuccgauggcccgagagacccagggauggggaggaaaggcugaggugcucugggacagaucuuggcauuggacucugggcccuggagggucauucaagcugggaauaccgaggcagagggcagagcuuucgccaaagccuggaugacaaaggcaccagugagccuuucccaaggcaggcccugcccucuguacccuccccucccccaggcaccaacgugugcgcgguggccaauggcgggugccagcagcugugccuguaccggggccgugggcagcgggccugcgccugugcccacgggaugcuggcugaagacggagcaucgugccgcgaguaugccggcuaccugcucuacucagagcgcaccauucucaagaguauccaccugucggaugagcgcaaccucaaugcgcccgugcagcccuucgaggacccugagcacaugaagaacgucaucgcccuggccuuugacuaccgggcaggcaccucuccgggcacccccaaucgcaucuucuucagcgacauccacuuugggaacauccaacagaucaacgacgauggcuccaggaggaucaccauuguggaaagugagcccagacccuaagucuucccaggaagugggacauggggcggggagcagcacagacucuuagaccccagccaggcacucuacccuaggucugaaucccagcagcuacaacucagcugaauccaacugcacccccgcaguuacaugacuccugauuuggagucagcgucagcccccgacuuccucccgccacugguccuaguucugccuucagagcugcacagaacaagcgagaggucucuguggagcccaacgcucacaaacccaggcugcagacauggggcugagcuccagucacuugggcuuucaauaacuugggucaguuuccugcucuugccaagccugagccuucucaucugcguggaugagugucucaucugagacaggauuccucgagcugcugcgcaggaaggcuuagcucagugaugcuggggacggagugugugcucuggaaagagcaguuacagugucagggcugucaucacaggacagccuuucagcucuuugaaaacugcauccugcuacauuuucucuucuucagccugguuaccaccgggucccuugacucauucauuugcucauauauucauucagcugguccauaaagaccugccaggcaccgaacuaggugcuacguauacagaccuguccuuucagccuuuucugggacauuuucugcugcacauaguccagccugcaugucugucuaaaaauguagcauccgaagcuaaacucgguacuccaugcucguagcuugaucaggagagacuggcacaucaauccccagaccccuggaagggauguccccucaccuccggcugucugcagaccauaccacagcauggcccuuuggcagccaccaucgcuuauagccacuaacacucuagucuuuucucuuacacugcuguucggcugugucucucacugugccuugguucuuuaaccugaguuuaagaugucugcuuuauaaaauaaucaauccagcucagggucuuuuuaaguagggggcuccccaguacagcccaagcaggauuugauuuacagaaaucuacauugcacucagcucagcagaacugcagcuccaggaaagugcaaacacaccagaaagcccgauugcccucagugggagaggguugagaggugaccacaggucauuugagugaggacagcagagguugggggcacugagucagacccuggugcccccgagcccucucugcugcaccucuugcacucccauaccccacacuucgccuuccagccaggagagcaccugccccaggcugucccccacggcuccugugcaggcugcccucugggcccuccugacaaaucgcugcuccugucucuucacagacgugggcuccguggaaggccuggccuaucaccguggcugggacacucucuauuggacaagcuacacgacauccaccaucacgcgccacacaguggaccagacccgcccaggggccuucgagcgugagaccgucaucacuaugucuggagaugaccacccacgggccuucguuuuggacgagugccagaagugagcugcugccuggggauggggguagcagggagaggugggacucgggguggcagaaacuccccaggcagauccaagcgggggugcaggagaggcaggcccucacuugagcuccacccuucccugcugugugaucuggggagaggugcaaaagcuuccuaagcuucagguuccucuucugugauacaagcuggcuaagauuccagcugccugcaccaaagggagcaucaggacugugggggacgcucugccuuugugauugauucauucaucagagcaccauguuggaggcacaggguagggccucuagcucugggauccaaagcuucaggcaaagaauguuugucgaacccuucguacagaagccuaaggcugggccuaccaagccaccuagcuggguugagaagucauacuugugggaaguaaugguaacuggcacagggcuguauacgggugaccacaggugucaugaaggcaguagauuggcccagagccuggaacuggaaaagacaaggaaggccagcucggacaggggaagugcuuugagcaaaagccugaagaaaggcaaauucaaggcagggaggacagagggggaccucugcaugccauagagcauaggcaggccugagcccagccaggaagugaggucagggugcggaggaguuaggagcacaagccaggacagguggcagaaagcacccgggggugggugcucccccuggaggguucacccgcagucagccugcucuguucucccgcaggggcagcccucaucccggcuguuugggccucuagugagccacccccucgccuuagggauccaggcccacauguuagcaacauuuuuuucccaauucagcagugcuuggaauguuuuucaaaagcuuuacuaggaaacuaguaaacacaacccaaagcagcuguauagauacgugagugucccgaacccagauuccccccaccagucccccaaugucagucaccuccaaccuggcucaaggacccucuguuuccuccugccucugucaucuggcacaucugcagcugaugaugaagguccaguccccccuuccaugacccucggcugccucaccugucuggggauggccucagagccugucccucaugagucuggagcuucccuggaggguccagcaaggcugccuggcccucgucccagaggacgugacccccuggcugcccaccaagcuccuuucuuaugaggccaggggauuccaucacgcauucagcgaguggcuuuugagggcaaagaaggugcagaggacccaguggggagcgcgaggggcgucaugaagagcuucguggcugugugcugaggacuggccccaccuggaagucagggaacguguccuugaagaggcggcauguuagccagcgucugaggauggcaggaguggcugggugggagcauggucccagugcccaggagaaagagcugagcuggcaggaggggcccucccccuggccacaaggagcaggcacuuucggggaaucagaaggagccaguguggaccccaguggagagggcaggggcaaguggagacuccaacaacccagccuccuccugagcccuccccgcgucagcacuggagcacugauggcccuguagagcucacaguaggauaguuagaagguccgccauguuccuggacacugagcaccuaccccaggaaagccucucucucccuccugccccauuccugggaagcagguucacccagaccacaguugugucacauggaggaguuuguugacgccaggaggaaaaccacuucucacugcaggugugaguaguuucaccugagguguaggaguuccugguggggacugacaggccaaguccaauccugacaagccaggaagaugacuggccacugccccaggauacccauuuucccuuauggaggcuagaaggacacgccgccucccucccaacuuacaucccgauuccagagccaccgcaaaccccugcucuccuccaggaugaggcccuuaagaucagagcuucucacgagcucgccgaggcucagggcagccagugucuccagaggggcagagcagcaccauuuuccuacgugagcccagcagaaggcgggauaguucaauggugcuggagacgcugggggugggcaagaagggugugaccuggagaggucugaggagacaaguucacaggccagaggacagaucuguggccagaauggugaggggcagagguaggaggaggccagaggcacuggggugggggcgggggcagguccuguuagggaacuggagaacggagcuggcuuuuguguggcuugguggucucagacuccacugugccuaaggaucgccuaggagcaagagaauguggaguccccugccccgcccugggccuagcugagugacaagcucugggaccgaggacccagggcucaccauccaaugccggugguccaaggaccacucugucacacccaggguagugcaugaccagcccugaggccuuccacagccccccuccagccucagcaccaccccacaaggagcacggcauaauugggggcuggcuguucccauugccuccuuuacugagaggaaaccagggcucagaggggcgacaggcucauucaaaguuggagccguuacgaggcagaacgguggcuccaaccccaaacaugcaaaggccucaaaguacggagaaggggacucuugagagcugcuugaggauaggacccacauaccccaggaccugggacacaugccacacucagcuccacaagggcuuccugaaugaucuggaagacagccagccucccugcacagaagagagcaguuaagaauaaacuccugggaaauacucacauagugugugccaucuguccuuaagauggagauuaacuucuuccacucucacauccugcgaggcagguggugcuaccauccccaccucauagaggaggaaacugaggcacagggcaguugaguaaguugccuaagggcaccuagcuggugggugguggagccagggcuggaaccccagggccugucucacuuggcugcaccggcucucuucucagcaaguagacggucacugcccagauacugcaaugugaauaucucacacuuggcccucauccccucacacucagccaccucgugugugaacugucugugcaauaguggggcccuuccugggcauuggggcacugcuggccucuauggcucugggguggcuuugcccuggcaggcuuccagguuccaggugccuacgcguccuggccugugcccucuguuguggauucucaggcuuugccuccugaucucuggacccucuucccccagccucauguucuggaccaacuggaaugagcagcaucccagcaucaugcgggcggcgcucucgggagccaauguccugacccuuaucgagaaggacauccguacccccaauggccuggccaucgaccaccgugccgagaagcucuacuucucugacgccacccuggacaagaucgagcggugcgaguaugacggcucccaccgcuaugugagucugcggggugggugagcuggcgggcggcugaggggaggccagggccagggucagccgucaaccaagaccguccaggcacagacauggugggaacagcugggaggaggugagugccuccaggccccagccucggucaaccccacccuguccagcuugcuccucaucagcuagacgagggagauagcaggaugccucugcgggcccucauucuguagcugucagaggccaggccaggcugugguccgguggagacugggcaagaggccugagcgaugcugugacggugauggugcugucuccacaggugauccuaaagucagagccuguccaccccuucgggcuggccguguauggggagcacauuuucuggacugacugggugcggcgggcagugcagcgggccaacaagcacgugggcagcaacaugaagcugcugcgcguggacaucccccagcagcccaugggcaucaucgccguggccaacgacaccaacagcugugaguggggcugccgccagcugccucacccuccugccugucgugcauggacauacaaacacacaccccacacacacaucgcacauaccacacgcacccuacacauaccacacacacacaucccacacauacuacacuacacacaccacaccacauacacacaccacaccccucccacacacucaacacauacacaccacaccauacacaccccccacacaccacauacacauacacccccaacacauacacacacauacacaccccacauacacacaccacacauaucacaugcacaccccacauauaccacaccacacacauaccacacacacaccacacaccacauacacaccacacauaccacacacaccccacacauaccacauacacacaccaccacacacacuacacauaccacacacacaccacauacacacaccacauacacacaccacacaugacacauacacaccacacauaggacacacauacacaugccacacaccuaccacccacaacacacaucacacacacaccacacagcacacacacacaccacacaccacacguaccacaaacaugccacacacacacacacacaucucacagacauacuauaaacaccccacaccccacacaccacaccccacacacacuugccugguccugcucucccugggccuccauuacacagacacacacagcuguacacaccuuuggaaccgcaaaacccccagugcuccuguaccccuucccaccaaggcaucuacgcacacagauggacucugcacacgccuggcaucuccuccacguugcacacacacauucaugucacacccgccccucagggcucauccaugcccucggugccccuacccucacccuggucacucuccucacuuggagccacacagacagccgagagccugggugcacgugcccucagugggcacgaguacaugccccagcgccccccaccacagaccugcagcuuucccaggugucucccaugcgcccuggggcucacuacugcacccgugaucucagggcccucagacucgaaucucucagaaacacuccucaaagcccacggugcccugccuaaaagcacacacauccucaacggcacaccugccgaaaaccccaugcaccuggcccucccacagcagccauccccaugcccuccccacuggcugcaagccgcugugccugccgugacugagcagaggcuugggagcuccaugaagucagugaaugggugggugcacucugggugcaugcacagcagagaacacucuccagcccugcgcccacccugucccugcucaggugaacucucuccaugccgaaucaacaacgguggcugccaggaccugugucugcucacucaccagggccaugucaacugcucaugccgagggggccgaauccuccaggaugaccucaccugccgaggugagagaggcgggggggaggggcuggcggggaacccaagcacacaccagggauggugaccaucuccccuacaugcuccagcccagccccccaaagccuuuugccaagaagacgcugaugaugaccucagcuccccgggggaggaggcgugggcacuggggcccacagcgcuggcucagaaagcucccuccaccucccuccccagcggugaauuccucuugccgagcacaagaugaguuugagugugccaauggcgagugcaucaacuucagccugaccugcgacggcgucccccacugcaaggacaaguccgaugagaagccauccuacugcaguaaggagcccccugcagccccugccucuuccaggcccagagcccagguccuccucccccaggccccugcaggauggagcaggaucaggacccagcuuccugaccaugaguuuugggagcucaugaagggcagaaccacuguuagccuggacugggccuuuggguuuggggguggccagcuggacacgugcaugacgucucagggaggcagcccuuucccugugccuguggcugacacgcagccuacuccuccauuugcagacucccgccgcugcaagaagacuuuccggcagugcagcaaugggcgcuguguguccaacaugcuguggugcaacggggccgacgacuguggggauggcucugacgagaucccuugcaacagugagugaggcgcacuggcauaacccaucuguaccucaguuccugccccaccccucccuggccaagcuuugucccugggccccguggugucugguucaaggcacucugugacaggccagggcaggugcugugggccaggagcucuguccugcguccuucuggcccccacagagaaaacucuggccugacgauacggggcgggcacuguucuagagacagccuguggugugggcgaguuccgcugccgggacgggaccugcaucgggaacuccagccgcugcaaccaguuuguggauugugaggacgccucagaugagaugaacugcagugagugacgcccuuugcuggcaccuccugggcuccuccccaucgcucacugcaucucccgccuucaggcccuccugcaccugcccacauuccucucugccuucccucauccccgcugacagccuccaucucccugaggcccuguccccaucccgcuccugcuccugggcucucgugggguuccgagagggggcagugagcagauggugcagacagugccccaccagaagggcaccguucaacuuuuggaaacacaugaaggcuccauagggcuggcagcugccccagucgggggugauccagggggaaccagguaucacccucaccccugcccccaccaggugccaccgacugcagcagcuacuuccgccugggcgugaagggcgugcucuuccagcccugcgagcggaccucacucugcuacgcacccagcugggugugugauggcgccaaugacuguggggacuacagugaugagcgcgacugcccaggugggcgggggcagguguguggugggugguggccugcggugagcagggcccucacaccugccucgccccccaggugugaaacgccccagaugcccucugaauuacuucgccugcccuagugggcgcugcauccccaugagcuggacgugugacaaagaggaugacugugaacauggcgaggacgagacccacugcagugagugaccacugcacccacucagugcuccaagagccugcugggccccacuucuuagucccccccagcaaaugcccccuuggaaaagggcauccagagccuucaacccccugccccacaccccaacucuugaggucagacucagagacucugccucuagcugcugcugagcccccccacagaggggugcugugggcaucucuccuguccuucccauggcaucagccuccccaggugggugacccccacccuuccccaucuaacuguggcuucugacugccccagacaaguucugcucagaggcccaguuugagugccagaaccaucgcugcaucuccaagcaguggcugugugacggcagcgaugacuguggggauggcucagacgaggcugcucacugugguaaggaagcugggauugggccgggggaggugccccagggagggacagaccccacccaacuccaccccacacacagacaccccugcagacgacggcgaaccaucaccuccacugcuagaccugaucuacccgcuccuaagucucucaguggcccucucucccccuacagaaggcaagacgugcggccccuccuccuucuccugcccuggcacccacgugugcguccccgagcgcuggcucugugacggugacaaagacugugcugauggugcagacgagagcaucgcagcugguugcugugaguggcggggccacguggagcggguggacagcaaauggccacagucucacuuugcagauggggaagccggggugcaggagaggaaaugccucagcgggguccacugggggcggagccauagcuguagcccagguguccagacuccucauccagugcccugcccacucuaccaggagaaccacaggagguuagagugagggacggucggccgcuggccaggcagggcugaagggcuguguccaccucuguccacaguguacaacagcacuugugacgaccgugaguucaugugccagaaccgccagugcauccccaagcacuucgugugugaccacgaccgugacugugcagauggcucugaugagucccccgaguguggugagccuucggcgguggugggaggaggcccugcccucugccgggccagggcaucagccucacagguccauuccucccccagaguacccgaccugcggccccagugaguuccgcugugccaaugggcgcugucugagcucccgccagugggagugugauggcgagaaugacugccacgaccagagugacgaggcucccaagaacccacacugcaccagccaaggugggccccagaccuggcuccccucugcccccuccccagacugccugagaccccgcugaccugccgccuccgccccuccgcagagcacaagugcaaugccucgucacaguuccugugcagcagugggcgcuguguggcugaggcacugcucugcaacggccaggaugacuguggcgacagcucggacgagcguggcugccacaucaaugagugucucagccgcaagcucaguggcugcagccaggacugugaggaccucaagaucggcuucaagguaugcccagcccuggggaggagcuuccacaccccagacgugccaggaacgccuuucuccacugccuuauucauucauucauccccuagacaguggggauacagcagugaaugagacagaaaucugcuugguuggggucugccucuaucuggcagguagagagccagcagauuugcugacagaugagauaugcagugugagaggaagagaggagugaggcaucaaguaggcaagagauacacaggucuggaguucaaggagaggcccaggcuggagagggaagucugggaguuaucaccauagagaugcuauuugaaucugugagccuggauaugauucccaagggagcaguguagguggagaagagaggaguccaaagucugagccccgagcugagcaacagccaggagcagggaagugaggggaccagcagaagagccugagaaggagcagcugcugaggcaggagaacagccacgagaagaaagcauuuccauggggagggcacacgcagcucugucaaaugacacucgggggcacacagaaggaggccugcacugugggccagcugggugggcucaguacccauaugcugcugccccuagugaggccggguagagggaauuggagucucugagccaggucuccagggugggaggcccagacccugccacaugcccagcccaaggcucccugugccugcagugccgcugucgcccuggcuuccggcugaaggacgacggccggacgugugcugauguggacgagugcagcaccaccuuccccugcagccagcgcugcaucaacacucauggcagcuauaagugucuguguguggagggcuaugcaccccgcggcggcgacccccacagcugcaaggcugugacuggugagaugcgcgcuuggagggcaugaggugacccaggcugugugggacugcccggguggcagagcuccagacaggcaggagaccagggccgcuagaaugugccaggagcugaggcaagauccucugucugcagacgaggaaccguuucugaucuucgccaaccgguacuaccugcgcaagcucaaccuggacggguccaacuacacguuacuuaagcagguaccaaacccaggcccuccuccccgcugcccaucucccagacccagcacagccucccuugcaagucuccccgcuuagguccaaccaucccucccccagaugcaaauguggccccuguugccacaaccgacuucugcuguccuucacuccccaaauccagggccugaacaacgccguugccuuggauuuugacuaccgagagcagaugaucuacuggacagaugugaccacccagggcagcaugauccgaaggaugcaccuuaacgggagcaaugugcaggugaggcgggcggcccucggcgaccaacacuggcccgccucagaugacuguuuucagaucgucucuccuucccgccccaccaacccaaauugcuuccuucucacuccacuagucacuauaugacugcuuguucuagcugcucacucuccucugggcccagacagcaaggacugggagauuccucuugcccuuccccucgcugccagccucaugucuccuuaaucaucaggaaguucccugugaggucuggccaagcacugugaggcuuggggcguggucccauucaccuagagcccccucuccuagagccucugcugacaccuacacagugucaggcccaggacugggcauuuuacuuccaugguucucccaccagagcugucagagggagcucuaccccauuuuacacgaggggaggcugagccucacagaggcuugcagguccucccccaggucacccagagcucucccuccccugccccuuccugcagguccuacaccguacaggccucagcaaccccgaugggcuggcuguggacuggguggguggcaaccuguacuggugcgacaaaggccgggacaccaucgagguguccaagcucaauggggccuaucggacggugcuggucagcucuggccuccgugagcccagggcucuggugguggaugugcagaauggguauguggcugaggaggguugggggagccccugaaagcagcauccaagcccagccucccugcaggccacuggugcgauggguuacgggaucucccagggcucacugccuacccaucgccagguaccuguacuggacagacuggggugaccauucacugaucggccgcaucggcauggauggguccagccgcagcgucaucguggacaccaagaucacauggcccaauggccugacgcuggacuaugucacugagcgcaucuacugggccgacgcccgcgaggacuacauugaauuugccagccuggauggcuccaaucgccacguuggucagugugccagugaggcuguccaggcacagcagacucaguggggauggaggucugaagcgacaggggaucaaguuuugggggcaagaguggacauaaaaagcggaggauauggccugaggacaccacucacuggggugugggguucagagcaccccgggggcuuccccagccuggccaccacccagcucccuugggaaggaagaggagaggcccuucccuuguauacacaguucuggaggacuggccccaaggagggugggggugggaggccugcgauugagaacugcagugcuccccacuucccgaggggagccauacacuggcagggcaggaacuugccaugaggcagucuagguuugaacuccagcucugacacuuguuagcugugagaccauggggggucuguaccaugaaccaucuguaacuggggcugacacccaccucucaggguggugguagggcuugaggagguggagugggccggcacccuguccgagcuccggcugacuggcacugugccugccccuuggcccugcagugcugagccaggacaucccgcacaucuuugcacugacccuguuugaggacuacgucuacuggaccgacugggaaacaaaguccauuaaccgagcccacaagaccacgggcaccaacaaaacgcuccucaucagcacgcugcaccggcccauggaccugcaugucuuccaugcccugcgccagccagacggugagcaggcaaggggugggagcaggcgaacggugagccaggcaccggggucccugggaguuccugcucaucccuucucuagcauugaccaagcccuccuggccagacacugggagacuccaggagggucuagacaggggauggucuggcucccgggagcuucagcccggccuggauccagcccuggagucuggcagcagcaagucccugaggccagucaagugggggucugggugcccagcccccagaaggaaggcaggccggccccugggagggaagcacagaggagguggggagcuggccuucaggccuggccugauccugggaccuuagaauccucuccuaucuccagcuucagcucccuccuaaaagaggcaggguucagacccacccgccucuguccaggauagagugagugaggcagccuuugguaggccagaaaaugucaccauauuucacgacguuuucucuggcagugcccaaucaccccugcaaggucaacaaugguggcugcagcaaccugugccugcugucccccgggggagggcacaaaugugccugccccaccaacuucuaccugggcagcgaugggcgcaccuguguguccaacugcacggcuagccaggugaggcugucccccagaccccaucaccagugcccgcuccccaacccccaaauccuccuuggaccccaacaccugcucuguccuaauguccucaugcaucugguuuucccacacuaacacccccacauuucuugccuaccucuugucuccccacagcaauacuuuuacccccgucaccucacacagacaccuccacacccuaaccuugacccuccuugccaugcuucagugcugccuuccccacccuaucccacgcagccccauaccuggccuuuccgaacucaccauagcccaaccugccccauaacacccugaccccugccucaacuucuuugaaacauccaagccccucaaaagaaagacuucugagucccccagacccccaccaaccccucuugcccccaccugcccuccaguuuguaugcaagaacgacaagugcauccccuucugguggaagugugacaccgaggacgacugcggggaccacucagacgagcccccggacugccgugagugccugcugggggugacaggagggcccccagcugugucggaggccugacuccugaggcuuugaauggccacuggagaggcuggggcuguggugcccugcaaguggaccuggccguguccaccccagccgcucugacucugagccucccucucuggcagcugaguucaagugccggcccggacaguuccagugcuccacagguaucugcacaaacccugccuucaucugcgauggcgacaaugacugccaggacaacagugacgaggccaacugugguaaggcgcugcccgcccacccucccuccuuccccagcaucuucccugccccaggauuuggggcuuucaagugcagggaaguugcagcccacggcagcuugcucuccaggcuggauuccuauggcucaagccuguguccucccugcugagggaugggcacccucucccugccccugaguccucccuucgccacgaaucaccuccuccucccuccacagacauccacgucugcuugcccagucaguucaaaugcaccaacaccaaccgcuguauucccggcaucuuccgcugcaaugggcaggacaacugcggagauggggaggaugagagggacugccgugagugucagaggugguggugggccgguggugggagaugacacggaagcagggcaggcagaaucuccccacagcuuugagaggcucucaaauaacuuuaguagaugggcaacacaaauuauauuggguguaacuugcuuugcucauaaaaaucaucaugcaugauauagagacauagagauccagaaaacaaaaagcaccaaaacuggggauaaacuguuccuuccuccgaagaaguugcuggcaggaccaaggccagggcuuggaagagagagaagacagugauggugaacuggaguggcagguguaagggagggcccucauucucuugcccaccccacagccgaggugaccugcgcccccaaccaguuccagugcuccauuaccaaacggugcaucccccgggucugggucugcgaccgggacaaugacuguguggauggcagugaugagcccgccaacugcagugaguugccuggccuggagcccagcuucccuccccagugucugcugcucacaccaccccgacgugugacccccucaguggcugcucccucacucuccccacccucccggcacacuccuggaaggagucucauccucaccccaugcccacccgcuugcagcccagaugaccugugguguggacgaguuccgcugcaaggauucgggccgcugcaucccagcgcguuggaagugugacggagaggaugacuguggggauggcucggaugagcccaaggaagaguguggugagccgagaccccacuccaggaggaagacagucuaccugggugggaggcauggcaccccuggcagguggagggcugggggccgccugcuuaccggucucagcguggcccugcugcugggcuuccugggccugcuguggggcuggggaaggaggccuggcuggagcucacuuccccacauccacccgugccccaugucucccaguuucccuaucccugccccugcccacgccucauccacacauaccuguguggaguuuucccugcccacccuaugggaucuguucaucuccuucccaaggcagcugcccacacacacacccccaaccaugucuccuguccccaaaccuccuuauagaccccacgucucaaaacaccgccugggcuccccgcggcugacccuucccaagcugggaugcccacccucccugccaggccagccugaccaugccugcuuggacccuaaugucugccccagcccuuucccugacugcccugacacuugccuccuccagaugaacgcaccugugagccauaccaguuccgcugcaagaacaaccgcugcgugcccggccgcuggcagugcgacuacgacaacgauugcggugacaacuccgaugaagagagcugcaguacguccccacccacccagccccgcaugagccccucccaggccuggcccuugucucgcggcccuccugccacaggccgcgccagagcugguggccaccucccagggugggggcaggagccgcccuccucacccaucccacuccaugucguguauuugaguuugugccauuucaccucaucucauguuucucuccauuuucacacuguccucucgggguugcagagguaggugucucugaugugcccgugcucccaccauacccccaccucugucccagagccccccaucccugugcugugccucuacccaucauccuugauugaccucuccccaaacccuggugcuugucucaguggucuugcccccgcuccccuccccaaacacagucuguucugagggcaaggccagggaccuguguccucucuggugucugucccaugggguaagugcgagcccgccugugcccagcuguuccauaggagcagccagugggcucugccaggacuggcucggccucugggucagucagcuguggccuucagagacacggggaugggccuugggcucgggacuguggcacuacugaggccuggaguccuugugcccacccuccugggccugucucccccuguccuucccagccccucggcccugcuccgagagugaguucuccugugccaacggccgcugcaucgcggggcgcuggaaaugcgauggagaccacgacugcgcggacggcucggacgaggugggcagggagaugagaaggaagcagauggccucagaggaguucaggcagggcuuggggagugccgagaggugaccggcugccugugcccaugcccacagaaagacugcaccccccgcugugacauggaccaguuccagugcaagagcggccacugcaucccccugcgcuggcgcugugacgcagacgccgacugcauggacggcagcgacgaggaggccugcggcacuggcggugcgccccuuggcuuggucucccuggguccucccucugcugcccaccccgccacauggcccagucauucacucauucuuucucuucuguauucauucuucaugcaacaaauauuuauuaagcauuuaccauguaccaggcacugccauagguguuagggacguaguaguaaacaagacacagggccccugaauacacauuuuugugcggguugugcccagcucaaugcccccuagucuaggggaccaguugagcugaaauccagcaaacccugagggcugugcccaucuaggccccaccccacaagucccuccgagacagucugcugccacaagaagaaaagcccugccuauuuucccuuccugggggcagugagacagugccugucccucgcugaccugccugggcucugcaguacagagggggcaggugaagcccgggaugagaaaagacugggccuuggagcggaaaucccaacugugcgggcagaugucuuggcucugccuugguaggccaggcacagggaugggaacccggucuuccauucccagcccagugcuguucccgcguccccgcuguggaacuacacagcccagugcuguucccacguccccgcuguggaacuacacagcacagugcccugccacauaccagagaaggagugcccucugaacuccuccagacaccccugaaaaauggccucuucuccccuaaauaccagagggggcaguuuggccccaccaaguagaaauuuaagagaccugguuccaauuuggcugugccacugcuugccuggugaccccucugagccuggaacccccaccuguggagacaggggucugggugggcucauggcucauucuaucucuuggcucccccuggcaccagugcggaccugcccccuggacgaguuccagugcaacaacaccuugugcaagccgcuggccuggaagugcgauggcgaggaugacuguggggacaacucagaugagaaccccgaggaguguggugagauuuggggcggggcucccaggcuucccaguggccagcaaccacccccacucccaagacuaauucuggcucugugucccccuggcugcugcagcccgguucgugugcccucccaaccggcccuuccguugcaagaaugaccgcgucugucuguggaucgggcgccaaugcgauggcacggacaacuguggggaugggacugaugaagaggacuguggugagcagggggccgacgagaggccugcaggggacggguagugcacaguggggugagucugguccucgugggagcugcacugggguuaggguuaaccaggaggacucgcccaggaaggggaggauccauugcuaggagccugggggcuuuucguuaggaaagagaagccccuggggaaggcucugggggcugccugaugccuuaggucuuggagguggggcugggaacccaaauguuugaccugcucccccugcaagccuugucacuuaggaauugggagccacuguuaucuaugggguugccgugggaggaggaggcaggggagaauacccagggccuaaagccucugcccuccucagagccccccacagcccacaccacccacugcaaagacaagaaggaguuucugugccggaaccagcgcugccucuccuccucccugcgcugcaacauguucgaugacugcggggacggcucugacgaggaggacugcagcaucggugaggcccggcagcggaccggacgcugguggggaguggggagagccaagcccuggccugggguggcucaagggagggcauccacucucugucccccacagaccccaagcugaccagcugcgccaccaaugccagcaucuguggggacgaggcacgcugcgugcgcaccgagaaagcggccuacugugccugccgcucgggcuuccacaccgugcccggccagcccggaugccaagguaggaaagcggggcagagcagggguggacaccccaacuguggacucucaugacccucccuguaacccuuagacaucaacgagugccugcgcuucggcaccugcucccagcucugcaacaacaccaagggcggccaccucugcagcugcgcucggaacuucaugaagacgcacaacaccugcaaggccgaaggugccggagccaccagagggcagaaaggcuggguggggcagggcgaccaggauaucaaacggggccgacuuggaauggaaugucuuccugcggacaucuugcccagacaagaagccccagacucauaguugcagcugccugagcacagugcuggcccagcagugggggcagguccuggggcuggcugacugaaggagucugggguguggcagugcucugaauugcacacacaccuccucacccaccacugccaggacgagaguacacucagacacgcauugcacacucacagucaugggggccucaccugcacauuccccacaugcuuugaugcccaccuugccuuccacaugccuguacacagacauucacacacaccccuggcacacacacccccaccaugcacucccaugcacacccucgugcuccaugccaagcacacacaccccaugugccuaugcacccccgagcaugugccaggcaguuuguagcagagagcguggugaugccauccagcagccgugaggagguggaagucucugggucuggaggggcagggacagcuuucugacugaaaggagcgggucacaguggaucagcucaggggaggagaggaggagguccagaggcugagguuggagccugcaacccugagcagggaggguaagcagcagcuucuggccggagcagaugguccuaccaggagaugggacaguguucaugugaaaggagcugagcuggguggggugcacaccugcaucccacagccccagcccuggccucuugcuucuccaggcucugaguaccagguccuguacaucgcugaugacaaugagauccgcagccuguuccccggccacccccauucggcuuacgagcaggcauuccagggugacgagaguguccgcauugaugcuauggauguccaugucaaggcuggccgugucuauuggaccaacuggcacacgggcaccaucuccuaccgcagccugccaccugcugcgccuccuaccacuuccaaccgccaccggcgacagauugaccggggugucacccaccucaacgugagugcccaaccuggcguggauggaguggaagagcuccauagagcaggcgguucagagcaggauuugaaaagggcagugcuggcuaggcgcaguggcucacgccuauaaucccagcacuuugggaggccaaggcgggcagaucaccugagaucaggaguuugagaccagcguggcaacauggugaaacccugucucuacuaaaaauacaaaaauuuggcugagcgcgguggcucaugccuguaaucccagcacuuugggaggcagagguggguggaucacgaggucaggagauccagaccaaccuggcuaacacagugaaaccccgucucuauuaaaaaauacaaaaaaauuagccgggcaugguggcgggcgccuguagucccagcuacuugggaagcuggggcaggagaauggcaugaacccgggaggcggagcuugcagugagccgagaucgcgccacugcacuccagccugggcgagagagugagacucggucucuaaauaaauaaauaaauaaauaaauaaauaaauaaauaaauagagacucggucucuaaauaaauaaauaaauaaauaaauaaaauaaaauaaaauaaaaauacaaagauuagccaggcgugguggcgggcgccuguaaucccagcuacucaggaggcugaagcaggagaauccuuugaacccagaagguggaaguugcagugagccgagugccacucgguugcaguggcaccaagguugcagaauagcacugcacuccagccuggaugauagagcgagacuccgucucaaaaaaaaaaaaaagaaaaagaaaacaaaagggcagugcgaggggcaaagguugagaguggggcagggggcagucuuaggauuguguucugaggcauggccagcgggaagacagagcagugggaauggucagcagcuggcugugcugcaggcagcccagggcacagggcaugaugggcaggcagacagcccuccggcaccaaucccccauccuugccacuucccacuguguacgucuuagcuaccucauuuaaccucuuuggguuucacuuuguuuaucaauaaaauuaggugaucaucgccauugcacaggcuucagggagggcucaccagccacgugugagagcugcgagucuggcgcauaagcuccaugccgguugaaucucuuuaaagccaggguccuggcugugagccuggggugacguuccagcaggcuggcagagugguggcggggggauaauggcaggaagacaaagcaguggccccugaaccuguggcuuccauucagauuucagggcugaagaugcccagaggcaucgccaucgacuggguggccggaaacguguacuggaccgacucgggccgagaugugauugagguggcgcagaugaagggcgagaaccgcaagacgcucaucucgggcaugauugacgagccccacgccauugugguggacccacugagggggugggcaagggcccuggggggaggccucugggcuggugguaggaagcccccgggacaggguugggggcugcacccacaugcgugcccuucccucccaggccagccugaggacagaguccuuuucagucccuugggucuucucggccaccccugccuggcccuccccaugcugccucugcccagggcccccagcugggccugcuugggcagggaucugaccucugcuuggccggcugucaugcacagccacacucugcccuggggaacagcucugccagcgucgguggcucugaaugagcacacugugguuuuagaggaaaagccccucaaccugcucagaagcagacucccgccugcuucucuguagaaggacagaaugcccuccucccaguccccagcagucccuguccccagaccaagaagcugguguccugccugggccugccuccucuggcccuccggccugcccacacucaccccuucucccuccccaggaccauguacuggucagacuggggcaaccaccccaagauugagacggcagcgauggaugggacgcuucgggagacacuggugcaggacaacauucaguggcccacagguuuguggggcagggugcaggagggacgggcauggagggggcccggcucgcagagcccagcugcugcugaagucacacaaaagcaagggaugggauggggcuuggacuggggcagggcagauuggccguggaggcuuuucccgaaagaggugacugugaguggcguaugaacaggguggagcugucccgggcauggaggcaguucuuuccaccccgagccuggguuggggaggccaagcucucacagugcucucucucuccccaggccuggccguggauuaucacaaugagcggcuguacugggcagacgccaagcuuucagucaucggcagcauccggcucaauggcacggaccccauuguggcugcugacagcaaacgaggucagagcccggcauaagucgcaguccccagcccuguccccagccuugccauccucccuacugagccaaaggccucacuucaaugccucccauccuuugucacugacccccagcaaugcugcagcgccuuccaggccucuccagcuggccucccccugaaccagcccugcaggccugagacccacccugacccucuggccuacuuguccauucauugguuggguugcacggaggcagcauagguacauuaggaacguagcaaauugggggagaaggaauagaagucagucaugacugaccccagaagucugggggugaugggaccuuuugccaguaguggccacaggaggaggaaccgguguggggagagagaauuuggucuggauguguugaguuugaggugucugggaaccacaggugccagugucguggacagcauggccagggccugagugccccucagguccccucugacuccaccuccucccccaggccuaagucaccccuucagcaucgacgucuuugaggauuacaucuauggugucaccuacaucaauaaucgugucuucaagauccauaaguuuggccacagccccuuggucaaccugacagggggccugagccacgccucugacgugguccuuuaccaucagcacaagcagcccgaaggugggggcagaggggagccugggcuggggaagggaggccugugggcauugagucuccaagcuguggcccugggaccugguggagagggggucacccugggcucacagggcucagagaaggguccugcucagcauccuccccaccccacccauaccugcagugaccaacccaugugaccgcaagaaaugcgaguggcucugccugcugagccccagugggccugucugcaccugucccaaugggaagcggcuggacaacggcacaugcgugccugugcccucuccaacgccccccccagaugguaugcuuaugcccucccagucccagccaugccucaggaccaucuccuuccuguggcuccugacuuccccugaccuuguugccugucccucuccuccuauuccccuggcucugccccuugacgggcccuuccugcagcuccccggccuggaaccuguaaccugcagugcuucaacgguggcagcuguuuccucaaugcacggaggcagcccaagugccgcugccaaccccgcuacacgggugacaagugugaacuggaccagugcugggagcacugucgcaaugggggcaccugugcugccucccccucugguaugcccccucaucccgccacgccugcuccuugccccugggccccagccccgccacccaccaccccaccucaggcaaaugcccagccccugccucgccuccagccuccuuuccacaacccagcauccagucacuccagucucugcuucucgcccagguccccccagcccauuccucugcuauagggccagguggucucgagggccacagucgcgcucacacauccucucccaccaggcaugcccacgugccggugccccacgggcuucacgggccccaaaugcacccagcaggugugugcgggcuacugugccaacaacagcaccugcacugucaaccagggcaaccagccccagugccgaugccuacccggcuuccugggcgaccgcugccaguaccgugagugagccaucccugggccccagggcaugcgggagggugacgggggaccccagagcauggggugauguucaaccugugccugggacccacaggggcaaguucaggaaagaaggccuuaugcagcugagccaggcccaagcugcuggcgcuuccccacaaaggugcuggcacacuuccccugaggcagugcacccccugcaccaagauuaugcaaacagaaaagcucuguucaaccuauggagagcccucaugaggguggggcuugaggcacuucucucccuccccaaccacagggcagugcucuggcuacugugagaacuuuggcacaugccagauggcugcugauggcucccgacaaugccgcugcacugccuacuuugagggaucgaggugugaggugaacaagugcagccgcugucucgaaggggccuguguggucaacaagcagaguggggaugucaccugcaagugaguggggcccuccuccacaguuccacccagcugggccccugcccuguccuagcccugcccugccccucccuuccucagcaucccaggcacgccucugccagccccagccccagccucugauuccuuccugcagcugcacggauggccggguggcccccagcugucugaccugcgucggccacugcagcaauggcggcuccuguaccaugaacagcaaaaugaugccugagugccagugaguugggcccgggcuucacccaggcauagaucaucgcucccuuccccagauuugagcaggaggaccgucaggccucagugcccaccccccgcccuguuuuccuggcagcaguggcuauggagguuauaccuacucagccgugucccuccuuucugcaggugcccaccccacaugacagggccccggugugaggagcacgucuucagccagcagcagccaggacguagguggcagggguuggggcaggcagggccaccgggaccuagagcagggggaccgugugccuccugcuucccugagccuuggugacucagugucccaccucuucccuccagauauagccuccauccuaaucccucugcuguugcugcugcugcugguucugguggccggagugguauucugguauaagcggcgaguccaagggugagucacagggauucuggaacauucuggucauuauuuugccauccuagccuucccccccaauaaucucugucuccuuauacuccugccuuuccccagggcuaagggcuuccagcaccaacggaugaccaacggggccaugaacguggagauuggaaaccccaccuacaagauguacgaaggcggagagccugaugaugugggaggccuacuggacgcugacuuugcccuggacccugacaaggugggcugggaggcgggcagggucgagugccaagaggccguggguggccuaaccaaagguguuggguuaggugagggacggaggugggggugggguaaccugggcuacaggcccagcuccugagcccuaccugaacccucugucacccugcagcccaccaacuucaccaaccccguguaugccacacucuacauggggggccauggcagucgccacucccuggccagcacggacgagaagcgagaacuccugggccggggcccugaggacgagauaggggaccccuuggcauagggcccugccccgucggacugcccccagaaagccuccugcccccugccagugaaguccuucagugagccccuccccagccagcccuucccuggccccgccggauguauaaauguaaaaaugaaggaauuacauuuuauaugugagcgagcaagccggcaagcgagcacaguauuauuucuccauccccucccugccugcuccuuggcacccccaugcugccuucagggagacaggcagggagggcuuggggcugcaccuccuacccucccaccagaacgcaccccacugggagagcugguggugcagccuuccccucccuguauaagacacuuugccaaggcucuccccucucgccccaucccugcuugcccgcucccacagcuuccugagggcuaauucugggaagggagaguucuuugcugccccugucuggaagacguggcucugggugagguaggcgggaaaggauggaguguuuuaguucuugggggaggccaccccaaaccccagccccaacuccaggggcaccuaugagauggccaugcucaaccccccucccagacaggcccucccugucuccagggcccccaccgagguucccagggcuggagacuuccucugguaaacauuccuccagccuccccuccccuggggacgccaaggaggugggccacacccaggaagggaaagcgggcagccccguuuuggggacgugaacguuuuaauaauuuuugcugaauuccuuuacaacuaaauaacacagauauuguuauaaauaaaauuguaaaaaaaaaaaaaaaaaaaaaggccaaaaaaaaaaaaaagaaagaaaaaaagc

SEQ ID NO: 16445 - RNA, 1298 nt, Homo sapiens
cuuuaggagagagaaaaauaauguggugcaggggguuggauaacaaaggauuuuugcuugcaacuaauagucuccagcugcaaaaauaccaaaggggaggccaggcaggccgaggacuccaguucuugccaacuccucaccggccugcugaguggggcccugccuggccuuuggggagguggaagggagaccggccaaggguaaauaucugagagcagggaugaucucucugccuuccuucccggaauugggagggaauccaggccacauccugaggcugggggggcugauuguggagcugcaccugggauagcggcaucagaucucugcagguuucuuccuucucucucuugccaagagaaggguggauagggggagcaggggcaggguauugccagcccuagggcugggcagugacucagggaagccucaggaagucggagagaaggccggccguagcugcgccagcuggugcugggaaaacagcuuucacugaugaaguucauacacaugccagcagcccccagaccccugccgugcccaccaaguaaagggcacgcagcccuguuugacuuccagccacccugcuggcugccaggggaugcaggcaggucccugcuuugagacuucgauuuccuuuggaggcagcccagcagcauucauuugaaucuguuuucucugugguuacagcguguggggcaaagaauuugguugccuuaccccugcacuaggcccucuuccuacagggccuuggccuccucaagcuacucuucccccucucuccaaucuugugaggaugggacaguacugggggcccagaggaaagaguggcugggcuuggggaugcaugaauacuuacggggguaauaccucgucucuguggccuuguucuccaggcauugggaugggauuuagcagagaggaccugaagaagaaacuaguuugaugaagcccucaguuggcuccuucccuuccuguccugugacucugagucagugucagggcccagccaaguuccuugagagcggcguuccuguucuuuuugcccccaccccacccucacccacuguuagggagcagccccugaaucccuguggggaggagggggaauuagggaggggucaagcagaacagcaagucauuauaccuguagcugugugggggcagaagaaucccuacuggguugaguauggguaauggaggaugaguuucagcccaaagcagguagcccaaagauuucuuuacuuguuggggaaacuguuggagauggaguuccaggcaggggucccagaaaguca

SEQ ID NO: 16446 - RNA, 2818 nt, Homo sapiens
auuuuaaaguucacugaugcaccccuggcaccugacccauaguagggacucaauaaaucuucccugcguggaugagugauauguacacgaguguuucucuagaguggauuccaagacuggacuugcuggguguuaagguuugcacauuucaugcuguaauagauucugccgaacuguccuucaagguagcuguaaggauggacauguugaucaugucugaugaucacccacuucguugcccuugucacacuggaaaugaccacauucuugcccuuuccucggcagauuuugaugagugcucaguguacggcaccugcagccagcuaugcaccaacacagacggcuccuucauauguggcuguguugaaggauaccuccugcagccggauaaccgcuccugcaaggccaagaacggugggugggguugccucuggccacagugcuaacuaagcccccucaaugcuguucccuggugggugguggccugagaggugguccuagagcccuggcugcacggacucuucucuuccccauucccagagccaguagaccggcccccugugcuguugauagccaacucccagaacaucuuggccacguaccugaguggggcccaggugucuaccaucacaccuacgagcacgcggcagaccacagccauggacuucagcuaugccaacgagaccguaugcugggugcauguuggggacagugcugcucagacgcagcucaagugugcccgcaugccuggccuaaagggcuucguggaugagcacaccaucaacaucucccucagucugcaccgugagucaccugcucucagcuuggagggcuggggaggguaggggagacagggaagguggacccuaucuugaacagaggccgggaguuacacaggaugguccugucuggggcaggagaagcaggaggcuggauacaaugguguguguuugaggcaggggcagagccaccggcacgcucccucccagcucucugagcaagugucuggauggccccugcauuucuggccaagggcugagggggcagugaauggucaaucuccagagaccagggacugucccuucucugagaggggaguguugacuagacugcagagggacuuuccggugcagugggagccaaggcuagggaaagaaggagcggaagccugaggugcccuguuaggcugcagcugaggguaaaggagcuggggcccagcugcucugucuccaugggccaucguuucccucggggaccauugccaauggacucucugcugccaucgggggagggcaguacugagguuauuucucuguggcuuuguggcagugaaugaggcugggagaggagcgugagccacaugagauuuuagaauauccuggaugcuuccauucaggcuucucccuaggcuacacuuuugcuauccuaguuguggaagaaggggugucacagaaaggggcacgagcauagcuggguguagacccacugccgggaacagcccugcccaucucagaggcuguuacaccagcaaccuuaaaagucaacaucuggcagcaucacauuuccaaagaaaugcaccacagggcugagaggaagaaucuggccugugguugaucugacccccuaagggagauuaacuugaucuguaacuguuuaguaaaccagaauucccaucucugccuugguuuccuaaucugcauaauggguuugagcuugucugucuagaucagauuaacuggagugaaagccagugguaaaggacagcacacuuugaaguugaggauugugaaccuugggccucucuagaagaucuucaaguuucuuuauuugguucuugugaugaaaagaaagaucccaggagguuacaagggauucauucugggagagagaaaggccccuccccgggaugguggcgagcagggguuccucugagagcccucacucuccguggccucagcguaagguucacauuucugccuuuggcuccuccagagcaucccugauagcguccuugggcugcugcuguccacagcucaccugugaucagacauguguccuccuuggggugcugagcugggggcugucaagccugguuggcugagcucuuaacgagugggcgacucagggaaccccauggcugauggggugggauuggugcuagacccucuugugcagcugcccucccccuguuccuuguccacugaccuacucaacaggccugucugggcagacagcuugucaguuuccuccccagcccugcaucuugccauacagugggcuucuggguagguggcuaugggguguccuggagguaaccuucucaacuucuacucuggccucaucuccuuaucugacuuccuccccaggagaagcugguaccccucccuuggcaaacagauuugccuugccucccagucugcuaaacucacugggccucucaggggcagaguccaggaggcuagaagaguccaaggggaaaugcuugugggguaaaugaguggguuucucucaucccagcuucugucccuuccucccugcccucccccugcuccacgucccugccgccugaaugucuggcugucacccugaggaugguuguuuugcucucucccacaaacuaauuaugggucccaaacugaggacgucagugucucuccccuagccccucccccaguuucugggucaucccccuccccaggagaugcugacuggccugcccugguguguaggguggcuggucccaggcacucaccugcacaguggcugcuggccuguaauuagcuccccaaggaggacgaagaagaaaggcugcagcuuu

SEQ ID NO: 16447 - RNA, 16805 nt, Homo sapiens
cgucagagcuccagggagggaccuggguagaaggagaagccggaaacagcgggcuggggcagccacugcuuacacugaagagggaggacgggagaggaguguguguguguguguguguguguguguguauguaugugugugcuuuaucuuauuuuucuuuuuggugguggugguggaaggggggaggugcuagcagggccagccuugaacucgcuggacagagcuacagaccuauggggccuggaagugcccgcugagaaagggagaagacagcagagggguugccgaggugagggguugccuccgaggugggugcgggggccucuaugagugcauggggguggauucguggggggagcucucgggauccuccccuggcuggguggaugguccccaagagaugguuucagcuaguguugguggcugguggcacuggguuuuagcaguuucgaacuccuggaggaaucugggaggguccaggccucaguacuccccucccccaugggucacguuuucacagccucaccccugcacccccagggccauggaaagucagggaaaggaggugaaggagugccccucugcccugagucgggggaaguggccgccccucccuggaagguugaugccagagggcaguggauccuuguuaaaccccuauccugcccuccacuaaagguuccuguucaaggguguggcuggggcgugagcaagccccagauguagaccucaugguggcccagacgagggggaauuucccccucaaaacugcuccacgcuuggcugcuguagacgcugagauuucccagcggcggcgccgaguuaacccuccucgugcugaacuggcuccaccuccccgccugcccccaccgccacauucacgcauugggcaacucagagaagcuguuuuaacuuucgauccuguggucccacaaucagaggacucgggcagauagggguugagauaagcgaguuuaggccaccaagcgggcggacgaggaucccagaccuugcgcuucccuucugaguuugggagguaacacuggccccgccccucacgccguggcuccucccucccuuccccuucaaggggcugaagacaaaaggugccccuguccuggucaagccaaucgacccagccuuguuauggguugggguggggagaaauguguccuccugauggcuggggaagaagagggguuggauauuucuagccagggccaugccaggaggcuggucacucugcaaggggaugcagaggaaagcggugcccacucacuccagaggaccuuucucucuugggcuagagaaaggccuauuggaggaaccugagcaggagggguaaggauucugccuugaggagaaaagagcugggguaagugggcacuggaggaaagaggggcaugaaggucuuggagcagaaacguccagagaagggaccucuccauuuuccaucccucugagaggccugggagaggugagaggcugaacgugcaacaggaggacuugggguuacuggguuuggggagaccuggggaguugucaucccauccucucccucaucucugggagagggauauuaugagaaacgugaacugagaggccccugggaaaccacugguuacccaguccucccugaaccuggaaauggggaugcaacccccucuucuacuucccuguccccuccucuccuuucuaccuguuuucgucucucaucuuugccuucuagcccuccagcuuccucucucuucuaggcucuuuccuccuagcuuacuaaacccgccuuuuuuccagucucuuccauccucuuccuuaguucucucuacuuuccuuuuccaccucuccuccuucaagucuccucccaccuucccccacuucuuaggaugaucagauuugccccuggaagggauccuaacaacacagugcgaugguuaauccccacucagauucaaagccugcuuuccaaacucacuuacugaguggccuugggcagaguagagaaacuccuuaagccucaguuucuucaucuauaaaaugggauauuauauauuuuaaaaagugucgugaggccugaaggagauaauacacugaguguaaugccucauacacaguaagugcuuaacaaauaguagcuguuauuacucucccauccucuucaucaucuagccuugugguuuucauuuuuauuuuauuucauuuauuuauuuauuuauuuugaggcagagucucucucugucgcccaggcuggagugcaguggcucgaucucugcucacugcaagcuccgccccccagguucacgccauucugucaccucagccuccccaguagcugggacuacaggcgcucgccaccacgcccugcuaauuuuguuuuuguauuuuuaguagagaugggguuucacuguguuagccaggauggucuugaucuccugaccucgugaucugcccgccucggccucccaaagcgcugggauuacaggcaugagccacugcgccuggccgagccuugugguuuucaaauuaucucauggaguccuagaauuuugagagguuugucuagggaugccuuuggcgucaggagguggggagagggaaguagaagcagucgaguuucaggcuuuccaugcuugcuuucaacagggcaucuucgguuucguaccuuuuauguaauugagauuccacagauuaaaagcugacauugccuaccgcuuuaaaaaguuuggaaaguuuuccacucaucuaacacucauauuuuauagaugagaagaucgaagcccacaaagggaaggcucuuugcccacagaaccagagccaggucuagagcugcaacuaaauccucugccacucuaagagagcucucgcucuacugcccugucucccuuugccuccccaucccucuggcuacagcucagcucuucccaccccugugucuaucacugaaggaguuacccccaucucaggcauugacucaggaugccccugguuuaagguggucuggccaugaguggugguggggacggucccuaggagggcuaucuaugggaggucccuggcugccccaggagauaggccaaguuucuugggcaccccucagaguggccuuauuuuucuccuccaggcaaccuccaagucccagaucaugucucuguggggucuggucuccaagaugcccccagaaaaagugcagcggcucuaugucgacuuuccccaacaccugcggcaucuucugggugacuggcuggagagccagcccuggugaguccuggcugcucccugcuggucccccaagucuucccuaacucaucuuccuucuccuuagauuuuucuccccucacccauggauucagaacuugagaccuguuauuccauguguagugaccuagauuuagcagggagucugugccccaucaagaccaggcuaugaauguugacagauggagaccccaucucuuaggaggcugagccgaagaggagggggguuugggcugggacaaaggcacuucucauaacagcuagaagacugggaaacaaggcgcaugggugaaagcuacagagggccuagauggagaauaaggagcgagaaaggaacugcugagcuuuuggcugugggguaaagggucaggagagcugaggaagcccuggccugagguagccucauccugaucuuccugcagggaguuccuggucggcuccgacgccuucugcugcaacuuggcuagugcccuacuuucagacacuguccagcaccuucaggccucggugggagagcagggggaggggagcaccaucuugcaacacaucagcacccuugagguggggcaggaggggaggggacaaggcuggguggggcugagguugaacuggguugagcauugggcccuggaagaaaauugguuggaugcuggaagcaaauugguguuccugugguuaacugcuagcuagcaggcaaauuagauuuuaaaagcaugcaaaugcacaaaaacuucuggagucuacaguugugcuuccuuauaguauaugugugaaugcaggccuggggauuggagggauugaaggacauggguaagagcaaagcucacuguuuaccacccucauuucuguagagcauauaucagagggacccccugaagcugguggccacuuucagacaaauacuucaaggagagaaaaaagcuguuauggaacagguauugugauauuccaccucccaccccaacucaauccccugagacuuuggccugagccaugacaaacuagaaagaauuugaaccucaguaaaggcucaguguucuaggcccaggaaugaccaaaggagguuccuagggucagagugaaccccaagucaagcucagggaaucuuucuaugagggacugaagguaagaggccggggagaacagagcaagggauaaggagcugauucugcuaggagcaaggucuuaucuccacgauauuccaaaaggucaggaagaacugccaaaggggagaggggaacaagaaaacgcuaucugcagagcagagaguggaggccagguauagagggaugagcagaguguuucacuucuuggcaucuguccuuccuguguaguuccgccacuugccaaugccuuuccacuggaagcaggaagaacucaaguuuaagacaggcuugcggaggcugcagcaccgaguaggggagauccaccuucuccgagaagcccugcagaagggggcugaggcuggccaaggugggggccagggugguucuggggaguguguaggagugguugccucuuggaucucaaccuuaucugaaccucuaaucugucugcacccuugauuucugcccccaacccucagugucucugcacagcuugauagaaacuccugcuaaugggacugggccaagugaggugaguaaugggcugacagguggagaccuuggucaaagugcagcuggagggauggaagcuagaccucagaaagacacaggcugaaguagggcaagggaaugccagaggagugagaaaaagagccguaucccaggagcuggguguggaggcagcgugaggcccuggcucaggccccucucugcccauaggcccuggccaugcuacugcaggagaccacuggagagcuagaggcagccaaagcccuagugcugaagaggauccagauuuggaaacggcagcagcagcuggcagggaauggcgcaccguuugaggagagccuggccccacuccaggagagguugggcuagggcugauggggaagagggggcaagcugggggugggcagcugacccugcugaaggcccuacaggugagagaaagaagccaggcgggagggccuuggaguggaccaagaugcauaaaagccaguuccagcggggcugugcacacugucguucaggucgcauccuguacaagugggccuaguggaggggcacaagcggggacucauccaacccaggcuucucuccucaagccccaugccuagaggaauaggagggcuuuuccauuugguuuauugggugggaacacuuuccaauuugccacaaagcacuguaagugguggcaguuguccugggugcaagagccgucgggggagaggcagcuggguuuccacaggggguguaggcacugagaaugaaccucccacccagacccuaggccaacagaucacagaacccccuucagcccaggugccuugcagccacacccacuacccaccccacuucuccacacaugauagccuuucucccuggguauaggggaagggggucugggccggagcaagcagccuuaauccugugcccccugaccacuguccuggccccaggugugaaagccugguggacauuuauucccagcuacagcaggagguaggggcggcugguggggagcuugagcccaagacccgggcaucgcugacuggccggcuggaugaaguccugagaacccucgucaccagguauuccccgggagcucccagucuggccuagaacagaccucgggaagaaaagaagggggcuagagcuguggggagggcaccagcagggaccuagcccccaacuccccuuguguccuccucacucccaguugcuuccugguggagaagcagcccccccagguacugaagacucagaccaaguuccaggcuggaguucgauuccuguugggcuugagguuccugggggccccagccaagccuccgcuggucagggccgacauggugacagagaagcaggcgcgggagcugagugugccucaggguccuggggcuggagcguaagcugggauuggaccugggguuggagaagggcuguuagggugauggaggcagccuggagggcuggcacugaaaagagcaagggauggggagggagggccaugggauguggagacccugaauggucaaggcagaggaaagggagggacccauuuagggcuggaauggggugggggcaucaugauuuggccaagauggggacuccucccuuaagaacccaaacagagacauggagauuuagggcuggugacaguggguagucuacacucacccaugcacucgccacaccugacgacagugagaugagcucguucacacucugaccuccccuggcagagaaagcacuggagaaaucaucaacaacacugugcccuuggagaacagcauuccugggaacugcugcucugcccuguucaagaaccuggugaggggcuuuggggugcagugaggggggcaccacuaggagacugugggacucuccuuggagaggaugucaggaagcccaggaggagcggucucuguccucaugaccucgcccuugcucucccucaccccacccacagcuucucaagaagaucaagcggugugagcggaagggcacugagucugucacagaggagaagugcgcugugcucuucucugccagcuucacacuuggccccggcaaacuccccauccagcuccaggugaaccguggcccagcccugccccaaucugggaccccgaguccuccuccaaugccacacacaagggcccuggacccucaccucuugugacugccccauaccccaugugucugggauucaugcacacuggggcccgggugagugggggugagcaagagcauggagugcacagggcagggaaugguaguggauagcagcaaacacuucggaagcacuuccuauagaccagggcacucuauuaaaugauacauacgcacaugcgugccagcacacacacgucugguuuucacaauaacauuaugagguaggcaguauuaucagccucauuuuauagauaaggacauugagacagagaguuuaaguaguuugucccagucacacagcuaaguguuggagcugguauuugaaaccuggaggucugguuccauagcgaugacuaauaaccacuucucuacggugaggcccugauugagcuucagaacgcauuuaauaacauggcaugagcuuuuugauuaugaugugugaguccaauaacuucucugagugcucagagccaguccccugaggaaacuucuugcuucacuaagaaaccccuguccggcugggcaugguggcucaagccuguaaucccagcacuuugggaggccgagguggguagaucacaaggucaggaguucaagaccagccuggccaauauggugaaaccccgucuccacuaaaaauacaaaaauuagcugggcgugguggugcaggccuguagucccagcugcucgggaggcuaagcaggagaaucgcuugaacccaggaggcggagguugcagugagccaagauugcgccacugcccuucagccugggcgacagagcaagacuaugucucaaaaacaaaacaaaacaacucagcacuuugggaggccaagguaggaggaucgcuugagccugcaaguuuaagaccagccugggcuacauagggagauccaaucucuacaaaaaauaaaaaauuggccgggcaugguggcucacgccuguaaucccagcacuuugggaggccaaggcgggcggaucaugaggucaggaaaucgagaccauccuggcuaacacggugaaaccucguaucuacuaaaaauacaaaaaauuagccaggcaugguggcgggcgccugagucccagcuacucgggaggcugaagcaggagaauggcgugaaccugggagggagagcuugcagugagccaagaucgcgccacugcacuccagccugagugacagagcgagacucugucucaaaaauaaauaaauaaauaauuagcuggauuaggugguacauuucuguaguuccagcuauucaggaggcugagguggaaggaucacuugagcccugaaggcugaggcugcagugagcugagauugcacuacugcacuccagccugggcaacagagugagauacuaucuaaaaaaaaaaaaaaaaaaaaaaaaaaaaaaaaaaaaaaaaaaaaaaaaaggaaagaaagaaagaaaagaaaccccuguccucacccucuucaggcccugucucugccccugguggucaucguccauggcaaccaagacaacaaugccaaagccacuauccugugggacaaugccuucucugagauggugaggaaaguccuggaguuggagggaacaggggcaggguggguucuaacaugggcaguggugcaggccugcugaugggguggugggcauguuuaaaugggugugaccuuaacacuuucucaugggccugcuuucgugcuucugaccucuuuucaccccagucuuaacaacuaucaggccacagcacuguaaccuagaaaaaacagcauguuugugagcgauaucaggggcuguggagggguaggccacaggcaggugggagggaugaaggccggcccgaggaauaacaagacgguagccugcagugcucucuucuucccccuucuccccaggaccgcgugcccuuugugguggcugagcgggugcccugggagaagaugugugaaacucugaaccugaaguucauggcugagguggggaccaaccgggggcugcucccagagcacuuccucuuccuggcccagaagaucuucaaugacaacagccucaguauggaggccuuccagcaccguucuguguccuggucgcaguucaacaaggucauucuccugcccuuuggaccucccacccccaagcucuucaucccuggggcacucagggccugcucagccuccaugcagggaccuuccacuggauucuccacagugcccccucagguccuuuaggaaggccugucauggaccagggaggaaaaaccccaggccuggggguuggcucuggagaugcguucucugacaucccugagguuuuggucugggggccaucuguccuuccucuuuaccagugacuugcaugacucacccagguuguguguaaacagagcucugauucaaagugacuuugaccuguuggaaaaauaguuccuggccgggcacagcggcucaugccuguaaucccagucuuugacaugccgggguggguggaucaccugaggucaggaguuugagaccagccuggccaacauggugaaacuccaucucuacuaaaaauacaaaaauuagccaguugcgguggcacaugccuguaaucccagcuacaugggaggcugacgcaggagaauugcuugaacccaggagguggagguugcagugagcugagaucauaccacugcacucaagccugggugacagagcaagacucugucucaaaaaaaaaaaaaaaaaaaggccaggcauggugguucaugccuguaaucccagcacuuugggaggccgagacggauagaucaccugaggucaggaguucgagaccagccuggccaacauggcaaaaccccgucucuacuaaaaacaaaaaaauagccaggaguggucguuugcgucuguaaucccagcuacucggcugaggcaggaggugaacccaggagguagaggcugcagggaagaugaaaccauugcacuccagccugggcaagacucuguaucaaaaaaaaaaaaaaaaaaggcuaggugugguggcucacaccuguaaucccagcacuuugggaggcugaggcgggcggaucacaaggucaagagaucgagaccauccugaccaacauggugaaaccccgucucuacuaaaaauacaaaaauuaccugggcaugguggcgcaugccuguagucccaacuacucgggaggcugaggcaggagaaucacuugaaccugggaggcagagguugcagcgagccaagauugugccacugcacuccagccugccaacagaaugagauucugucuaaaaaaaaaaagaaagaaagaaagaaagaaaaagaauuccuguugcaaaaacugaacaaaaucccacagggacaugugcaguaauaccagcuaccacguguugacagcuuauaugccaggcgcugugcuuaacaccuuauguauguuaucucacuuaauccucccaacaucucuuugagguagauacuauuauuauccccauuuuacagaugaggaaucugaugcucagaggguuauguaguuuguucaaguucccaaagcaggugagugccauggcuaggagagaaccacauauuucugacucuugcucuuuuauuuuauguuauauuauguuauuuuauguuuugguuuuuuuuucuuuucuuucuuucuuucuuucuuucuuucuuucuuucuuucuuucuuucucuuucuuucuuucuuucuuucuuucuuucuuucuuucuuucuuucuuucuuucuuucuuucucuuucucuuucucucuuuuucuuucuuuugugugagacagaaucuuuaaagagaagaaagaaaugcucaugugaccagaggguguguuagcuaaagggagcaagacagucacacccagcagguuaccuuccuuugggcgucaccucugccacaccuccuuagggagaggguguagcauaguaguuaagaggggcuccagggccagaaugccuggguuuaaauccuagcucugccucuuaccagcuauguagaccugggcaagucauucgacguuuuuggacuuccauuucuucaucuguaagauggaauuauuauaaucccuacuuccauagccugguaaagagcaaauaaauauauggaaaggcuugaaauaguggcuggcacguguaagcauuaggauuggucguugucauugauggagucucagguucggucugauccucagcccugugauucugucgugagggcacucacagcucacugccugcccuaaacaggcuccagcucuggcccucccucggcucacaccuuucccccucucccccuaggagauccugcugggccguggcuucaccuuuuggcagugguuugaugguguccuggaccucaccaaacgcugucuccggagcuacuggucugaccggugaguccccacccuggguagucugagcagccauacaccagucaccuccauacucacugcccaugccccauccucuccuucaucccggccaggcugaucauuggcuucaucagcaaacaguacguuacuagccuucuucucaaugagcccgacggaaccuuucuccuccgcuucagcgacucagagauugggggcaucaccauugcccaugucauccggggccaggauggugaggccaccccagccaguccucugucucugugccugugcccucugggguuucuucugggaaugaaauguccugaccuuccugaugccgauccugaucuucaggaaguucuuccagcuucucuucuuccuucuguggucuaaauguucaccuucucacugugagcucugugggaacggagacuagugggucucucucccucaggagccccacccuagguccucucucccuugccuugguggagugagaacaggucuuaugguagggguuggggaaggggaagaaaguccggacagagggaucucagggucuccuuccuaccauaggcucuccacagauagagaacauccagccauucucugccaaagaccuguccauucgcucacugggggaccgaauccgggaucuugcucagcucaaaaaucucuaucccaagaagcccaaggaugaggcuuuccggagccacuacaagcgugagcuggaacuggcagcucugauuccuuccugucacccacuuccucccugcuccccgcugcccuccucucccugcccgcgugucauccugaugucacucccuauuucauagcugugcuucucuuacuuccccaugauccaugcccaccuuuuccaccucccuuccucccuaaccccagagcacuccauggcugucuuuuccuucucacaacagcugaacagauggguaaggauggcagggguuaugucccagcuaccaucaagaugaccguggaaaggugaguguggugguauggacaguggguaggucaggggcuuagugcuuaucugcaggaaggagggguggcaucaacccuuggucagucacauguaccuccuucccuccuccagggaccaaccacuuccuaccccagagcuccagaugccuaccauggugccuucuuaugaccuuggaauggccccugauuccuccaugagcaugcagcuuggcccagauaugguguaaggagcuggaaagacaggaaugggaguggucugugcagaugggcuaaucuuagcaugggcagcugggagagcuggcacugggggcugaacagggaaucuuccuuuccaugagagggacaccuguucaaaagcaggguguggugguguccaggagaagggcuggcaucagggggucuguuuucuuuccccaggccccagguguacccaccacacucucacuccauccccccguaucaaggccucuccccagaagaaucagucaacguguugucagccuuccaggaguaagugaaaaaccucauggggauaccaucccacucuaagggggugggcauuugaauuguuagaagaggcucuucugugagaaaggagcagcaaaugcuaacagccugucuucuucucuucuguccacucuaaugaggggguaguaguuaagaucuggacugccuagguuugaauucuagcuccaccacuuacugguuuggggcaaauuacuuagccuuuggugccuuaucugcacaaugggggauaauaaugcuaauaauaauaaccuaccucacugcauuauuguggagauuaaaugaguucauaacacuuaaaaagcugagcauagugcauggcucauagcaaaagcuguguaaguccagucguggaucacuuaaugaaggagcauuuucugucuuuggcaguuucauaauuaugcgaauaccauugaguauaauuacacaaaccuagaugguauagacuacuauacacugaggcuauauuguguagccuauugauccuagcuuuaaacccgagcagcaugauacuguucugaauaguauaaggaaauaguaacauaaugguaaauauuugugugauaggaauuuucagcuugauuauaauuuuuuuuuuuugagacagggucucacucacuggagugcaguggugcgaucuuagcucccugcaaccuccgccucuugggcucgagcaauccuccugcuguagugcaccacgacacucggcuaauucuuuuuuaagauuuuucugcagacaaggucucacuuacugcccaagcuggucucaaacuccugggcuuaagugauccucccaccucggccucccaaagcguuaggauuacaggcgugagucacucugccuggccuugauuauaaucuuaugggaccacuguggucuguaguugacagaaaugucguuaauguggugcaugacuguuauuauuauuuucuguccugccccugagagccacugucacuucucugcuguauugguuuuuguuuacucaucuguuuuggccuugaaauggccuagacauuuuucuucccgaaguaugacacucgggugcuuauuaacuuagucaagacacaacaucucccuucccagaaggugaggcgggagugaggacuuggggacuuaagaacuaccaaaguucagaguccaaagaaacauuagaaauuggcuaauccacccccauaacacgcacauuuuacagaugagaagacugagcucagagcauagaaauagcuugcccaggccaugacuaagucaggauaaggagcuggagcuuguuuccucacucagugguccugacuuugcaccacucugcauuugccuagccugccuuccucuaacugugcucucccuacuuccaggccucaccugcagaugccccccagccugggccagaugagccugcccuuugaccagccucacccccagugagugacaaagccccuccugaccccaugugccucuucuuuccuggccuugccccgcucuccuuauuuccauugcugguuccuggcaggggccugcugccgugccagccucaggagcaugcuguguccagcccugacccccugcucugcucagaugugaccaugguggaagacagcugccugagccagccagugacagcguuuccucagggcacuuggugaguggcagcuugggaguggaggcuggguggcaucuaggggagugggcgccaugccuacuccacugcuucucccaucuccuugcaggauuggugaagacauauucccuccucugcugccucccacugaacaggaccucacuaagcuucuccuggaggggcaaggggagucggggggaggguccuugggggcacagccccuccugcagcccucccacuaugggcaaucugggaucucaaugucccacauggaccuaagggccaaccccaguuggugaucccagcuggagggagaacccaaagagacagcucuucuacuacccccacagaccugcucuggacacuugcucaugcccugccaagcagcagauggggagggugcccuccuauccccaccuacuccugggucaggaggaaaagacuaacaggagaaugcacaguggguggagccaauccacuccuuccuuucuaucauuccccugcccaccuccuuccagcacugacuggaagggaaguucaggcucugagacacaccccaacaugccugcaccugcagcgcgcacacgcacgcacacacacauacagagcucucugagggugauggggcugagcaggaggggggcuggguaagagcacagguuagggcauggaaggcuucuccgcccauucugacccagggccuaggacggauaggcaggaacauacagacacauuuacacuagaggccagggauagaggauauugggucucagcccuaggggaaugggaagcagcucaagggacccugggugggagcauaggaggggucuggacaugugguuacuaguacagguuuugcccugauuaaaaaaucucccaaagccccaaauuccuguuagccagguggaggcuucugauacguguaugagacuaugcaaaaguacaagggcugagauucuucguguauagcugugugaacguguauguaccuaggauauguuaaauguauagcuggcaccuuaguugcaugaccacauagaacaugugucuaucugcuuuugccuacgugacaacacaaauuugggagggugagacacugcacagaagacagcagcaagugugcuggccucucugacauaugcuaacccccaaauacucugaauuuggagucugacugugcccaaguggguccaaguggcugugacaucuacguauggcuccacaccuccaaugcugccugggagccagggugagagucuggguccaggccuggccauguggcccuccaguguaugagagggcccugccugcugcaucuuuucuguugccccauccaccgccagcuucccuucacuccccuaucccauucucccucucaaggcaggggucauagauccuaagccauaaaauaaauuuuauuccaaaauaacaaaauaaauaaucuacuguacacaaucugaaaagaaagacgcucuaacugcucagauaggugcugcgguccagcccccagcuggaggagacccugaguccaacccaggccucccgagggggccagugaagggaucccacacccaccgccccuauguagggcagggaagaaauugcaaaggacuugggggauagaugggaaugggagggcaaacugcagcacuuguuaaauuaauuaaagaaacaaaccagaagcacaaaaacggggaaggagaggggagaaggagcagguccaguguucccaggcccccaauucugggggcaaauguugccacuuuuagcuggaccuucccagggaagucccccuuucccccuuguccaaacugaguccaacugcucacaccacuggugcaaaccuaaagagaaugggaguguguugugugagggaggggaaaaccccagaugcccuggaggcagaguccuugcccccucgcucugggcaggggugagggcaccacgcacccuccuuguguccucucuccaggccucugcuuguuauugcuugaagccccacagucuuaugcccauggagcagguggggaggcaggagaagggcagaggaaggauccaggguugugacuagauuccggggauggagagcgugggggucugugugagccagaagucugagguccugggucugaagacaccaguccaacccucacugccggcuggccucagccuccacuuucacgcugcuccugcgacccuccaccagcgcgggaugggguccuggggcaggacaucuguccagcagcccuuccucgaac

SEQ ID NO: 16448 - RNA, 8474 nt, Homo sapiens
acucucacacacggguucgcacccggacccccgcuggcuccccuaggggagugggcaggccccuucugcggaauuucucuucccucgucccucucuggccgagcacccccucucccaggacccgggagcggagagcucaaaaucggcuccucccucccccucuuucccggaucaggaccgggacccgggcgccccgcgcccaguagguugccgcucacuugcucacgcccuacuccgccuccuccuugggcgggcgucucccuccagauccuaaggcucagcgccgccccaagggggccggggugggagggaggggggcgccucgagcagaggcugcgugggcggaggaugugcgucacggggagcgugggcugggggagggagggggcacguggaaacccggggccagcggcuggcagcccgggauccaaaauaaccugagguggggggggaggggucgcccacaccccguacggggucgggagcguccccaggggagcccgucuagccgcacccuccaguugcggggcgggggacugggagacgggacucugcucguucccaccacccccacuguguuuggcgcuuaauagguuggagaagaggaccugagcaacugaaauccucccaccaacaacgcgcuccuucuccccggaccccacaaggcggaaaggucuccucgcuaggccacauuguaaaaccagccccgguccacggccuccacgccccgccaugccccaccccagccccucagaagugcggacagagaggcggggcggggcugagauuccggacuaggggaaaccucaccuguggccaguccgcucgcuuuccccggcccccacccccccuccuuucccuggggcuuagagucuaugggccgggcccuuagagcccccgccucccccaacagcccucccagccgugggcgggagugcaaugcgaaccagauggggcuaggagaaaccaaagggggagacggugguggguugcagaggcgggggcuaagcuccuucaaggcgcuccuccuuccagcuccgccgcaggaagucacgucguaggcucccgaccucuuacucaucuuccacuagacucucgggcgaggucccuaauagacggccccaggaaggguaucgucuuugucacacaaaauucccaggcagggccucauccucagcaaacagaggacaaguggaggaaucccugccugaccuacgcgcugacaaaagccgacgcgucuaaucaacacgcgcaccuaagugguggcgugcagcauaacccucccauuccuguuucccaaacuuuccaggcuagcauggaggccuggguuucugagagcgacccccucagauuauuccauuggggcugaggaggggcgcggggauaucuaggagaucccugcagagccccacgcucucaggcccgccuuaagugcacacuauacgggagucagaugcacgcacaggagaagccgcacagcccagccuucgcuaacuuuucccggcucacugcuaacauucacacguccagcaccacaaggccugaguaugggcaacgggcguccccguaguuguuuaggcgcgugugcacguccgugcgcuucugugucuuuguguacuugugcgugguugugaaacuccucucucagcucggaggggugggggagagaaggaaugucgccggcggggcgcucacguggguacgugggcgccaagagggccggcugugcauccggcgugggcggcacagaacgaccucgccccgcccgcuggguccccaagcccgcccugcacagccgggccucggucaccucgguccccaauucggcgccccggcucugaauccccgcccccgccuccugcuccacacccccuccccccccgucuccgccucucccagucucuaagccgcggcgucuccgcggccgagaggccccagcgcccgccuccccggcccccgcccccacccccgcccccggcucugcccacgcccuccgcccgccagcccggcagccagcgcagcuccgggccucgcucccugugcguccugcgggggcggaggcgcggagaggcggcaagcgcagccggggagggugggggggcagaggcacagacagaggcgcggaggcucggagagagaagacguggagggagggacagagccuggacagcgguggacacggcaucgugcgcggggaagagggcagcacgcagcaggcgccgagcgccgggcaccgagaagggcagcccgggugaucuccggccguccaugcacagagcgccuucccccacagccgagcagccgccgggcggaggggacagcgcccgccggacccugcagcccagacucaaguuagugggcaaagggaggcagcggggaguggagauggguggagcuggacuugggaaugggguccagagggcggaggucgaggggaggacguggggaagcaggacgggggugggggguggagacugauggaaaagggggugcgucuucgaauuagggggcccugggagcaggcaagcaucugaugaagcuggauaugaaagaguaguacccaaaucuccauuccugguuuacucugugggcuccaucuggccuaagagcccccugcaaagaaugugggagccuccaagcaccaggggaugcccuggagcucgagcuggcaucagugcggaagguggggggacgcucaguugccucagucccucguuggcacggagcgcgcgggcccccggugccuuugaguuaaaggagcaucagcgggggaaagggggggugacgagggaggcagggaggccuuaggcguuccuucccauaucugucccuuuauucacagagcggggaggggaguuucagugugcagccccuucaucaagaggccuugagccgcucccccacuccacuugaagaugcggguggaaaauaugggagaggagaguaggcgggagccccugggcgguuuucgccuacagacgcuaccacugugggagugugugugggcggaacggccccggagcagaacaauugcgccccucccccugccacggccccugagcugaaggaaaaggcugaccgaggaaguggggagugucacugcuaggagaggggccacugaggagcacugggcagccuggaaggguggagagguucugaggggagagaggaagcgugcguuaagaaugcuuaaccaggccgggcgggcccgguggcucaggccuguaaucccagcacuuugggaggcugaggcggguggaucacgaggucaggaauucgagcccagccugaccaacauggugaaaccccguuucuacuaaaaauacaaaaauuagccgggcaugguggcgggcgccuguaaucucagcuacucaggaggcugaggcaggagaaucgcuugaacccgggaggcggagguugcagugacagcgccacugcacuccagccugggugacagagcgagacuccgucucaaauaaauaaauaaauaaauaaauaaauaaaugcuuaaccccugggaaaagcugagcggagaagaguaaggcaccaccuggcucacugagugggaaagccagggaaggugccacacccucccuuuuagccaccuggggcuguggccccuucacagggaaugaagcuggccagcagcguccacugugggggagacugggcuccuacauucacuuuaguaugggugacuucacuucaguguugagacugcugaguguuuagaggggaaggugaggauuguguuuugggggagagggagguccagccaucccaggucggugcuggucagccucagcgcucaaguucuucuugccccagaccaaaaagauaaaagcugaagauaagguuguaagacgcuucgacuccuacagacacaggccacugacuuuuggggcuucgggccagucuaggacggcacuggcuuguccaugccucugagcagugccugauucugagagucuguacucagaccugggcacugggcaggauagcauccaaaugagggaggggaagaaaagcaggcaggaaagagggaacaauuguuaguguggguugguacccaguagggggacuugcaccgacugccucucucuugugccccuccuucucaggcccagugcccgagccauggcacugccucggacgcugggggagcugcagcuguaccggguccugcagcgcgccaaccuccuuuccuacuaugagaccuucauccagcagggaggggacgacgugcagcagcugugugaggcgggugaggaggaguuucuggagaucauggcacuugugggcauggccaccaagccccuccauguccggcgccugcagaaggcacugagagagugggccaccaauccagggcucuucagucaaccagugccugcuguucccgucuccagcaucccgcucuucaagaucucugagacugcggguacccggaaagggagcaugagcaaugggcauggcagcccaggggaaaaggcaggcagugcccgcaguuuuagccccaagagcccccuugaacuuggagagaagcuaucaccacugccugggggaccuggggcaggggacccccggaucuggccaggccggagcacuccagagucggacguuggggcaggaggagaagaggaggcuggcucgccccccuucucccccccugcagggggaggagucccugaggggacuggggcuggggggcuggcagcaggugggacugggggugguccagaccgacuggagccagagaugguacgcauggugguggaaaguguggagaggaucuuccggagcuucccaaggggggaugcuggggaggucacaucccugcuaaagcugaauaagaagcuggcacggagcguugggcacaucuuugagauggaugauaaugacagccagaaggaagaggagauccgcaaauacagcaucaucuauggccguuucgacucuaagcggcgggagggcaagcagcucagccugcacgaggugagaacccccaggccuccuaggauugcccuugacuuccaggucuccagccgcuuaccucugcgaguuucuacagucuccgacuaucuuucauuaucucuugaccaggaccccaggcccugauccccuccccaacaggccccuaccccagcggccgcagugcuuccauccucagcugagggggaagcagagauacaggcagcaccgagcuguucagcuccuugucacucaggaccccacaggagaggaggaggccccgggcauuccuaggaagcugugggugcugaccucugucuucccaccucagaaagcucccauguagugucaaaaccaaagcaagcgucugauggaugggccucauuuguccaauggugaaggggugugaggaggucuggugaggcagcggggaaguucgaauucugacucuccuggcugcccucccuccacagcucaccaucaacgaggcugcugcccaguucugcaugagggacaacacgcucuuauuacggagaguggagcucuucucuuugucccgccaaguagcccgagagagcaccuacuuguccuccuugaagggcuccaggugagaccccuuccccagguccuuccuggacuggaauccugcuauggaguuagaucauguccuaaccuucagcucaggcagcucuaggccugcuucccgcccaccuggauguccugcuuuuggccaagucagcuugucucaggucuggucucuccucccauccaugucggguccccccaacccccuacaacaauagugcuugaacuagagacucuuucucggccagcuucuuggcaaagguuuuaaauaacacaugccucuggcuggguucugugcucugccagucgaguggcccucgucagccucauccacuuuauucuuacccaucuuuucaggcuucacccugaagaacugggaggcccuccacugaagaagcugaaacaagagguauguuuuccggggugcauauaggggcacugggcagccuuccccaauccccucccuuggcaggucuucauuuccccauguugggcauccacagguuggagaacagagucacccugaaauccagcagccucccccaggcccugaguccuauguacccccauaccgccccagccuggaggaggacagcgccagccugucuggggagagucuggauggacauuugcagggugagugugccucagaacacuuuucucuucauugagggugggggaguaggggaggggguugggggaggagugagccaggaggcagugccugaaacaggguugggagaccuggcuggagggggggcagaagggccugugggcuggcuaugugguugaggguggggguuccauuggcugcagccccuuaccugaccagugcccaugcccacagcuguggggucauguccaaggcugacgccgcccccugcugaccugccucuggcauugccagcccaugggcuauggagccgacacauccugcagcagacacugauggacgaggggcugcggcucgcccgccucgucucccacgaccgcgugggccgccucagccccugugugccugcgaagccaccucucgcaggugaggcagccagcagugcuguccccaagcaccccggccacucaggccccacacagcaauucugguguccuggggccaggugggaggaagagggauauagucgucagagagggcaguaggauggcugggcuccagccagccaggccuuggggugcagagaggcagacccugccgagcugcucccaccauggaaagucugguccuaguguagaucugugaaaggggaacuggggaauggggggacagagaaaagaggaugaaggagcaggaaggaggagcaucaauaagggaagcucagauggcacuuccaccaacccaggaguggggagcaggcuaggaguuguggguauggggauggggaugcccagcuuggaagcagaggagcccaaagcagugaugcuuuguguguggaagggggaagagggagugggcaggcggagggccgggcagccgcugggcugagagugacgcagcagacaaagccaccaacccuggcuugguauuuuuaaacugugcgugggugggaagugggggcggggacuggaaggggggcucuucuugagggaggagcucggaggcuggcuuccuguucucccucugauuuggcuaccaaaaaacuuggggggccaugguagaguggccugggaggggccugggagggggccagggaugaguggggguggcagagcuugggaaggggggaggggagaggucagagccaaaccacccccgcagcuccugacagaaccagaaauuccagcgcaaccgaggaggcgggagagaaagagagagagacagacagagacagagcuacgcacagccagggaggggagggggcucacacacaugggaauggaaccccccauacacaugcagugggcaggaggcaguaauucaauaaaccuaaacugagcccaucuucacagcuuucuuugccccugcuucuguucccaaccaccucugucugcagccagucacccugcagucuccuaacugcccccuuuucccugcagaguucgaggaagggcugcuggacagauguccugccccaggaccccaucccgcgcugguggagggucgcaggagcagcgugaaaguggaggcugaggccagccggcagugaggguuggacuggugucuucagacccaggaccucagacuucuggcucacacagacccccacgcucuccauccccggaaucuagucacaacccuggauccuuccucugcccuucuccugccuccccaccugcuccaugggcauaagacuguggggcuucaagcaauaacaagcagaggccuggagagaggacacaaggagggugcguggugcccucaccccugcccagagcgagggggcaaggacucugccuccagggcaucugggguuuuccccucccucacacaacacacucccauucucuuuagguuugcaccaguggugugagcaguuggacucaguuuggacaagggggaaagggggacuucccugggaagguccagcuaaaaguggcaacauuugcccccagaauugggggccugggaacacuggaccugcuccuucuccccucuccuuccccguuuuugugcuucugguuuguuucuuuaauuaauuuaacaagugcugcaguuugcccucccauucccaucuaucccccaaguccuuugcaauuucuucccugcccuacauaggggcggugggugugggaucccuucacuggcccccucgggaggccuggguuggacucagggucuccuccagcugggggcuggaccgcagcaccuaucugagcaguuagagcgucuuucuuuucagauuguguacaguagauuauuuauuuuguuauuuuggaauaaaauuuauuuuauggcuuaggau

SEQ ID NO: 16449 - RNA, 1826 nt, Homo sapiens
acugugggggagacugggcuccuacauucacuuuaguaugggugacuucacuucaguguugagacugcugaguguuuagaggggaaggugaggauuguguuuugggggagagggagguccagccaucccaggucggugcuggucagccucagcgcucaaguucuucuugccccagaccaaaaagauaaaagcugaagauaagguuguaagacgcuucgacuccuacagacacaggccacugacuuuuggggcuucgggccagucuaggacggcacuggcuuguccaugccucugagcagugccugauucugagagucuguacucagaccugggcacugggcaggauagcauccaaaugagggaggggaagaaaagcaggcaggaaagagggaacaauuguuaguguggguugguacccaguagggggacuugcaccgacugccucucucuugugccccuccuucucaggcccagugcccgagccauggcacugccucggacgcugggggagcugcagcuguaccggguccugcagcgcgccaaccuccuuuccuacuaugagaccuucauccagcagggaggggacgacgugcagcagcugugugaggcgggugaggaggaguuucuggagaucauggcacuugugggcauggccaccaagccccuccauguccggcgccugcagaaggcacugagagagugggccaccaauccagggcucuucagucaaccagugccugcuguucccgucuccagcaucccgcucuucaagaucucugagacugcggguacccggaaagggagcaugagcaaugggcauggcagcccaggggaaaaggcaggcagugcccgcaguuuuagccccaagagcccccuugaacuuggagagaagcuaucaccacugccugggggaccuggggcaggggacccccggaucuggccaggccggagcacuccagagucggacguuggggcaggaggagaagaggaggcuggcucgccccccuucucccccccugcagggggaggagucccugaggggacuggggcuggggggcuggcagcaggugggacugggggugguccagaccgacuggagccagagaugguacgcauggugguggaaaguguggagaggaucuuccggagcuucccaaggggggaugcuggggaggucacaucccugcuaaagcugaauaagaagcuggcacggagcguugggcacaucuuugagauggaugauaaugacagccagaaggaagaggagauccgcaaauacagcaucaucuauggccguuucgacucuaagcggcgggagggcaagcagcucagccugcacgaggugagaacccccaggccuccuaggauugcccuugacuuccaggucuccagccgcuuaccucugcgaguuucuacagucuccgacuaucuuucauuaucucuugaccaggaccccaggcccugauccccuccccaacaggccccuaccccagcggccgcagugcuuccauccucagcugagggggaagcagagauacaggcagcaccgagcuguucagcuccuugucacucaggaccccacaggagaggaggaggccccgggcauuccuaggaagcugugggugcugaccucugucuucccaccucagaaagcucccauguagugucaaaaccaaagcaagcgucugauggaugggccucauuuguccaauggugaaggggugugaggaggucuggugaggcagcggggaaguucgaauucugacucuccuggcugcccucccuccacagcucaccaucaacgaggcugcugcccaguucugcau

SEQ ID NO: 16450 - RNA, 501 nt, Homo sapiens
uccuuuuuuuuuuuuccacuagaaaaaaaacacagagcucuauuauucucaacaccaauggcagcggucuucauaggccagcggagugaguucugucgacagauagguggccccuacuugcuggcgaugaguggguuccgcaggaccacgaugaccaaguccccgugcaggaacauccuggagauauagcagucuuuguugacuggcuuggacuucuugcccuugccgcucuuggguaccucaguccacgucuccuucacguucuccagcaccauguugcagugccuguggaaggccuucacguggcccaggaguuucguguuguggcgacaguugaugagcacuugcguguuguucuugacugacugugugagcacagaaaguggacccguguuaaauuccuccuccucucgcuucugcagcuccucuggggucaucucacucuuggacuuguuaaggaggcucaugauggucacuacgcucucgguucauucccguuuc

SEQ ID NO: 16451 - RNA, 40920 nt, Homo sapiens
agaagguggagccccugagcugcuugugcugguaguuugcucccagaaaagcugggauuuggggaaaugcugaguuauggggguguggacacuuccucuagguccugacucuggaguggguaagaagcugguagaaaaagcccuaggguacaggucagcccuuucugcuuuguuuucucacgucacccgauacagaccugggaacugaaauccuaaaggucuuuugcaucccuccaccccuucccccaacauguucacguccuucagcguuuaucgagaaccuucucccucucaguagcugcaacuauuuguuuccuucccccuuugccggccucuucuaccaugccacuggagugucaacacagcucucuaaccuuccuccauauuucuccuggucugcccuguccucgccuccucccucucuccacccagagaaagccccgcccuucccuccucccuccccaccccagucugucacacagggacaucacccuacagcaguucaggcugugugguucgcaggaagcauacacuggcuuuuugauucuugcuaguucccagcucacaguuugggaggauccaacaccaaccuuuacgugaaguggaggcccaaggacagugaggagcuggguggucccagccuggagcugugccagccugacaugggugaguauggggaccagccccggggaaggccugagggaugccuacucccucccuggcugacucagcagggguggggccuaaccuuugcucauuugggggcugaaggagaggaaacaggacucugggggacggggggcacagggcucagcuagcgaggcugccgaccacgggauccugaguaugggcaagccccaguucuaaggaagagccugagacgcaucuuaggccagggcuuucccagcccccuccccgccgccccguggaggauugccccugcuccuccccauuuaagcuguugagauucaaggaaauuuugacaguacucacugcuagcccccacaaaaguaaagccggcuuuuggcagugcuggaaggucuuuaaaaugccuccccucccucucauuuuucuaaggccuuuuaagucugucuucucuccucccccaccuugacccaccuucaggugggggcugcacugagcagcugcuuccuguugccccagagacugaagcaagggugguggugguugggggaaaacugaaccaaagucgauucucauggucccacaucagccucaccagggcugcuauugauggcccccacacuacagucacugagggcacugagugggacgcaggauugagguugagaggauaggagguuuuugccuucguggcuuccugauuccaaaggccccacagccguagggauggagcccugaggagcugaaacacggggaaccaguucaccuaguagggcgcugcgcgugacccccagcaggcucggccuugaguucccucuccugcaccccuaggccuccuaggagcccauguagcucuuucugccuuccccggccucuuuugugaagcggucuuugcuggugcccugggagcgcgggcagagcucucccaaguccuuccuuucggaccuaccaccaucccccacuucaccgcagaaguuucugucucuuucugggauccguucucuuccucccaucugggauccuuccugguucuggccccuaggagacgccacccgcuauccucucccccaguggauccuucgcgacugcucuccugagcgguuguccucaccucgguaguuccugccccuuuaagcaccaccuccuccccuccgccgccgccggcccagggcugggggaggaggcgcagccgccgcccggcucggccaccugcgccucugccgccgccgccgccgccugcggcccggcccugcuccaggugaggcccggcacccaccuccagcuccggagucccuuggcgggccguuccugcgguauccugccccgggaucccugcugccccgggauucgggaucugacucucccccugagggagcugcccuuccucucuccccugaacuaucuacucgcccauuuucccccuguccuccgcgaccggaauccggaggcuucucacgccucuccgccaucgucucccgaguaccuuuccuauucugggcccaggaucucccccucccccgcgccuucuucgccagaaaaaucucccgcggucuggguuucgccuccuccccucugaacuagcgcuuucccacgccuuccuaaccccaaugggaggggggauacccaccccaacuccucuccuuccccguaguaaggggggcgggggagcaacaucgacagcacuaucugucccugcuccgcucagcccuuuaaguucagcuaagucccaucuaaaccuuuucuguaguccucaccccacccuacaucuccgggagcuugggguccaaccucagcaccgccuacugagcccaggugggaaggacucuccuccugggccuaggguuggucggugcagccuaggaaggccccucccccagaaccugggagcugggggccagggcgcugccggaaucuugugcuucagggccucagggacaguugggagagagugcguggggagcuggggcuaaaucucuaagggaguuggggcgauggggaaggcaagagaaguccagucuucucuguucagaugcaaaggaagccccccgacucccuaggaaauaggggcuuucucuaacuuccaggaccaccauagagaaucccauugggaaguuuggaaacaagucugugugaaucugaggagccaccugucgacuuaaaggggagaagggggccggguggagugugcucgccuguaaucccaguacuuugggaggccaaggugggcagaucacuugaggucaggaguucgaaaccagcuugggcaacauggcaaaaccuugucucuacaaaauauacaaaaauuagccagucgugguggcgugugccuguaaucccagcuacuaucgcuugaaccuggcaggcuggaaccuggcaggcguagguugcagcgagcugagaucacaacacugcauucuggccugggugacagagcaagacugucucaaaacaaaacaaaacaaacaaacaaacaaaagugggggaagaaggggagggguguuuuccuugugauguguuaugggagaaucuagccuucccagauuguagagggggugaagacuuuugcuuuaaccuggugggggggucuaguuggaaugguuacccggcuaagagccaucucccugcuagacagauccuguuaacaguaugauccauucagccagugaggggaaggcaggucuuuaauaauuaucccaccuccauuagagaauucccccuccacccccaguccagcugcgccccuagcuaugcucuuucauuucccacuccucacuuccagaauuaggggacuggcugccaagaucugcuucagacucuucuaagucauguuuggagggggugcuggggggaggagaggguguucagcagugguguuugggguuggaugccaggaguaucuggugggggagagggaaggauguagagggaugcaaacgaauccccuucucucucuuccuccucccagcccuagccaucuggcuacagaguggagccaggcacuguggcagcugaccccagagucagggaggugcugcaggaacacagggagggugagaaagggggugcaggugcuaauuugucccuccccauucucuucaugacuaguccacuggccuggcuugagggagguucagccuauucccuggagacucuccuuacaaguugcugauaaaaugaccauuugccccuuccccuuucuaguagcuuccugaagggaaauggguggggaaaagagaggugggugggugaucagccacaucugaugggauugaggaguguuucgggacauuuggggucagucugcccucucucgucuggauggggggagaagcacagcugcagcauggggugacuucuagcaagaaguaaacauccagcuguugggcacacugucaccccaaccucauccuuccucagagcaaggaagauccugauuagaugagaugagguggggucucauucaggaaugaggaugauuguagucuuucugcaccagaugggaagaauggauccuaccucauuuucuuuucuaaucccaagugguccucuccuauccaacaccccucuuccuaaccgcuccuggcuggaauaguccuaaagguugcccuggagacuaggccuggggcucggaaggggugggggcggucaguggggcacaggaguaaccggcucuuccggagcagaguggagccagugguggguguguguggguguggggaggggcguggcuacacccgucugacgggcgcaggcuccuccccugccugcccaguccccgacuggcccccuuuaagauugggagcaggagguaggaagauucucccucaucugcucuggaaaagggcagggaagacaaaaggauaccagcuuccuuacccacacccccaucccgccgcccuugaggccucaguuuuaugccuuucuucaccugccuuaauuuuuuauuuggggauagagaggcauuucuuagcagaaguuugccagagcccuccuuucuccagaaggaaggaaaccucuacccugagugugaccucuacuuacucagggacuugaggucagcaggcuguuggaggaguauuuuuuuuuccccaaggugaccuguaaaucuguuguuuugacagggaggagagaaggguuuugguuuccaccugccuauucccuccacugguaaucuacuuaucucgagagaggaagagaaacccccuuagccuucugugucuguggcccacacacucugugagccuuugcuaaagcuagcuuccuucuuauccucucugagccauuuguaguggggggguggagggguggagucuuuccccaaaauucaggaagagcccaccccucuguggaguaaggaaauccaauguagacugauggaucucaccccccaacucugcccauuuuucagaucucuuuccuccucagacccccagaggaaaacguauuuguugacaccccaacuugccagaguuucaucauccccacucuguugcuuuuccagaauauucagcagccugagcuuugcacaguuuaggcaacuguuucuagaacugcauugcauugaauuaaaugggaauuaucuucaaggcugcaaaguguugaguugcaaggaaaggaaaccugguuuccuuucuugucauauuuuauccacuguuugacauugaagaagucauugaaccucuuugggucuuaauuucuucauuugaugaaggagagaagguugaacuagaauuuuuuuuuuuuuuuuuuuuugagauagagucucccucugucacccaggcuggagugcaauggcgcgaucucaguucacugcaaccuccaccucccagguucaagcgauucucuugccucggccuccugaguagcugagauuacaggggcacgccaccacacccagcuaauuuuuguauuuuuaguagagaccggguuucaucauguuggucaggcuggucuugaacuccugacaucaugauccaccugccucggccucccaaagugcugggauuacagccgugagccaccgcguccggccugaacuagaaauucucuaagcucuaacaucauaugacacuguucuucauccuggugcccugcaguggacauuuuaggugacagccaaacucuaguccucugcuagauuuuacuuuucugaguuuucacacaguuauguagcccugucagaaaaaaauucccagaaccauagaauggguggacauuuguggcaucuuuuugcugauuaguuuucagcuuauccuuuacuucucugacugcauuuaggcuacacucaggucuuugcugucugguuccagagccgaaccuucuuucccccacgcacaggaaucuuuccuuuccggugaccagggcccugcagaugucgccaggaaaguggugauccaggcaggaccaggcugcacugaagggacagaggugaguggguggcugacucuugccucuccccaucccuuuacugaaucgcgaccugagugacuaaccuuucuauuuccacguuuccauuacccuaccugggaaauaacugcccccgaaauuccccugacucuuaccccuaccagccuguuagagaaguggcaccugccuuugggccuagacguuuggucuagucuuuuaaguuaaccuugggacuguggcaugccuuucaguuugcccugugugaagcaggaccacugccuccaugagaugcgggugcagagggagcugccaggugggcaagguggccagaguugcaggaggcacagcggcgcuaggacccagguccgggucggaaagaugggcuggcgggcuuuaggacccuguggcggaggccgcguggggagacucucucccggccgaggcuucuccgcccccuccggcuccgacucacuccucccccgccggccauguuggcuccucucgggccccgcgguugagccgcgucccccucccccuucccgaaccccggaccccagacccccuccccagcgggcgucuccacccguucuggcgcccggagcgcggccaugugaaccgcuuguaccccggggagagacgagccccgagcccggcuggacgccgcugccucagguuuguggggucuguggccaggggccugagggggagggagccccgcuuucauccgaggcuucccucggggaacagaagcuccagagccggcuugagccuugccggggcgggaagccgacgggagcuuauuuccugcgaggauccaacccgaggcgagggucuccuugcucuggggucugggaggagaacagggcugguggggcugcugaggaccccggacggggccgcgggggcaggaggagcuguaggggcucccggcgacagugaggaggcggagaagccgccuggcugguggagaugacuccugugggggacuugggguggaauccccgggaggggcuccaccuccucggguggggguggggauugccugagcgcgaggggugggugaggggguucccuuggcggguuaaaacgcuccguuugcggggagcugggcguuuugacuguggugaguggagggcggaagggguuuccaggggucugagggugucucccucggggagcgcacccauucucuugagcgugaagaucaggagagggccuuccuugcugaggguggugcugcgcuuggcuuggggcccucgcgucccgggagaaucgcgcacuccggggauggagguugauagggcuuccgcugaggcuuuccaauuugagcugggcugaggggcagaagggaagaauaaagaggaauuccuuuuuccaaggagauuccucacugaggggauccccgcuuccguggcagaaagaugauaccgcaucaucccuuucuuucccgguguucccaguuuucaggagaaggcaaugucaauagcaguuguccuuuguaggguuaauuggagugagagauuugucugcuuugggggacgacggaggggauagcuuuccaccucuaucuguacacaaacagccccucccccagccucccgcaggaaguggccgggaaauggcagcugugcguuugcugcugcgugucuuguuguuuugaaauguccauuuuaaucagauuugguuucauuuucugaagccuucugggcaagcuuggaucuugccaaccauguggcccgagagaccuuucguuggacuuuuuuuuuuuuuguaaacuugucaacuggaaguagucaacuucaguugacucacguaucccaaucccuucuccagaacaucucugucuuccugucugguuucguuuuguuuucccuuuagcuagaggucauagagaagcaaacucaguuaucuaccagcgggguacgcucuauguaagugaugcaaauucccucagcauagagagcugucagggagacuagagagcuuuuguggcacgaguagcuucuugggguccuacuuuaguauaguuauuaugacaguuucuauauugcagagcaccugagcaagugagcuugugaagaaggguagauucuaagaaauggacgaagaggaaggggugaggaagauuuaacuauuagauggauuugugugucggggguagggacugauuaacagacugagauuggugaacucaguccuugguggugauucuagccuaagggcagccccugugggaagcuuguuauuugacuaaggggugcuggagauacuaccuucugcagaaucaacuaauuagaauaguacaguuuguuaucauaugacuuacucuuuaauccauaaaagaacgucuccccucuuauucuucuuggagauugguaagcuuuuccucuguucccugcaaagucgugcccagauuuuuuuuuucuuucuuuucacuugauaaucccaggauauuucuccuguaacauauagugauggacugugugcuauguccccaggcauuuuguggcacacuggauuugguuaggggcaacaguuggccacagaauuuuauuuuucuuucuuuucuuuuucuuuucuuuuuuuuucuuucugucuuuuuuuuuuuuuuuuuuuuuugagacggaguuuugcuuuugucgcccaggcuggaguggugugaucuugucucacugcaaccucugccucccggguucaagcgaguugccugucucagccucccgaguagcugggauuacaggagcccgccaccgcauccagcuaauuauuuuauuuuuaguagagacggcguuucaucauguuggccaggcuggucucgaauuccugaccucaggugaucuacccaccucggccucccaaagugcagggauuacaggugugagccaccaugccuggucuucucuucuuuucuuuuuuuucucuucucucucucuuuucuuuucucuuucuuucuuucuuuuuuuuuuuuuuugagacagggucucacuccgaugcccaggcuggagugcaguggcgccaucauagcucacugcagccccgaccucuuuggcucaagugauccucccaccucagcccccugaguagcugggaccacagacacgcaccaccacauccagcuaauuuuuuguaauuuuuguagaggugggguuuugccaguuugcacaggcuggucuugaacuccugggcucaagugaccugccugccuuagccucccaaaguacugagauuacaggcaugagccaccaugcccggccuaugaccccaggaccacaggauuuuagauuuugaaagauaaaguuuuguuuuuuucuuuuucuuuuuuuuuuuuuuugagauggagucucgcucuguugcccaggcuggaguacgguggcaccaucuggacucacugcaacccucgccucccagguucaagcgauccuccugccucagcccuccaguagcuggaauuacaggcaugcgccaccaugccuggcuaauuuuuguauuuuuaguagagaagggguuucaccauguuggucaggcuggucucgaacucgaauugagccucccaaagugcugggguuacaggcauaagccacagggccaagccuugaaagauaacauuuucagauuauuuggacuauucugaaaacuacguaagccugucauuuaaaucaucuuuucacuauuuauuuuccaggcaaaaaccccucccaccuagaugaagaucccuagauuaaagauccaguaugggagcagauagacacuuaugauugugugaaaguggcaucaucacuaguaagauagcagcaucauugcucuucucacuggggcuguugggguuuuugauauucuggaaacaguaaaaacaaguccaucugaugucagcauccuuuuucuugccccugauuaguuccuuuaaguugcugucugaugggguugauuugaugcugauuuuaaguuccccuuucuucagccuuugcuuaccugaauuggcacuugacagaacagcaaguugauuuucccuguuggggguuaaaagaguaaagaaaggagagauaacuacucuugagucuuuggacuuuuaaaagaaaagcugauuuugagaaaauagugauuucauuugauacaugauugaauugggagcugaaugaagcaaaccuuucauggccuucuuauaaaaugggugcauuuuucugucagagaaauauauuucuuaauauuucaagcuucucgaugaaagaaaaaaucugagguguaaagagagcuguaugggcugaccccagagccagucuagaaugaaggguucaucuuguagucuugcggcucuggaaucaaguauuacugggagagaagcaaagcuuguuaggguuacugacagugucuuccugcuguugaccuuucuugucaccacugaagaggucaagcaccaaacugcuauuuuuacugcugaaacaguauagaaguuagucauugauaaugauguuugaccuuguguaagauguaucaagagcagcaauaaugccaaguauaaaauuugagauaauuccugggguaaauaaccuucuugguuuguuucuuaggauguugguguccucauaugccuuauauauagcccaagaugaauaguuucucaguauuaucucaugugggucaguaggacuauuuuucaccagcuuguuauuaucagucugccuaauuuggaaauuuaaaaaauugugcaaaacaaaaaagcccaucuuugaagauaucugauacuuugaagauacugucacuagcaguaaaaguagcauuggcuuaguguuuugucuuuucuccucuuuaaagagaacaguuauuaugggggcauuuugcagacuaaaauacuguaaucuugccaaaaauuuaccaaagaaaggaagaaguuuuuuguuguuguuuuuuuuuuuuuuuuuuuuuugagacggaguuucgcugugucgcccaggcuggagugcaguggcgcgaucucgacucacugcaagcuccgccucccggguucacgccauucuccugccucagccucccguguagcugggacuacaggcgcgcgccaccaugcccggcuaauuuuuguauuuuuaguagagacgggguuucaccguguuagccaggauggucucgaucuccugaccucaugauccgcccgucucggccucccaaagugcugggauuacaggcgugagccaagaaguuuuuaaaagauagauggucuuccuacuuuuagucuuuugagguuggacucuguaaccugccucaugaaugggguccuuaaccugccugcuuagcucauauuuggggguggaaaggguggaguccuuaacuguuagaguuuaaauucuggcugggcacgguggcucagccugcagucgcagcacuuugggaggcugaggcgugcggaucaccugaagucaggaguucaagaccagccugaccaacauggugaaacccugucucuacuaaaaauaugaaaauuagccgggugugauggugggcgccuguaaucccagcuacuugggaggcugaggcaggagaauugcuugaaccggggagauggagguugcagugagcagagaucgugccacugcaccccagccugggcaacagagccacacugucucaaaaaaaaaaaaaaaaaaaaagaaauucuaagaaacaaucagagcugaaagagggaaauuaccuuaauauaaccucuggacuguggcuuuuaguguccugcaauuucagaggcauuccuggucuucugagaguaaagugacuggaaauguggcagaaaacuuaaccuguaguuucuuuaauuaacaaauauauaaaaaccuauuauaugccucaaguguucaguuaaaccaaguagaauguuuuauuaauucagagcuuacguuuauuuauuuuuuuauuugguugaaaacgguggugugaucauagcccacugcagccuccagguccuggacucaaauaauccucccaccucagccuccggagaaccuggcacuacaggcauaugccaccaugccuagcuaauuuauuggcuuuuuacauuaucaguacuucccuauuuucaggccuuauuuucuucaaggaauggcuauuuaaguacgucaagauuugaggccuuucuucucucuugaaauuuuuaucucugugaagaaugaagcugaguuuuuuuuuuuuuuuuuuguucucugaaaauaguaagagcaaagcccaugaccuucauuggauaaguaagcugguaguggcagaaaagguagauuuacucauucauuucuucaguccauggacucaacaaauauuuccuuugguucuuuuguauacuuagcacuaaauuaggugcuagggauauaaugguggaacuuauauccaacugaugcuguggaaccgacauaauguagaagaaauaaggacagagaacagucaucuuugaauucuucugaacagccuggacgugacaguuuucuuugaguagcccccucuuaguauaaucuuccuucuuucauuaucuuuguucugccucacuuggaguccugacuagggaagguaguuaaggagaggauggauauuuugagccucagucaguauaugauauaguuuguccgagucagaguucaagggaagcuuguuacuagggcacucagaauggguuaucgugauuggagaagagggcauauuuauucuguggcuugguacuuggaauuuuuuuuuuuuuuuuaguguagagauagggucucacuguguugcgcaggccagucuugaauuccuggccucaagugauccugcugagguuauaggcaugagccaccucucccagccuacauggaacucuuauugguggaggaacauggcuuagccagggagaugagguuuuuagauacaaaagccaaagcguccucauuugcagugucaggaacugggaacagugaaaacuuggaacuuucccaagguguggggcaggaaugggacagcuuuuacauuagaacaggguuucucagccuuggcacuauugauaacgugggccagauaauaucuucguuguggggggcgcuguccuguuuguugaaggacgccuagcagcaucuuuggcuucugcuuacuagaugccaguagcacauaccuucagagauuacuaaauguccccuacggggcagaauugccccugaugagaaccucuguauuagagugugguggguaauccagagauguguagaguuaagaaauauccuucaugauguucacaauuacaaagcuaaaauguaguggugugauuuuuacucuagaauuugccuuugcuguuuagucaagauaaacauuugaaaucucucucaccccccaaccccauuugugagauuuugauguacuacaugagaagaaugaacccaagagcugcagggaccacugcaguauccagcuggaggguguuaaugugucuuguuguccugggggguagccucagaggcuggaggguuagaauuggucagggaggacaccuguaacaguguugcaauauauaauauuuauuucaacacuuugugcauugucagccuuuuucuuuuuuuuuuuugagauggagucucgcucugucgcccagacuggagugcagugacgcgaucucggcucacugcaaccuccaccucccggguucacgccauucuccugccucagccucccgaguagguaggacuacaggugcccgccaccacgccuggcuaauuuuuucuauuuuuaguagagacaggguuucaccguguuagccaggauggucucgaucucuugaccucgugauccgcucaccucggccucccaaagugcugggauuacacgagccacugcucuugguguugucagccuuuuucuauuaaaccaugucacaggcccacagaguagcagcucuuugauuggaacugggagaaaagcaaccuauucggcccuguggggagggcuuuauugcuucaagcuuauagggcaaugucccuuacucuuauaaaugaaacauaggagcucuuaaaagauccauuuauguauagcugggacugggcugggugcuugaaugaauguacuuccugguaugagagucaucugcuacucuagggguugggcacuggcugauuucuuuucucauuuggugaaaauccuauuaguucaaagggagaugcucuccuuugcuuuacuguucuuacuagcucuggaugggaggacagaguuuaccuuuaggguuuauugugaaaagcaucuugaguaggaagguuaaaaugaaauaaaccuagguucauuguugagaggagguguucacauguuuuucguauucccauacugugacauaauuaauucccauauuuaagugacaucugaaaucaggagucaaauuguauauaaggaagucuggcuggaucaucccuaguuuuaaauuauauuuauuuuauauguagaccguuuagaccugauuaucuuuuuuuuuuggagauagaguguugcucugucacccaggcuagagugcaauggugcgaucucagcucacugcaaccuccaucuccuggauucaagcaauucuccugccucagccuccugaguagcugggauuacaggugcccgccaccacgcccagcuaauuuuuuguaauuuuaauagagaugggguuucgccauguuggccaggcugguuucgaacucuugacuucaggugauccacccaccuuggccucccaaagugcugggauuacaggcgugaaccacugcgccuggccaggccugauuaucuuuuugaaaacuacacagucuuuuacuguuugucuaauaauaguagcuaauguaguccugguaagguggcucacgccuguaaucccagcacuuugggaggucaaggugggagaauugcuugaggccaggaauuugagaccaucaugggcaacauagcgagacccugugucuacaaaaaaauuuaaaaauuagccaggugugguggugagcaccuguaguccuagcuacuugggaagcugaggcaggaggauuacuggagcccaggaguuccaggcugcagugagcuaugaucaugccacugcacaccacucuggaugacagagugagacucugucucaagaagaaaaaaaaaaaacuaacguuuauggagugcuugcuggaugacagacacugugcuggggcucuaauuuagauuuucucauuucauccucaccaguccuuaaaaguggguacaaaaauuguuacagaugaugaaacuuaggcccagcaaguauaaguaacuuguccaagguuaaacagcuagcuaguaaauaguagaguugggauuugaaccuagagcccacuacauugugcugaccacauugcauagcacaaagacaauuuuaugugucuaggaagcuucucguaaaugaagugguugugguucugaugacaguucagaagagacagguggagaaacugaucucacauacuaaauaacuucccauucuuuuuaauucucugauuucugugagccaucgacauguuguuauuaauauuuacaaaaacaggauaugcugugcuuuuccagagcagcagagaggaggucacaacuuuguucuuggauucaaauagagaauggaaaaaugaaccgugacccaucauugaggaggauauaguccacugcacauaggauggaaguugcauguauccuccacaccaggggagguguacaaaaaacuggggagaggagaggugaggaucagaugaaauuggcccucuaggcauaguauuuccaggacuucugaagugaagaguguccuccuugcucugugguauaagcuuuggaaggaaccuaacuggagacuaaggaaugaacuuuccuuuaauucuugcacuuaagaaggauuauuaaucucaugaugcuuaucuuucagacccccuacugcugaggaguagcuguuaacuauacuagggaaauccugacugggcgcaguggcucauggcuguaaucccagcacauugggaggccgcggugggucgaucacuugaggucaggaauucaagaccagccuggccaacaugguguaaccccgucucuacuaaaaagauaaaaaauuaucugggcguguuggcgggugccuguaaucccagcugcuggggaggcugaggcaggagaaucgcuugaaccugggagguggagguugcagugagccgagaucacacccuugcaccccagcaugggcaacaagagggaaacucugucucaaaaaaaaaaaaaggaaauccuggaggacccuguguguuuuguuuguuuguuuguuuuguuuuguuuuguuuuuuugagacaggguuucgcucugucacccaggcuggaaugcaguggcaugaucuuggcucacugcaaucucugcuucccaggcucaaacaauccuccugccucagccucccaaguggcugggacugcagcugcucaccaucaugccuggcuaaccuggggucuuuucacuauaaagacuccauuuuuucacugaugcauggcagguuuaggucugcuacuuaauuuagagcaagcuuguccagcccacccaggacaacuuugaaucuggcccaauaccaauuuguaaacuuucuuaaaagauaacauggagauuuucuugugauuuuuuuuuuuuuuuuaaagcucaucagcucucauuaguguauuuuauguguggcccaagacacuucuuccagugugguccagggaagccaaaagauuggacaccccuauuuagacuaaagaugagauauccuauaugggagauaaguaaguccuaaaaacuuuuucccuuaaaucaacaaaugcacauugcuuuuaguuuuuagagauggggucuugcuauggugcauaggcuggacuugcacuuuugggcucaaguaaucuuccugccucauccuccugagcaacugagacuacaggcaggaaccaccaugcucagcuaacuuuuuuauuuuuuguggagacagagccuugcuauguuucccaagcuggucuugaucuccugaccucaagugaucuuccugcuucagccuccuggagcacuaggauuacaggcaugagccaccaugcuuggccuauuuuuauuuuuaaaauuucaguuaaaauugauuaagauacagacaauucccacauacuaugcaggguuuauauaucaugcucagacuuauguuauauucacauuuauacuaauggugucuaauuuuaguaauguagcauauuuaugaauguaacucuugcagacuuuggccagugggcauauauauucuuuucuuuucuuuuuuuuuuuuuuuuuugagacagggucaugcucugucaccuaggcuggagugcaguggcaugaucaugguucacugcagccucgaccuccugggcucaagugauccuucugccuuagccucucgaguaagcuaggaccacaggugugccccaccacacccugcuccuuuuuuuuuuuuugagaugaagucucgcucuugucccccaggcuggagugcaauggcaugaucuccgcucacugcaaccuccgucucccagguccaagcaauucuccugccucagccucccgagcagcugggauuacaggugccugccaccacgcccagcuaauuuuuguauuuuuuaguagagguaggguuucaccauguuggccaggcuggucuugaacuccugaccucaggugauccgccagccucggccucccaaagugcugggauuucaggugugagccaccgugccuggccuucacacccugcuacuuuuaaaauguuuuguagagaucgguucucgccauguuauccagcuuggucuuaaacucuuagccucaaauaguccuccugcuuuggcuuccaaaguauugggauuauaggugugaaccacuaugccaggccucaucauauauguacuuaaccaguguauucauucuuuuuuuuuugagauggaguuucacucuugucgcccaggcuggagugcaauggcgcaauuucagcucacugcaaccucugccuugcggguucaagcgauucuccuuccuuagccuccugaguagcugggauuacaggugccugccaccacacccagcuaauuuuuguauuuuuaguagagacaggguauuaccauguuggucaggcuggucucgaacuccugaccucaggugagccaccguaccuggccugaauucuucucuuuuuuaaaauguaguaacauaauucaaggaguugcuuuuucuguaucaagacagauuauguuucucacauaucaaguugguaugcacuaggaugucacaagaauccgauugauauguuagaguuuaccaauaauucuggcuucugcuugcuuucuuuccuuuccucugucaaaguuaaauucauucugaucaagggcuucuuaucauucuuaguaguauucagaaagggugaaaaacuuuuuagccauaccucaaugagccauugcacuuuacaaauauaaguaucuugcuauuuuauuuucccugugaccguuucuuuauauuuaagccacaaaacuaaaacauuaggaaauaaccauaauagacauaacagaauaauauuuuuugggauacccucauauuuaaucaauuuuccacugcugacauuuuucugaccuguguucuuggggagcauaaagaguagaaguauugcuggaugauucgagguuugccauuaugaucaccuuccugaaauguauucuccuuuucaaaucccuuuacuaauguaacuacuaucuugagauaucuagggcuauggauaggauaauuagaaauuauguuuagcucaaguuuaauaaugaaacaaagaguguuuaucaaauaugcuuuucugucaaaaagauggcuuugagaaccuuuugugggccugggagggagacuuuaccuuggggauaaaaacaaaaggauggagaauguuaagugguacaguagaggcuaauaucuaauauagaaggguaaccugggcugaguggggcuuacacagagggaagacuccuccagguuuguaucuugguuuuucucgcuaacuugcuuuguuuuuuaaucuacaaagcuggcuuuaaaagacuguuuucauagguucauugcucaggcuagaggcauauuuucuccuucucuuuucuuauucuguaccuucccucacacaguacuuagguaggagaaggguaaguagguggaggggaggggucauugccccuggaagauuccaggugacauaaccuuguuuaaccgccaguauuuuuuuucccucucucuccccuccugcagaaauggaggcaaacgaccauuuuaacuuuacuggccuucccccugcaccugcugccucaggacugaaacccucuccuuccucaggggagggccucuacacuaacgggucucccaugaacuucccccagcaagggaaaagugagugugagggcugcuuggccuggggagggaaugggcaucaucccuuuagggcagauucauggggggauauuuugcucuacuuugcugcuggagagaaaucaacuucuaagaacaaguucuaggguuuuuuggaaacauuuuuuguauugauuuaagguuggaagagauuagaaaaacccacuggcuuuuucaucuuagccuguucuucugucagcccuguuccccuggcugcugacagagcagugaaguggcuacugcugcugauaacccaugagagagauaaagugcuagccuucuaagaagcuguuuuuagagguuagggaagcuacacugggccaggacugagaguugaaugaagguugcaguguauuuauugccuuuuaguuuguacaucagagaaaggcagaugcuagaaguacuuauuccaccuucuguccuuggauggaagguagggacaagggaaaguuuaaugcuuaccuaguucccccagagagaaguucauaauuccauauggagguguugcugccaggauugggucuuuuccuggauuuggcuuaccaguugcucuguaccaugacucgccagguaccucuguaaucuugcuuggguuucaaguccuuuauacuuggaagcagagagaagcccacaugcuucccuccuuucuuguagcagaaaaauccugcuacuucucccuccgauccucucgaagaggguugcagaugguagaagcuccuuuauuucauuggauuccacccuacccucaagcuuccuuaauaucuugguucuuuuugauugauuguccuccaucccagagguugccauugaugaugagagcugaauucuacagcacacaaagugcccccccuaccccgccagcuggcauauuaccuuccaaugccuauagggaagggccaagcccagccuucugagcuggguucuugucgcuguggugacugcaaauucuauucuuagcccagcacaaagugcuggaucugcaugugccagugagguggagguuguuccuuuugguaccacuguggggccaaauaggcacuggggaaagggggccccuagcgaauucagucaugccccuccaagggaagaaauccccuagggaaugagaguagggcagaaugcaagucacuguagggagucugcaaacaguuucauuuaauuaaaaacaaaaaaaaaggccaggcgugguggcucacgccuguaaucccagcacuuugggaggccgaggcagguggaucacgaggucaagagaugagaccauccuggccaacacgguaaaaccccgucucuacugaaaauacaaaaauuagccgggcguggugaugggcgccuguggucccagcuacucgggaggcugaggcaggagaaucacuugaaccagggaggcagagguugccgugggucgagauugcaccacugcacuccagccuggugacauagcgagauuccgucucaaaacaaacaaacaaaaaauaaaccaaaaaaaagccagcaguaagcagcagcaaccagcucugcugguggcucucaugguaggccuggagagcucucuagcccccuacucagccucagcagcaguugcuaaaccuacauccaggagccucugggcuugguguucuccagagacccaaaaacuaaauauagcaggggaggaaucccccuucccuuuaccaugucuuuuucuagucagugcuauuacuuugaguuuguuuugguaaaguugcuugccuacauaucuguaacugaccuuuucuuucuuucucugccagguuugaauggggaugugaauguuaauggcuuaucuacuguaucucacacuacuacuucagggauuuugaacucugcuccccacuccuccagcaccucacaccuccaucaccccagcguggccuacgacugucucuggaacuacucacaguacccaucugccaauccuggcagcaaccucaaggacccaccccuucucucccaguucucggggggacaauacccacucaacggcauccuugggggcagccggcaaccuucauccccaagucauaacacuaaccuucgggcugggagccaagaguucugggccaacgguacccagagucccauggggcuuaacuuugauucacaagaacuguaugauuccuuuccugaccagaauuuugaggugaugcccaauggacccccuaguuuuuucaccuccccacagacuucuccuauguugggaucuagcauucaaaccuuugcacccucccaggagguaggcagugguauccauccugaugaggcagcagaaaaggagaugacuucaguuguggcagagaauggcacuggcuugguaggcagcuuggagcuggaagaagagcagccagguauaacuggguuggugaacuggguggggaaaggaaaaauggagcucgggggggauaguggcuuuuugaggugagaaaaacuugucuuuccagcucucugcaguggaggcugauuugcauguuggugauuagcaauuagcagagccaaguggcugguguuuuuguggcagcagcaccagcucgcgagugggagugcaaauuauuucaagcucaugcagagcuucuggccuggagagggcaggugggcgagcccgaaacagccccaacagacacccugcaucaagaaaggcuucuuucaaaauauacggagugguuagggucuagcagcgggcauugaggcuguuuuaacugacuguggcaggaucagacuggcuguuaaagucgucugagcccaauguagugauuggcaugcgaaggagggaaggaagcaggcagagcauaucauuauuugucuacucaguuuccuuuuuuuuguuguuuagcauuaguacacgugacagccccucucaucuuuucccucaaaauagauaaaagcuuagcuuccaguugauuccugguacaaggguaaccaccacucuguaaaauuacaggauguuuucucguuucccaauggauggaggagauaucugagaacaugauagagauguuguaucagaccccacucucuuuuccucucuuugccugcuguaggauugauuuuaccagcacaucucugcucagaguaucuugaugugaucgguucccagcaaugaacuggccgcaauaaauguugaaugaaugaacauccuucuagcaaagauugacugccuaguauagcuaagugaaccaauauaaggcacugauuuugacuuuuggucucuccugugauuuccuagaacugaagauguguggcuacaauggcucugucccuucuguggaaucguuacaccaagaggucucaguccuggucccugaccccacagugagcuguuuagaugauccuucacaucuuccugaucaacuggaagacacuccaauccucagugaagacucucuggagcccuucaacucucuggcaccagguagguuuggaggcuaugucccuuuaacuuauccaugcagaguagccaaacuuuaccugaaagagacaguaaaaugggaaaaguauuaggcaaucaggggcacuggggcuuccagguaggccuaaggcagaccacaguuacaugccacaggacuuggugcccuaacugaauucugagcugaauugguucaugucccagguucuuucccaguauuccuuuuggccaagagcucugggcuguaauaauucacuggguagggacuuauuaucacacaguugaucuuucuggguucugacaaacuaggaagaaaacauuugucagugagcaguuaccuuuuacuccacugaaguacaagaaagacauauuuuaugauaaauccuagaauuuugcauaggucucuggguagauaauaccaccaaugccuuuccuuucauuuucaccuuguagagaugaggucuugcuauguuguccaggcuggucuugaacucuggccucaagcaauucuucugccucggccuccccucaaacuuuuaugaucccuauaaucucaugacuacucuuucagggagaaggcuuuacuuguuaccuaacuuaauauuaggaagaaucuucacauugugggaacuagaauuggauguuuucugaccaguguuucuuaaaucuugcuuucugauuuuuuucucauuauccugcucugauuuuucuacccuuguaaacagagccagugaguggaggacuauaugguauugaugacacggagcugaugggugcagaggacaagcugccucuugaggacagcccugugauuucugcccuugauugcccuucccucaauaaugcuacugccuucagucuccuggcagaugauagucaaacaucaaccucuaucuuugccagucccaccucuccaccuguccuaggggagucuguccugcaagguaagugacgguagguaggacaaagaaagaccuuuaccugagaaaagaugagagaauaaguuucauaguuagggccuuaagagugggaaaucuggcugggcgcaguggcucacgccuguaaucucagcacuucgggaggccgaggcggguggaucaccugagaucaggaguuugagaccaccuggccaacauggugaaaccccgccucuacuaaaaauacaaaaauuagccagguguguuggcacaugccuguaaucccagcuaccugggaggcugaggcaggagaaucgcuuggccccaggaggcagagguugcagugagccgagauugugucguugcacuccaaccugggcaacagagcaagacuccaucucaaaaaaaaaguaggaaagcaagagcaccuugcugggagcugaggggcuaugggauaguguaugguggaacuaaaagagguauaggcugcuauacuccgaccugugcccucugcuuugaagaacuugugagacuuggaauuuguagggagaaggaggcuagaagcuuuauuggcaccagguaaaagguauuucuucacacaaugacaucuguagcaacuuuacccuuuaauccucaugauugguugggagaaaaagcuacuucuuuuuccaacccuagggaagaccccuugaaguaacccuguuuagcuugguccaggguugacugaguagauucucuuguuuuaugugaugccuuuuuuuuuuuuaaagccuauccugucccuuuggauucuagauaacagcuuugaccugaauaaugguagugacgcugaacaggaagaaauggaaacucaaucuucagacuucccaccaucccugacccagccagcuccugaucagucauccacuauucagcuacauccagcaaccucaccagcagucucgccaacaaccuccccagcagucucccuagugguuucuccagcagccuccccagaaaucucuccagaaguuugucccgcagcuucuacaguugucucuccagcagucuucucaguggucucuccagcuuccucagcaguccucccagcagucuccuuagaagucccguugacggcuucagugacauccccaaaagccucucccguaacuuccccagcagcugccuuuccaacagccuccccagcaaauaaggaugucagcagcuuucuagaaaccacugcugacguggaagagaucacuggagaaggacucacugcuucugguaguggugaguauccagauucuauucuaucccugucugguuccaagaaacuuuucugucccauguuguaguuagccuuucccuauuggccuauuguuuaaauauuuugcuugaacucuuaacuuggguaucccuuccucccaaggugaugucaugaggagacguauugcuaccccagaagaaguucgucuuccccuccaacauggguaaaugcucuaguuugcuacauuuauugaccuugacaaguuuaaugcacaacucuagaaagaagggaaugccucuuuuccucugaggugggggaggaaugggccagacaagaguagauuacaggacaguuaucugcagugauaauguuucuuggcaugagauuccuagguuuuccuucuucucucaaggucugucuuccaucaccuauucuuuuuucaucuuguagugacucaauuuugcccaaggagcuccagcuauuaucuuuuccaaacccuagggcucacauccaaaccagcuggcuuguccuauuucuguggacaagggauaguaaugaaugaggagugacuuaguacuaaugaauugaggugguuuuguuguuuuaaugcucuuaggagagguaagggcaggaacaguacaugaccaaaaugaacaaacuagcugacaccagggccuuguggaaauaacugccuuccuggaucuuccccaccccugccccucaaggcuacuuguggucaccaagucugaguacugcuuaaaauuuugagagaaagauuagaguuagucuuagaacuaacucugacuaacuuuguguucugcucagaacacagaguuccuaacuaaacccuggcauauugagucuuuucauggaaucagcagcaaauuuauuuuucugcuugccucccugcccuuugucuucugucuuuauuccccuuaggucuuuauccucuuuacuggaaauccaguaacugcccugaauggcucagggagggguuucuggcagcuuaucucacugauuuuguaaaggagggauggagaucucucugagcuugugcaguuugguguagugcuuuucuccuaagggccuugauguauuugcuggagcucaagucagccuucuagccaagcuuaucucucuuggugcuuuugcaucugcaugcaguucuagagauacaaauguggggagggccaucugcucagagggcuucgcgcuuagguggcaugggaguggguaggggugugaccuggcggcagggcccaugugcuucucuggcagguggcggagagaggugcgcaucaagaagggcagccaccgauggcagggggagaccugguauuauggccccugugggaagaggaugaagcaauuuccagaagugaucaagguaauguagcuuuuuuuaaaggacugcuuucuugggcucaguggacuccuuuccacugcccaagacuccguucuugggcucagugacaacaggcuggcauugucugcucugggccuguucugcuuaugccuuugcuggccaaagacaugguaggauccaacuuuauuaauguuacuuuacuucuuccucuuaguaccugagccgcaacgugguacacaguguccgccgagagcacuucagcuucaguccccguaugccuguuggagauuucuuugaagaaagagacacgccagaggugcagacccaaggguuaaauaugcuuuugucccugaggaagaguugguggacaagcugcagcuuccucucgugggguuugaagguucuggggcauugaaugguuccgagggccucguggccugcacugauuccuuacuacuguaacagucucccuugcuaccuuagggcuugcagugggugcagcucucagcagaggagaucccgucgaggauucaggcaauuacuggcaaacggggucgaccucgaaacacugagaaggcuaagacuaaggaaguccccaaggugaaacggggucgaggucggccaccuaaggucaaaaucacugagcuauugaacaagacagacaaccgcccccuaaagaaacuggaggcccaagguacagugguauuucuuacuuugggauucugcucccuccaugagguaucuaaaauguugaugaauugcuaauaccuggauuucccaggaguguaacuaacauuaucugggaagaaugaaucugaaucagcuucuccuuggaauccagcauccuagucccagcgcuugggaauacuacuuuuccagccauggucuuucuugaguugcuguuaccagugaaaccuugggcugcccccagguguguuuagcccagaggagaggacuuucuugcccuuucuuuccaucuuuuagcuccuuaucauauacugguucaguuguacccuuuuaccuuacccauuucuacuaucauggagguucagaauucacaucugaauucaaaagauaauugggagccaggcaugguggugugugcuuaauaaucccaguuacccaggaggcugaggcaggcagcagaggaucacuugagcccaggaguuuggaggcuacaguaaacuucaguuguguuauugcauuccaaccugggcaacagagcaaggcccuguuucuaaaaaaaauaauaggccgggcacagugucucacaccuguaaucccagcacuucggaaggccaaggcgggcggaucgugaggucaagagauugagaccauccuggcgaacaugguaaaaccccgucucuacuaaaaauacaaaacaaaaaauuagcugggcgugguggugugugccuguagucccaccuacuugggaggcugaggcaggagaauagcuugaaccugggagguggagguuucaguaagcugagauugcgccacugcacuccagcuuggugauagagcuagacucugucucaaaaaaaaaaaaaaaaaaaaaaaaagccaggcacgguggcucacgccuguaaucccaccacuuugggagacugaggagggcagaucaccugaggucgggaguucaagaccagccugaccaacaugaagaaacccugucucuacuauaaauacaaaauuagccaggcaugguggcgcaugccuguaaucccagcuacucgggaggcugaggcaggagaauggcuugaacccaggaggcagagguugcagugagcugagaucacaccauugcacuccagccugggcaacaagagugaaacuccaucucaaaauaauaauaauaauauaauaauaauaauaggcacuguuuuaguggauggacaggugagaaauaccuacauuuuucaguaaauaguguguuuacccugguguagugugaagaaugugaaaaaacuuagucuuuugauuuucacucagacaucuagccgugucauguuucaaccaaaugaccuagaacaagucucauuuuguuuuuuuuuuuuugagacagagucuuacucugucacccaggauggagugcaguggcacgaucuuggcucacuacaagcucugccuccuggauucaccccauucuccugccucggccucccgaguagcugggacuacaggugcacgccaccacaccuggcuaauuuuuuguauuuuuaguagagacgggguuucaccauguuagccaggauggucucgaucuccugaccucgugauccgcccaccucgaccucucaaagugcugggauuacagguguagcccccacgccuggcccuuuuuuuuuuuuuuuccagauggaguuuugcucuuguugcccaggcuggagugcaauggcgcgaucuuggcucaccgcaaccucccagguuuaagcgauucuccugccucagccuccagaguagcugggauuacaggcauaugccaccacgcccagcuaauuuuguauuuuuaguagagaugggguuucuccauguuggucaggcuggucucgaacuccugaccucaggugauccgccugcuucagccucccaaagugcugggauuacaggugugagccacugcacccagcuaagucucauauuuuaaucaaagccuuagguaguucaucugcccauaauaucugucuuagaggguugucacguagacaugugguggcguuucuauaccagaaacaaaauaauaaauauugucaugucagggccaggcacgguggcucacggcuguaaucccagcucuuugagaggcugagaccagcggaucaugaggucaggcaaucaagaccgucauggcuaaaacggugaaacuccgcuuguacuaaaaauacuaaaaauuaacugggcgugguggcacgcgccuguagucccagcuacugggguggcugaggcaggagaaucgcuugaaccugggagguggagauugcagugagccgagauugugccauugcacuucagccugggcgacagagugagacuccgugucaaaaaauauauauauguauauauagucaugucagaaacaucaauuaugaaauacucuuguuugcagaauuauacuuccacaagucuucccgaaaggaagaaauucagaacuuuuagugaagcaagacauggagcugagcaugaucaauaacuaugucagugauucuuuugagguguccacugugugggccuuuuuucuggcacacccuugguuaaucagugcuucuaacuacuacccucuuucccuggcaguuuggcuugcuguauccuuucucugcuuucugcucuaaaaucaguccguggguuucugcucuugucagguauccugggagagagauuggcuccaaggcuacucugccauuguggccucuuuucuaucagcaggacaccuucuaaagcagucugauuggagccaggggcuggugcuucugggcaggagaugucauuugaguucuuugugccacccccauagcaggugccucuccuacauuuuuucccccaauguuuuauuauguauacuuaaaaaaaaaaaaagcuacucuagauucuucagggagcugcuugggaggccagcuuugagacgggcauguguugcccuggaugcuagagaacugccuuccugccucacuuguuucauuuuucuuucugcucucacagaaacauugaaugaggaggauaaagcaaagauugcuaaaagcaagaagaagaugaggcagaagguucaacggggagagugucagacuacuauccaagggcaggugagggacaucagagagaugaaacaguagguuaauuuuuccuacaacuuacuucaucuuuuauuuucauuucccacauccgucacucccuguguagcagcauaucuucauuacccugaaauuucuugcacuugauuuagagaauuggguuuguucaaaaauaacgugggcaucucuagggugagagaauuaauccauugccaaccccucauuccaucucucaccucuccuccccagcacccuugucuguuuuugaauccuagcccaagcagagaugcuuucagaguuugaggagaaaugacuucccuuaugguuuacaggccagaaauaagcggaaacaagagaccaagagcuuaaagcagaaggaagcuaagaagaaauccaagguaggugcauguacaaacuugccaaguauaauuucgaagccacuaaacugauuuugcaggacauguacaucagucuuguuuuauagugagauuucugggcugugagguugggaggacugggaccagggaaggauagugacugauaucuuuauggcagucuugguuccucucuuccuuggguaggcugagaaagaaaaaggaaagacaaagcaggaaaaacugaaggaaaaagucaagagggaaaagaaggagaagguaaaaaugaaggaaaaggaggaggugaccaaagccaagccagccuguaaagcagauaagacccuggccacacagaggcgcuuggaggaacggcagaggcagcagaugaucuuggaggaaaugaagaagccgacagaggauaugugucugacugaccaccagguagugaggagagaguaacaguuccugggucagcugggaagacuuuccuuuaaaaaaaaaaaaaggacuucugcaaugggagagacauuuccauuaaagauuaaaggaaggccgggugccauggcucacacuguaaucccagcacuuugggaggccgaggcgggcagaucgcuugagcccagcaguucaagaccagccugggcaacauggcgagaccucaucucuacaaaaaauacgaaaauuagcugggugugguggcauguaccuguagucccagcuauuugagagacugaggugggagaauugcuugggcuuaggaggucgaggcugcaguaagcagagaucaugccacugcacuccagcuugggugacagagugagacccuaucucaaaaaaaaaaaaaaaauuacauaaaaauuaaaggaagaaccucuuguagacaugcaaauugucaucuucuguuauguuuaacagaacucucuacucacuuuucucucucuagccccugccugacuucucacgagucccuggucugacauugcccaguggagccuucucagacugcuugaccauuguggaguuccugcauagcuuuggcaaggugcugggcuuugauccugccaaagaugugccuagccuggggguccugcaggagggacuccugugucaaggugacagcuugggugaggugcaagaccugcuggucaggcugcugaaggcugcacuccaugauccuggcuuucccuccuacugucaggugagugcaagucccucccaaaguaaccaggacaaguaaaggagauguaacuacuuaguguuucucuuuuccuuauauuuuuccauuucuuuuucuuccugacuccucuccuuauuuuauuuuucuuuauuuuuuccuuuucuuuuguggucuucuuucguauucugucuuaacccccauaguucucuucugauguauuuuccucuugcacauucacccaacuugguugugcaucuuucccuacucacccccauuaugcuguccuccacacagucccuaaagaucuugggggagaaggugucugagaucccacugacaagagacaaugugucagagauccugcgcugcuuccuuauggcauauggaguagagccagcccucugugaccgccugcgcacccagccuuuucaggcccagccaccccagcagaaggcugcuguccuggccuuccuugugcaugagcucaauggcuccacccucaucaucaagugagaggcugggaguggggauggucauuguaucccuugcaucagaaugggguggaggacuuguagccuuccagaaguccucagaaauguguguucacugccauguucugaagaugcuggaaugacuugggacugaauugcagugcccucccugggagagccuaagccuucugccauucacccaaucuggguucuaggcuggaacuccuuuuucagcugcagccccuuuacccuugagccuccuuucccuuuuuuugugcugccacuucauccuauucccuauuccccugcagugagauugacaagacucuggagaguauguccagcuacaggaaaaacaaguggauuguugaaggccggcuccggagguagggaccagacagagaguagagccucagagaggagagaaguggggcgggugaagcauagccaggguuuuggcuugaaaugugaugcuuuagccccuucccuggguuugggaccuuaccagggcccaggaugguuuagagucaagguauuucuuuuguggcacuaucauguuccucaccaguuucccguaauuuuuuuuuuuugagauggagucuuccucugucgccuaggcuggaaugcgauagcgcaaucuuggcucacugccaccuccgccucccagguucaagcgauucuucugccucagccucccaaguagcugggauuacaggcccaugccaccacaccuggcugauuuuuguauuuuuaguagagacaggguuucaccauguuggccaggcuggucucgaacuccugaccucaggugauccgccugucuuggccucccaaagugcuggaauuacaggugugagccaccacacuuggccuucccuuaaucuuucuccaucuauuucaaggcugaaaacuguucuggccaagcgaacugggcggucugaaguagagauggaagggccagaggaaugccugggacggaggcgcaguucucggaucauggaggagaccaguggcauggaagaagaggaagaagaggagucuauagcagcugucccuggccgcaggggucgaagagauggagagguacuggcccaagaucaaggaaagugggaguuagaaaauaaauuccucuuucuugaaucugauaaccuccuuuuucauaaugcccauguguuucucccuagguugaugccacagcaucuagcaucccagagcuagagcgccagauagaaaaacucagcaagguauugugcuucuaaccucccaagaguuggagauaugggcugggcaagaauugaucagcuucuuuuuuaaacugaauuuuaauuuuuauucuuuugagaugggguuucuguuacccaggcuggagugcaguggcacgaucauggcucacugcagccucagccuccugggcuuaggugauucucccaaguagcugggacuacaggcaggagccaccaugccuggcuaauuuuuguguuuuuguagagacaguuuccauauguuaccaaggcugguucugaacuccugggcucuagcaauccaccugccuuggccucccaaagugcugggauuacaggcgugagccaccgcucccaaacuuaaucaccuucugaauuaggcccagauggcaucacuuuuauagagggacugagagccauugccuuucucugauauacuggaugaauucaccacugucacucuggaaauguguuuauucaucuucauuuucauugucuacccagcgucagcuuuucuuucgcaaaaagcugcuucacucaucccagaugcuucgggcggucucccugggucaggaccgcuacagacgucgcuacuggguauugccguauuuggcugguaucuuuguagaaggaacagaggggaacuuagguaggugugccugugggaguguggauucugaguccuaucaaacaagaauuaaauaauuccuuuuccuuaguagucuugggcuucuuucauuuucugauaauauagcguaaugguuaagagcacagauuuuagaguaaagcugccuacccaccugcucugccauuuccagcuguaugauucuguuucuucauuugugaaguugagauaauaauaguguauguacuucauaaggcuacugagaggauuaaaaugaguuaagucucuuagaauaauacuuaacccguaguuguuucgcaauaaauguuagcuuaugauugugcugcugcugcugauuacuugggagaauaguguuucuuccccagauacuguguucauuggcauauaagcucuucccaguggaaucucaaaaaagggggacuaaguccaagagaaaaagaaaguauagguccuaaguuuauauacccucuuacuuuucccuuguaugucagcauauggcuuaacucuuuacuucucuuuacaguuccugaggaggugauaaagaaggaaacugacuccuuaaaaguggcagcccaugcgucacucaacccugcccucuucucuaugaagauggaguuagcuggcuccaacaccacugccaguucuccugcccgggcccgaggccgaccucgaaaaacuaagcccgggucuaugcaaccuaggcaucuuaaguccccugucaggggucaggauucagaacagccccaggcccagcuucagccugaggcucagcuucaugcuccugcccagccccagccucagcuucagcuucagcuucagucccauaagggguuccuggagcaagaaggcuccccuuugucacugggucagagccagcaugaccucagccagucagccuuccugucuuggcugagccagacucagagccauagcucccuguugagcagcucaguccucacaccugauagcaguccgggaaaacuagacccagcuccaucacaacccccggaggagccagagccugaugaggcagaauccagcccugauccucaagcacucugguuuaacaucucagcccagaugcccugcaaugcugcccccacaccgcccccugcaguuucugaggaccaacccacucccuccccucagcagcuugccuccuccaagccaguaaguagccagaauuaguaguaugcacuugauuucaucuugccacaggcaccauugccuggguguggagcugcugccugaaguugagggaaccuauaaacaugaaaacauccucauuuccuuaugucucauuuuauucacagaugaauagaccuagugcugccaacccuuguucuccagugcaguucucuuccacgcccuuggcuggguuggccccuaagaggcgagcaggagacccuggagaaaugccacagagucccacagggcugggacagcccaaacggagagggagaccucccaguaaguucuucaaacagauggaacagcguuaccuaacccagcugacagcccagccugucccaccuggugagugaccuuggagugagggcauccggugugggcagugcuucacagcuggcgccccacauauaucucaucugcucacagagaugugcucaggcuggugguggauacgagauccugagauguuggaugccaugcucaaggcccuacacccccgagguauccgggagaaggcacuucacaaacaccuuaacaagcacagggacuucuugcaggaagucugccugcggcccucagcugguaaauacauuccuacacccagcuugagcugaagagcccaggauaagcauugagcugcugcuagggacaacagccugaugggccucucccucugccaccucucuucucagaccccaucuuugagcccaggcaacuaccugccuuucaagaagggauuaugagcuggucccccaaagagaagacauacgagacagaccuagcagugcuucaauggguagaggagcuggagcagcggguuaucaugucugaucugcagauucggguaugcugggauuggcacuguguaggaagguuggggaaaagcauuagucccuuaugcccuguuagaaaaaacccugggucccuacuucacaggugaccuaccuuaagugggucuuguuuuuguuuuuuuuuuuccuaugccaaauuuuccuccuuuuacagugaguuuuauuccucucucuuaacugaagggcuggacauguccuagcccagacucuacccgugaagacuuggccuacugugagcaccucuccgacucccaggaggauaucaccuggcgaggucggggcagggagggacuggcaccucagcguaaaacuaccaacccuuuggaccuggcugugaugcggcuggcugcccuggaacagaauguagaacggcgguaccugcgggagccccucuggccaacucaugagguugugcuggagaaggcccugcuuagcacaccuaauggugccccugagggcaccacuacagagaugugagugacucccacccuccauucuuggucuuggagagaaagggauaaguucccucuuuaguggauccgcuccuucuccaaagaucaccacuuucucccuccagaucauaugagaucaccccucgcauucgugucuggcgccagacccucgagcggugccggagcgcagcccaggugugcuugugccugggccagcuggagagguccauugccugggagaagucugucaacaaagugguaagaggcugagagagccuggagaggcugaggggccagccagcaggggcgggguggggucacuggcagguagaggcuggagagcucauucugccuccucacaaccuugguccagacaugucuagucugccggaagggugacaaugaugaguuucuucugcuuugugaugggugugaccguggcugccacauuuacugccaucgucccaagauggaggcugucccagaaggagauugguucuguacugucuguuuggcucagguaaggcuucugcucuuucuuucccacacucaaacagaaaucagagauuauccucaaucucuccucuccuuggaaagaguccuagacuggguauuaggggaccuggguucuaaguccuuuuuuggacaagucacuuaaauucuauagcuuuaauugcugucucuauaaaaugagaauaacuauaccuucccuuuuaccuacuucauuggguuaugugaauaaaccaaugccggcuuaugcaugauaguauuuugaagccuuaaaucauauuuaggcagagauuguaguagggcaagcagugcaucuccagcuguugcuaaucucaccuguuuccuauacuaagcagguggagggagaauucacucagaagccugguuucccaaagcguggccagaagcggaaaagugguuauucgcugaacuucucagagggugauggccgccgacgccggguacuguugaggggccgagaaagcccagcagcagggccucgguacucggaagaagggcucucccccuccaagcggcggcgacucucuaugcggaaccaccacagugaucucacauuuugcgagugaguugagugaauccuggggggacaguuggcucuaccucugccagaggaaagggcugggaggggucaguauauuugcuuccugagauggagccaucauugucccucuaaugauaggauuauccugauggagauggagucccaugaugcagccuggccuuuccuagagccugugaacccacguuuggugaguggguaccggcgcaucaucaaaaauccuauggauuuuuccaccaugcgggagcggcugcucaggggaggguaaguagaugugggugaaccgcccggucuuugcuacugcugcaacuccuacccagcucacaguuuugccccugcccuguccagguacaccagcucagaggaguuugcggcugaugcccuccugguauuugacaacugccagacuuucaacgaggaugacucugaaguaggcaaggcugggcacaucaugcgccgcuucuucgagagccgcugggaggaguuuuaucagggaaaacaggccaaucugugaggcaagggagguggggagucaccuuguggcaucuccccccaccuuccaaacaaaaaccugccauuuucaccugcugaugcugcccuggguccagacucaagucagauacaacccugauuuuugaccuugcccuuggcagugccccacauccucuuauuccuacaucccuuucucccuucccuccucuugcuccucaaguaagaggugcagagaugagguccuucuggacuaaaagccaaaaaaagaaagaaaaaaauaauuuuucuuuucuguuuuauuugcuaauuaaaaauggggagggggaaagucgucccuacuuccuccucccugcuuccucuccuccccuguacgugccccagcauucugggguuauuuaacaauagcaauaguucuagugaaugugugaaaccaagaaacacucuguacugugugcggacccgcagugacggccaguaaaguggacuuaacucccaagugugucgcgccggacaccgggcccuggacaugcugcuuccauguucagucccuucccugcuucucgcugucuuucuuuucccaccucccaccccccaguuuucagauuuucucucauccaauaauguaaaacuaucguguacggguuccucccuccuuuucucuucucccaaaucuuuucccuucaaaggaaaaaaaaauguucagaggucccugucuucuguccccaucuuccugccgauagcuauccccuguaugauguuggaugcuccucacaugcugaguuuccagccuuuucugaaacucaguagcuggggagagggcagggaggcuuccugggccuuccagccuccuuccccaccuccuucccaaacccucuugggaacuccucagggacaacuacugcugaguuugggugcacccuaagauggaggccagguagcaauggggccggccucagagagagcgcugugugugugugugugugugugugugugugugugugucggccucagagcgcgcugugugugugugugugugugucagccucagagcgcgcgcugugugugugugugugugugcgugcuugugacccuguauuguuugauaggauccauucaguuuccccaaguaccuguuuucauucccauuuuucccauuguuuaaaaccaucacuuuuuugucuuugggaaaccacaggaacaauuucucuggagacaaggcugugucucucuccuggucauuuuuguuccagccucuucagacugugcaaucuuucagcaggaacucccucucuucucgguagcuuugaaucuuaagcuucuacgggagagugguagaacuggaucauuuccuaaucccauuuaguugugcuuuucuucauuuacuucauaccccaggaccccuuccccagcagcagagacccuggagcacaggagaguagggaggagggguucuggguccaucacugcccuacaugugacuauguccaaguuaagcccccaacacgagaggaaagcugcugacucccagcuauagccaugggcacuuggcccccugcuuuuccugcucagcagagccccucccuucagagauuacggguacuugcacuggggagguggcugcuggcuggcccaagcagagagcugaggcauccaagaaauguuccauuggggggugggggugccaggugagguggagcauuccuuguauucuggcagcacugaagagccacugaaggggguaggggcaguguagguccuggggcagccccuuuauuccuuuaugccccuucucccucauagccuauuucuaaagucgccuuuucugucagauaaaccucaaaacuuuuaauuuuauuugagauuuuuuuuugcuuuuaagagguggauugaagaauauuugaauugacuuuauauuaugcauaaauauuuauauuuuaucuaaauaacugcgcuguaacaaacuuuguguuagacaguugaaacuguuagaguugggggcucugcuuuuucccccuggcaauuuuccccugguauaagaugugcuagauuaauuucauugugagguggaugggggagugaaauugugagguggaugggggagugaaaucuccaugguuccugcuuuguguuccucucccagcuccaucucuuucccuagggaccaggcacucauauggcggggugggguccuagccucaguuugaagaagugggggcuggagcgggguugggggugguagggauagggcaugaucaaaggggccauuucuugcuuuucuuuccucaucuucacugcccccuugagcuagguggauuuucucuucaugacaagaguauuugguagggaaagcagguuuaaaauaaaaagacaacccacccccugcccuuuugcuucccucccaucagucugguugacaggaagaaaccacaccaucaacaccaacaaguuucuguguuccuuuuacagcaaaagggacuuuuuauauaaccaaaugugguguuuuagugacuuuuugauaauguacaguuuuuugugaauuuaaauuuauuucuuucuauauuuuuaggaccaaucucauuuuuaauaagguuaaaaagaaaaaaaaagucuagcgaaaaaacuccuguuuuugccaugugauguuccacaagugcagcuguagaaaagugcuugucaguuguugaauaaaaaaaaccacauuugauagagauu

SEQ ID NO: 16452 - RNA, 369 nt, Homo sapiens
ugcaggcacucagaauaguccagcauuuggcauagcgacguaggcuuuccuacaauacagcuucuaacaaaacuaggcuguccugaaccccugguaauagaauuguucaccuuuauaccaagaagguugggaaagcaccaaaaucugcaugugguguguacccaggccgacuucgagggguucgugcuguaagaccuaaaguucuuaugagauuguccaaaacaaagaaacaugucagcagggccuauggugguuccaugugugcuaaacguguucgugacagggucaagcgugcuuuccuuaucaaggagcagaaaaucguugugaaaguauugaaggcauaagcacagagucggaaagcuaaauaaa

SEQ ID NO: 16453 - RNA, 369 nt, Homo sapiens
uuuauuuagcuuuccgacucugugcuuaugccuucaauacuuucacaacgauuuucugcuccuugauaaggaaagcacgcuugacccugucacgaacacguuuagcacacauggaaccaccauaggcccugcugacauguuucuuuguuuuggacaaucucauaagaacuuuaggucuuacagcacgaaccccucgaagucggccuggguacacaccacaugcagauuuuggugcuuucccaaccuucuugguauaaaggugaacaauucuauuaccagggguucaggacagccuaguuuuguuagaagcuguauuguaggaaagccuacgucgcuaugccaaaugcuggacuauucugagugccugca

SEQ ID NO: 16454 - RNA, 3102 nt, Homo sapiens
cucagguggggcaacauuccccuggaugaugcugugcaguucaaccaucuggagguggucaaacugcuucaagauuaccaggacuccuacacacucucugaaacucaggcugaggcagcagcugaggcccuguccaaagagaacuuagaaagcaugguaugagcacaggucauggacagccccugcucaagaaaaagcaugagcuggccacacauguaauccauaaccaccaaaaauacuauggagagcuacacugcuucaguggggaccaagcagucauuuggugacuuaggcuagugcuuucuaugggagucaaaauaccccauucccucagcagacagaguacagagaagggccucagaggacaccugcaguacagcuauccagagagacugggcuucaagguacagccuaauggcuugccccacucaaaaccaucccagcucuucacccaggucuccucuuccucucccugaagaaaccaucaugagagagauacucugguggagggacucuagcuaccaugcacauguacauauccacagaauaugggaagugggaauggcuauauacauggcuuuaguagucuggagaaaucuacuccccuuggccaggacaugcugcugcuacugcuaacagccaauuuuauagacagagaaaguauuuuguguucaaauaaacuuuaauuaccaaaucauuuuugcuaaacccaguccuucuuucuucccuagggguaucuagcuucaucaccaucauagaagguagaaaaagauggaaucacagggucaaagcacagcuucucuaccuacccuaccaaacaguacauauucacuuaccccaccagguuuuucucaacuccaaauacugcuuuagguuaaguguauucugcugccaagggaagcauagguuugagucuaaacaggcucugaaacagauugugcaaaaccucaggccuccuuccuuccucgggaaguuccaacuguggcagaaaugaagauggaacuucucaagaauaaacaguuuuggccgggugugguggcucacgccugaaaucccagcacuuugggaggccaaggugggcugaucacaugaggccaggaguucgagaccagccuggccaauauggcaaaaccccaucucuacuaaaaauauaaaaaugagacgggcaugguggcacacaccuguaauccuagcuacucaggaggcugaggcacgagagucgcuugaacccaaaaggcagaguuugcagugagccaagaucaugccacugcacuccagccugggugacagagugagacucugucucaaaaauaaauaaauaguuucuagcacucauccccuagauaucccccaagugucucucuuccccuuuggucaagguuauaacugggauaaugauuaugacagacuggcugggugucagagguacagauuuaagguagauggacucaggguaaggauagcuacagcuguguggggcugaaggucuguggcacugagcuacuggggaaggagggcucuguuuucauuuugacacacugaguuaauaaagcacuuacugagggagccagagcccaaacucuaaaugugcuguagaaaaagggccaagucauugacugcaccacuccuucagccagagguagaaaggauuuacucuucagccaucugguagagccccaagaacaaguuacauguggacaaagggagggagagguaucauggugauuaauaaauucaaacaaagcugaaugauaagaccccaggauggaauacagucugagaaaggccugggcaaagggaggcagagggacugaaggaagcaggucaaggaagauacacccaugguagccuaggaaauuggcaguaguugguggguggggaaaaggaggguuuggcuguaugccuagcuuucacaagguaggggaugaggaagaugaucaugauauugcacagaggacccaacacugaauugugggagcuagagguugcuugaggcaaaguaaaaaggcuucggacacuuucaaaaggaggcuggccaaaggcgugauuagggacuccaguaauggacauacuagaggcccucgggcaccucaagcccugaaugggucagcagcuccccaucccagagagcaaaggcaggcaccacuggaccccggaaaucugucuguagcgugugaaccacagagaccuggcucacauccaccaggcucagcuucugggccucauacuccagcaacagccccaccuucucuggcugcccaauacccucaacuggggcuuucucguuggccaacaugguguaccacuugcgcugggcauaggugaacacccaggaacgaucaucaacaccaaugcagcuaucccgggacauguccacaucugccacuccuauccggaacugcugggagcgcuucacugucacuucccaguagugucugccacuggugaccgcugugucugccagcaccacugcccacucccggaagcgcuccacauucaaggccaccuuggugggcuccaaucccaccaagccauauuugacacccauaucaucucugaagagugccaggcugcugugggcgguuuuuucuuccaguuugaaacugacgccugcgggcagagcaaaaagacgggauaauaacaggggcuagaacccuagggcuggugauauauucagauaugaggcaggcagccaugauacacgagcaacuagggaagagucagaaugccaagcgggcaagagagucgcgaggucgcuuuacuacggauagcucacggagcugaaaaacucggauugaguaagucccggaauuuaaagaaaccaaaugguaucacagguuuggaaucuuaagaccaaggcagguggggaaggaaaagacccgagaggguuggaguugcuucucggaguggggucugggaauaauagacggcagccauucuggagguaaaagaguaaaaagagauaauccuaccucucugggccucuguggaggcaacucccaaucguuuggcuccccagcggcacaagcgcaaagaacgugcaaaaagcagcgccaucuugcgccuuggaugaaccgggcacgccucccgcuuacagacaca

SEQ ID NO: 16455 - RNA, 3102 nt, Homo sapiens
ugugucuguaagcgggaggcgugcccgguucauccaaggcgcaagauggcgcugcuuuuugcacguucuuugcgcuugugccgcuggggagccaaacgauugggaguugccuccacagaggcccagagagguaggauuaucucuuuuuacucuuuuaccuccagaauggcugccgucuauuauucccagaccccacuccgagaagcaacuccaacccucucgggucuuuuccuuccccaccugccuuggucuuaagauuccaaaccugugauaccauuugguuucuuuaaauuccgggacuuacucaauccgaguuuuucagcuccgugagcuauccguaguaaagcgaccucgcgacucucuugcccgcuuggcauucugacucuucccuaguugcucguguaucauggcugccugccucauaucugaauauaucaccagcccuaggguucuagccccuguuauuaucccgucuuuuugcucugcccgcaggcgucaguuucaaacuggaagaaaaaaccgcccacagcagccuggcacucuucagagaugauaugggugucaaauauggcuuggugggauuggagcccaccaagguggccuugaauguggagcgcuuccgggagugggcaguggugcuggcagacacagcggucaccaguggcagacacuacugggaagugacagugaagcgcucccagcaguuccggauaggaguggcagauguggacaugucccgggauagcugcauugguguugaugaucguuccuggguguucaccuaugcccagcgcaagugguacaccauguuggccaacgagaaagccccaguugaggguauugggcagccagagaagguggggcuguugcuggaguaugaggcccagaagcugagccugguggaugugagccaggucucugugguucacacgcuacagacagauuuccgggguccaguggugccugccuuugcucucugggauggggagcugcugacccauucagggcuugaggugcccgagggccucuaguauguccauuacuggagucccuaaucacgccuuuggccagccuccuuuugaaaguguccgaagccuuuuuacuuugccucaagcaaccucuagcucccacaauucaguguuggguccucugugcaauaucaugaucaucuuccucauccccuaccuugugaaagcuaggcauacagccaaacccuccuuuuccccacccaccaacuacugccaauuuccuaggcuaccauggguguaucuuccuugaccugcuuccuucagucccucugccucccuuugcccaggccuuucucagacuguauuccauccuggggucuuaucauucagcuuuguuugaauuuauuaaucaccaugauaccucucccucccuuuguccacauguaacuuguucuuggggcucuaccagauggcugaagaguaaauccuuucuaccucuggcugaaggaguggugcagucaaugacuuggcccuuuuucuacagcacauuuagaguuugggcucuggcucccucaguaagugcuuuauuaacucagugugucaaaaugaaaacagagcccuccuuccccaguagcucagugccacagaccuucagccccacacagcuguagcuauccuuacccugaguccaucuaccuuaaaucuguaccucugacacccagccagucugucauaaucauuaucccaguuauaaccuugaccaaaggggaagagagacacuugggggauaucuaggggaugagugcuagaaacuauuuauuuauuuuugagacagagucucacucugucacccaggcuggagugcaguggcaugaucuuggcucacugcaaacucugccuuuuggguucaagcgacucucgugccucagccuccugaguagcuaggauuacaggugugugccaccaugcccgucucauuuuuauauuuuuaguagagaugggguuuugccauauuggccaggcuggucucgaacuccuggccucaugugaucagcccaccuuggccucccaaagugcugggauuucaggcgugagccaccacacccggccaaaacuguuuauucuugagaaguuccaucuucauuucugccacaguuggaacuucccgaggaaggaaggaggccugagguuuugcacaaucuguuucagagccuguuuagacucaaaccuaugcuucccuuggcagcagaauacacuuaaccuaaagcaguauuuggaguugagaaaaaccuggugggguaagugaauauguacuguuugguaggguagguagagaagcugugcuuugacccugugauuccaucuuuuucuaccuucuaugauggugaugaagcuagauaccccuagggaagaaagaaggacuggguuuagcaaaaaugauuugguaauuaaaguuuauuugaacacaaaauacuuucucugucuauaaaauuggcuguuagcaguagcagcagcauguccuggccaaggggaguagauuucuccagacuacuaaagccauguauauagccauucccacuucccauauucuguggauauguacaugugcaugguagcuagagucccuccaccagaguaucucucucaugaugguuucuucagggagaggaagaggagaccugggugaagagcugggaugguuuugaguggggcaagccauuaggcuguaccuugaagcccagucucucuggauagcuguacugcagguguccucugaggcccuucucuguacucugucugcugagggaaugggguauuuugacucccauagaaagcacuagccuaagucaccaaaugacugcuugguccccacugaagcaguguagcucuccauaguauuuuuggugguuauggauuacauguguggccagcucaugcuuuuucuugagcaggggcuguccaugaccugugcucauaccaugcuuucuaaguucucuuuggacagggccucagcugcugccucagccugaguuucagagaguguguaggaguccugguaaucuugaagcaguuugaccaccuccagaugguugaacugcacagcaucauccaggggaauguugccccaccugag

SEQ ID NO: 16456 - RNA, 2230 nt, Homo sapiens
ggugguucuuagucaauaacccucuucccacaagagccuuucuaaccuccacugugaggccugaaauggggagcaauaagaccucauacuggcuucccaguucuccaaguuccuucaugcgcauucucucccaugaaaccaggaccauccaguugaaauaauguuguuuccaacugagaaaaagaagcccguuuauuccuaauagggggcaucagguaggaaucaaacuucauugcaaacagcucaccauccuauugggagaugaauggauguuucucuguuuugcuuuuuccucaagcaggaggaagugaggaaauuagguuuggggugggguagggguauagcuuugagaggcaaaaagaucagggaaagaucaaacaggaaggaacuugagaccagauuaauuuaaauauuuguucucccuuaccccucccaccccauccccgcugugccccccauccccgccccuucuauagcuauuucgauuccuggagagcauuacacaugugucccaucccaggccucuagccacagcaaccacacuacucauuuccccuggaacugaggcugcauaccugggcuccccacagagggggaugaugcagggaggggaaucccaccugcugugagucaccugcugguauaaagggcgggccuuacaaugcagggaccuuaaaagacucagagacaaagggagaaaaacaacaggaagcagcuuacaaacucggugaacaacugagggaaccaaaccagagacgcgcugaacagagagaaucaggcucaaagcaaguggaagugggcagagauuccaccaggacuggugcaaggcgcagagccagccagauuugagaagaaggcaaaaagaugcuggggagcagagcuguaaugcugcuguugcugcugcccuggacagcucagggcagagcugugccugggggcagcagcccugccuggacucagugccagcagcuuucacagaagcucugcacacuggccuggagugcacauccacuagugggacacauggugaguggcagccccuggagccuaacaggaguccaggcucuccaaggcuguggcagaagaccgugaccuugaguggaagcuggaggguugaaggccauuagggaguaagagaggacaagagaguaggguuccugggagagucaugggccugaggguccagguuggcuucagaaguacuaucuuacuucuucauucuuuccaccucuuccuucauuccaggaucuaagagaagagggagaugaagagacuacaaaugauguuccccauauccaguguggagauggcugugacccccaaggacucagggacaacagucagguaccacugggauguggcugggcaaugaaggagaggggacugagaacauggcuggguaccaugguaaaccagaaguugugucugaaaauaguaagaaacugggugagucuucagugaauggaguaggaagaggguguccucuuucauugcuuucuuuucucccuaguucugcuugcaaaggauccaccagggucugauuuuuuaugagaagcugcuaggaucggauauuuucacaggggagccuucucugcucccugauagcccugugggccagcuucaugccucccuacugggccucagccaacuccugcagguaugaaguaggggcguggaggaugggggcuugcaggugucagagacagaggguuggggguuaaggguuuagagucuucucugacuguguccuauguccuuucagccugagggucaccacugggagacucagcagauuccaagccucagucccagccagccauggcagcgucuccuucuccgcuucaaaauccuucgcagccuccaggccuuuguggcuguagccgcccgggucuuugcccauggagcagcaacccugagucccuaaaggcagcagcucaaggauggcacucagaucuccauggcccagcaaggccaagauaaaucuaccaccccaggcaccugugagccaacagguuaauuaguccauuaauuuuagugggaccugcauauguugaaaauuaccaauacugacugacaugugaugcugaccuaugauaagguugaguauuuauuagaugggaagggaaauuuggggauuauuuauccuccuggggacaguuuggggaggauuauuuauuguauuuauauugaauuauguacuuuuuucaauaaagucuuauuuuuguggcua

SEQ ID NO: 16457 - RNA, 1012 nt, Homo sapiens
guggccuuuagaaacaguaauaacagcugagcuaaagugcucugagacaucucacaaccuagacccauuucaaaguaauuagaguucacaggacccacgaauccuucagaauaacaagucccaauuugccaugcucaucccccucugagggauaacguccagccagccucaagagcuaggggaauuugauaaccaggggcaucuuguuacccgggaauguuaccggggucucuggggagggaacaaucacggaugggaguuucagauggaugccuguagaagaugcagccacuuggacugugucaggaguccggcucccgcuuccuuuuuuuucucucccauaucuggaaauaauaggaaaugccagcgaguuuugggggcaacagggucagagguggcggaguggcucacuagggcaccgcaggaagaggagguagacuaagccccgcugggaauacccaacagcgacuccuagugcuuugccuugugugucccuuauuuuagaguuccuaaaguuauagaaagcauaaaaguuugguuuucaaaccuagacguaauuuuguucaagaagacuaaaaacagaguuacuuucuaacgccacccaacaaguccggcgucuggcugcguuugucccaccggcgccccguaaccucuuuuuccggcgcgugcgucacacgcucucuccuggggucgccguaccuggcuccuucugauuggcuuagaugcgcccggagcccuucugauuggcuaaaauaugccccgagcccuucuugauuggaagaagcgccucggaccccgguccuuggcgccguagugguuagguugagcccuaggcgugggggagaacuggggaaacuggaauuucccgcggagcugacagcgcuugcgcucccccuacucguucuaauuccacgcgcuccaaaauauccgccauggagaaaucuugguaaugacccauuccccguaagcaucccaggaacacaucugacccuugcccuaucccccuccucac

SEQ ID NO: 16458 - RNA, 1012 nt, Homo sapiens
gugaggagggggauagggcaagggucagauguguuccugggaugcuuacggggaaugggucauuaccaagauuucuccauggcggauauuuuggagcgcguggaauuagaacgaguagggggagcgcaagcgcugucagcuccgcgggaaauuccaguuuccccaguucucccccacgccuagggcucaaccuaaccacuacggcgccaaggaccgggguccgaggcgcuucuuccaaucaagaagggcucggggcauauuuuagccaaucagaagggcuccgggcgcaucuaagccaaucagaaggagccagguacggcgaccccaggagagagcgugugacgcacgcgccggaaaaagagguuacggggcgccggugggacaaacgcagccagacgccggacuuguuggguggcguuagaaaguaacucuguuuuuagucuucuugaacaaaauuacgucuagguuugaaaaccaaacuuuuaugcuuucuauaacuuuaggaacucuaaaauaagggacacacaaggcaaagcacuaggagucgcuguuggguauucccagcggggcuuagucuaccuccucuuccugcggugcccuagugagccacuccgccaccucugacccuguugcccccaaaacucgcuggcauuuccuauuauuuccagauaugggagagaaaaaaaaggaagcgggagccggacuccugacacaguccaaguggcugcaucuucuacaggcauccaucugaaacucccauccgugauuguucccuccccagagaccccgguaacauucccggguaacaagaugccccugguuaucaaauuccccuagcucuugaggcuggcuggacguuaucccucagagggggaugagcauggcaaauugggacuuguuauucugaaggauucguggguccugugaacucuaauuacuuugaaaugggucuagguugugagaugucucagagcacuuuagcucagcuguuauuacuguuucuaaaggccac

SEQ ID NO: 16459 - RNA, 1665 nt, Homo sapiens
uuuccauguuccucauauucaagaaaauaaaagcucuaaucucuggccaaacccaaguaaaaccuugggacccugaugaaagguuacuucuuuccccaacaaagagguuucaggaugaguacuccuucggguucuagcucuccuuugcucaucgaucccuccuacccaaucccauaugcccuucauaccugacugagagaugauagcaagacgagaaguauauguaggaaugaagcgcaagaaggcaggauccacauguacuugaaguggugugauggcacgcaucaugcgcaaaucauacaccuugaggaaacggucgcaggccaggccagugaggcggcuggagaagccacaggcagcuagcagguugccaugcacaucaaagucugacagacuuccugagaaggcaucaaacucauguuccaccuuaaaaguacggaggucucucagggaaaccuagaaaaaaaaaauucaguuaucugcaaauucuguuaucaggaaaaauaccugccaccuaccuaacccaguggggucccuaccaaaggaacuagggcuuuaggacagggaaaguuaaagcacagaaaaggcaaacagagaagcccagagccagaaggggcuucagggagacuucauuaucauagaaaacaucaagcugcaaaauaaucucauaguagaacaucacugaguaggaagugaauucacuccacucaucccucaccuccaauccaacuacaccccagaguuaagggaaagcagaucgcaaucagguaucuagugaaacagggcccugcagugggaggagaaauggaacuuggccaccuugccagacguguggccgcagaagaagaagcgauuugucugucucaugauggugacuccaggcgucucuacugcauacuggagagggaagcaggaaaaaccagugagaagaaugauuuuucccacagaccaagggaacagaaaggucacacccacaucucaggcacauuaccagcccaagcauacccugcccccgcaacaaccucagaccccacauaggucuuucuugccccaagcuuguaccuucugagucuccuggacaguguuaagaucaaucucuauuaugugauucugcagcccaccaacgaguagagugcugcugucagucaguaggagacugugcauauccucauucucauccagccugguggggagaggaaaggcuaaggggcccaggccuuacaagcugccaaucccuuagccuucccacccuaugaggcauccucguuccuaguccagagcugagaagccacuuacagguaaucaaauauaaugaggcccccacgggccauauacuugagguuguucuuggugagaaaaaggauaccauucuccaggcucuggaucugccgaauaucaucacugccauugacuugaaaggaugaguagcgcuccaaggcugggccaaaaaaugaaguggcauggcccuauagaggacaaagacaacagagacacuuagaguggaggggcaagggccacccuacggccaggucagggacugaacauggcucagcuuggauccuuucuugcuuggccuuugugacuaggagcaacuggggcaaaaggcuaggaaccagucaaucuuagugauaaagacacugauaauacugucuuauguuuguuuaa

SEQ ID NO: 16460 - RNA, 6079 nt, Homo sapiens
ccgggguccuugcuguucgggagccucuccuaagcugccuguucgcgcgagaguuuggaggggcggguuuggggucggugucugauuggggcucgcaccgcagcacgcuggagucccgcuuagguaccaguuagcgucaggggagcugggucaggcggucgccgggacaccccguguguggcaggcggcgaagcgcucuggagaaucccggacagcccugcucccugcagccagguguaguuucgggagccacuggggccaaagugagaguccagcggucuuccagcgcuugggccacggcggcggcccugggagcagaggugggacggaugcgggcggcgaggcgcugggcgcugaggguuggggauggacugaagcgaaagcaauggcggaguccuuagaaagggggcugguguccguacggguaaucacuuacgggcuggagguggggacgcaggaaucuucggugcaggauccaaaugggcccuaguuauugcucuccucgcuggccuccuggccugacugagggcucccugccggcaguucccuagugccuguaguccucacguaaucgccaacuuaccuccuguagcugccacaaagccccgugaacccuaggcaugcagugcuaaaguaccaacacuuagggccucaccuauccacguagagucuggggcugagccgcaaguccugagcucgcgcucccacccaccacccugggggaaucagagcccucaagcgcuggaacagagaagccccuuugugucccggccauuuccuggaaaguagagccagagucacaaugaggccuuugaaagccuuggggugaggauugggggggucagggaaaaauggagucggcuccucacacuuauguuuuauucccacucaaacccagguggagcgaccccauuacgcuaaagaugaaaggcugggguuggcuggcccugcuucugggggcccugcugggaaccgccugggcucggaggagccaggaucuccacuguggagguaaaggcacaacgggaaaaagaaguggaggaagcagagccuugggagggcaugagauccaaggccugggagaaggaugaauggaaauccuggguugaucccauucuccucacacccuacccccuacccuguccccugcucucauucucuccucuuccaccagcaugcagggcucugguggaugaacuagaaugggaaauugcccagguggaccccaagaagaccauucagaugggaucuuuccggaucaauccagauggcagccagucagugguggagguaacuguuacuguucccccaaacaaaguagcucacucuggcuuuggaugaaauucgacugcuuaaaaaggaccuugguuuaauagaaaugaagaaaacagacucagaaaaaagauuuggcucugucucauuuggaagaagcugcaggcuuauuccccaugcacuugcuuccuggcugcaaaccuuaauacuuuguuucugcuguagaauuuguuagcaaacagggaguccugaucagcacccuucuccacauccacaugacugguuuuuaauguagcacugugguauacaugcaaacauccguucaaaaucugagucggagcuaaaaauaaaaaaugaaaaaacagaaauaagaauaaaaggucuuauccucauaauuaggaaauuuuaaucgaaaacaacacacauguacacaaagguguaucuaauaagcaauauauaaggcaguguuaagauuacagugcuagccugggcaucauggcaaaacaccaacucuacaaaaaaaugcaaaaguuagcagugcaugguggcaugugccuguagugacagcugcuuggaaggcugaggugggaggaucacuugagcccaggaggucgaggcugcaguaagccgugauugugccacugcacuccagccugggaaacacagcaagacccugucucaaaaaaaaaccaaaacccagcacuuugggaggccaaggcaggcggaucaccugagguuagaaguucgagaccagccuggccaacauggugaaacuccgucucuacuaaaaauacaaaaaaguagccaggcgugguggcucaugccuauagucccagcuacucaggaggcugaggcaggagaaucacuugaacccaggaggcagagguugcagugagccaagaucgcaccacugcacuccagucugguugacaagaacaaaacucugucuugaaaaaaaaaaaaggccgggcgcgguggcucacgcccguaaugccagcacuuugggaggcugaggugggcagaucacaaggucaggagaucgaaaccauccuggcuaacauggugaaaccccgucucuacuaaaaauacaaaaaauuagccgggcgugguggugggugccuguagucccagcuacucaggaggcugagacgaaaagaauggcgugaacucgggaggcagagcuugcagugagcugagauggugccacugcacucuagccugggcgacacagcgagacuccucucaaaaaaaaaaaaagaaaagaaaaaagauuaugguacuuuaauagcuguuguucacagagccuacacuacaucuuuaauacugugcuuacugaggauauuagucucaauuuaaacaaaauuauuauuauuuuuuugagauggaguuuagggcuuguugcccaggcuggagugcaaugacacgaucucggcucaccgcaaccucugccucccggguucaagcgauucuccugccucagccucccgaguagcugggauuacaggcaugcaccaccacaccuggauaauuuuguauuuuuaguagagacaggguuucuccauguuggucaggauggucucgaacuccugaccucaagugagccacccuccucggccucucaaagugcugggauuacaggcgugagccaccacgcccggccaaaaauaaaauauuaaugaacacauggacacagggaggggaacgucacacaucagguccuguugggguguugggggcuaggggagggauagcauuaggagaaauaccuaauguagaugacagguugauggguguagcaaaccaccauggcacauguauaccuaugcaacaaaccugcacguucugcacauguaucucagaacuuaaacuauaauuuaaaaaaaaauuaucuucaucuauagaaauuagaaguauaaguugaucagguuaaucaaaaaauucuguuuauaacuuggagcuaauguuaacugucuuguuucuuagaauuguacaaugaggugccgggcacggugguucaugccuguagucccagcacuuugggaggcugaggcggguggauuaccugaaguugggaguuugagaccagccugaccaacauggagaaaccccgucucuacuaaaaauacaaaauuagcugggcgugguggcacaugccuguaaucccaacuacucgggaagcugaggcaggagaaucacuugaacccgggagguggagcuugcggugagccgagaucgcgccauugcacuccagccugggcaacaagagugaaacuccaucucaaaaaaaaaaagaaaaaaaaaaagaauuguacaaugagguaaaauaaaaucauauaguugaaacuacugccaaguacaguggcucauaccuguaaucccagcacucuuggaggccaaggcaggcagaucacuugagcacaggaguucgagaccagccugggcaacauggcaagaccccgucucuacaaaaaaaauauaaaaaaguagcugggugugguggugugcaucugugugaggcugagaugggaggaucaccuaagccugggagauccaagcuguagugagccucagucaucacaccacugcacuccagccugggcaacggagugaggccugucucaaaaaaaaaaaaaaaaaaaaaaaaaagaaguacuuugaaacuaucaaguaaaccauauuaauuuaaaaccaggccgggcgcgguggcucaugccuguaaucccagcaccuggggaggccaaggugggcggaucacuaggucaggagaucgagaccauccuggcuagcacggugaaacccgucucuacuaaaaauacaaaaaauuagcugggcgugguggugggcgccuguagucccagcuacccgggaggcugaggcaggagaauggugugaacccuggaggcggagcuugcacugagccaagauagugccacugcguccggccugggcgaaagagugagacuccgucucaaaaaaauaaauaaauaaauaaaauaaaauaaaugaaaaccacacuaggccaggcacaguggcucacgucuguaaucccagcacuuugggaugccgaggcaggcagaucaccugaggucuggaguuugagaccagcccgaccaacacagagaaaccccaucucuacuaaaaauacaaaaguuagcugggugugguggugcaugccuguagucccagcuacucaggaggcugaggcaggagaaucacuugaacccaggaggcagagguugcaauaagccgagauggcgccaaugcacuccagccugggcaacaagagcaaaaccccaucucaaaaaacaaacaaacaaacaaaacuaauuaaaaucaauuagggaaagcuuuuuagaauagguuguuggagcuagauuuggaaagaaaaguaaggauauaaauuacuaauguacagagguagaagagagugacccaaggcugaggacauuucuaggugccuuaugcccgcucagaggcccaccucacagagcugcuggaggagauaugugaccggaugaaggaguauggggaacagauugauccuuccacccaucgcaagaacuacguacguguagugggccggaauggagaauccagugaacuggaccuacaaggcauccgaaucgacucagauauuagcggcacccucaaguuugcggugagcuaugggaaucgguagcugguucuuggacauuaagggguuguuggagaaccaauuagaaaguuaggcugauauccuuguccuccucuuuggaagugaaggcaagaggccucuuauugcccugugucacccauuucucccuuggguuggcagugugagagcauuguggaggaauacgaggaugaacucauugaauucuuuucccgagaggcugacaauguuaaagacaaacuuugcaguaagcgaacagguaagcugcccccacuuuaucuccuguucuaguagcucuguggaaccugacauucccuaacucacccauacacccccaucccagaaaccucugguauuaggucaagagcugucuuccauuucccuuggcuuagggacuugggguguuccuccacauuuucugucagcuuucagaauuuguguccccuugacccugagauacaggugagaggacaguggggauguuuuaucauuuauaagcauauauucugcagaauggugguugguguguguuugugucagcuuggucugggaaauuuucuugauacuggcagauaucaguaugagaauggcauauuccuuuaaauuguuugccauuugcagaucuuugugaccaugcccugcacauaucgcaugaugagcuaugaaccacuggagcagcccacacuggcuugauggaucacccccaggaggggaaaaugguggcaaugccuuuuauauauuauguuuuuacugaaauuaacugaaaaaauaugaaaccaaaaguacaaacuguguugucuuuucaugccuggaauugcccuuacauuaagcuugaagauaaggaguuauauagacaggaaagauaauggaggagaaagaagaguuuugggauugauacaggauaaagguaggagaggccugaaccuuuaauucuucuaccuucugagauuccacuccacucauaaacuagauaagcuuucagucagugcccacucaauaccacgucuuuagagucuaauuguggagaauagaggaaccuccaugaggaagcaggggaacauaguguaugguaguguagaauucuagaaaucccuuguguucauggcuguugaaacauaaaguaagacagggcuuggucuugaaggaaauaacgga

SEQ ID NO: 16461 - RNA, 931 nt, Homo sapiens
acgaacuggauggggagggggagaaaaggcacugaggaacaguuuccuugcauuuggccagggacuauccaacauggucuggaaguuucugacugucucuuacccauucccagauuuccuuugaauuucguucucugcugcacucccagcuggccaccauguuuuuugaugagguugucaaacagaauguugcugccuuugagcgucgggcagccaccaaguuugguccagaaacagccaucccccgugaacugauguuccaugaggugcaccagacuugaggcaagggauugcucccugaccucccuucuaccccacuucccuacacaauucucuuauuuauuugguuuggcuccuguuccaauuugaaaggagucuguguucauaauacuguuucuccucucaauuucccagaaauuggguucuaugcuggcuggaaauguugggggaaagagaaggcaaaggauguggaaaugagaugugcuuaggaaagggucaggcccaucguaggagcaccauaugccugcagccuuuucacuacgaauuagaauaaggacuaugugguugucucuggaccuuaucaagacaccuuagugucugaccaggggacgauaguaacuuuucuaaggauugaauaaauugagcuuuucuucuggcacagagguacugagugguaaguaacuuuuacccugccugagauuccucaggagaaaaggcaaccugccuccagccugaaauacauaaagccucauuuuaagacuguaaguccaugcugccuggcuacuagagagcaaggggcuuucuuaccaccagugcugaggagaaaaguacugaacggaaacggaguugucuuuguacucuugaguuguaccuuauucuuccacuuggccugaguuuuuauaaaauuucaauaaauugugacagugugaau

SEQ ID NO: 16462 - RNA, 1226 nt, Homo sapiens
cacagauacagccacaggagccauggagacagguggaggugccauucccugggcaauuguuugagccagggcagcugacaguggcgugaucucuggggucaagugugggggugggggugguggagcagcaggaggugcagcauuaguugggggagcagcuggagcuccagcaggggccaccaguucuugcugggacacuggacgaggcuguagagccuggcugcugagaguagugugagucugggcaaugccaugguuaaaaguggcaacagugcccacagugggggccagagucugcucagucgcuggugcaguggagcucaggguuaugaccuuggccugauugcggaacugagcauuuuguuccaguaguaccucauugguggccagcagguugcugaccugcuucuuuaacuccucuacccgcuuccugagcauggcauucuccuccucuagcagucugcacuccaccccucgcgguggagccaaacuauauucauaugacucaaaaugagggccaucaggggggcagcauccaccucgccggcguuuugggccuggcucaugguccucaaagccccugucaggaaggucauagauaucauagagaucaugacgucguccugggaggacugagccuguugagcccccaccagugccuccuccaccccgagcaucaaacucaaaaucccguugcaggugacggaacuugcacuuggcuccucucugacagucacccuugagaaagucacggcagauagggaccuccuccuugccauuugguaggucagccggugaaaggccaaggccagcugcuacuuucugccucagccgugggggaagcucuccugucuucuuauagccauccucauccuccuuggagccauggaugaaacggcaauuugggcggcuacacuccuuguucuggaagucauggcagaagaugaacucguuuuugcucacccccaaguuggacaccucgcucaugucuggguggcgauaucggcaacgcuugccucgcuugcacacauuccucaagaagucucuacagauggcaucugagcuggccccgccacugccuaccccugccccacuggccuccucgcugccaccaccuccagggccuccaccgcugcucccgguaccguuggcauagcugucccggucaggcauccuggucccgcccaacucaggguuuucuuuaucuugccacucuuggugaccac

SEQ ID NO: 16463 - RNA, 9576 nt, Homo sapiens
cauuaugagcaaauccaaauuuauuuuaaugucaugucauuuucaauguguuuaaaaaccucauaaguuagugggagcccuaguuuccugggacagcaugccagagguacugaaauuugucaccuuucucuacaaacccccagcaauccaauccaaguccauagcuucagaaagccaggaguugugucuucagucagucuacgccucugguucuugguuuuucuuucaugggagggagaucacaauauuucaaacagggaacaaaaccaguugagcuuccagcucaggucuguguaagauggagcgaggaaagaccccacugacuccagagaaaaaggguaagguugagauggauuauuucuuuacagcuuugugaaaauggaagaaaaaagauuuacaaaugaggauccauuucauagaugagaaucucuucauaaaugaaggcuccagcuccuaaaaugggaggggccugacuggacagccugaaucagaugaggaaucggccacacugaauaaaaacaaucugaaaaauaauccucuuaauuuugaagccagauaaaauauuuggggagaauggaaaaaagaggaaaaagccccaaacagauggaaaaaaugcugacaucagagugguauaaaaaaauucggcugaguuuucaguggugguggcuaauuuagcccuguucuguaguggggcacaaaccuugaccaagcagagaguaguagaaaaggcuagaaagaggggcuugaagacgaugaauuuugacuccugauuuuauuauucaauuucuuuuuuucauuuaaaguagucuuccgugguugggaagccucaccucccaagaccagagucaguuggagcugguuguuguuggaagggaguggguuggggaacuggggugggggcagggagauccccccgcucugcuggcgguccuagguggagaagaacugcacuucacagagucugggguuuggugggaaggggaugaggcaggagcagcaagcuggggagaugggacccaccucaguccccagcuucauuuucuucuaauguuuccccacugguggcauucucugcagucuuggaggccuauaugcaagaaaaggagagggagaagaccugucaguuucuaacuacuuggggaugucugggaccagagauaaaaguauuuuuuuuucugagacagucucacucuguuuuccaggcuggagugcagugguaccacuucccugggcucaggugauccucucaccucagccucccagguagcugggacuauaggcauaugccaccauguacaacuuuuuuguauuuuuuguagagaugagguuucaccauguugcccgggcugaucuugaacuccugggcucaagugaugcuccugccuaggccucccaaacuguugggauuauaugugugaaccaccacacccagccauaaaguuaucucaauccucugggucacagcugaaauaaagacauacaggucucugacuuacaauggucaacuugugauuuuucaacuucacaauggcgugaaagcaauauggauauuucgauacaugauaauuuguucaauaaauguuuugagcacauucaagguaggccaggcuaagcuaugagguucaugguagguuaagguacaucaaauccauuuugagccaggcauggugguggcuacucagcaggucaaggcaggacaaucacuugaacccaggaggaguuugaggauacagugagcuaugaucaugccucuacacgucagccugggugacacagugagaucaucucuuuuuuggagacagaguuucgcucuuguugcgcaggccggagcgcaauggugcgaucucggcccacugcaaccucugccucccagauucaaacaauucuccugccuuagccucccgaguagcugggauuauaagcgugugccaccacacccagcuaauuuuguauuuuuaguagagacgggguuucucucuguguuggucaggcugaucucaaacuccugaccucaggugauccauccgccuuagccucccaaagugcugggauuacaggcaugagccacugugcccggccaaagcaaggcugggcauggcagcucaugccuguaaucccaacaguuugggaggcugagguggaaggacuguucaaggccaggaguuugagacucugucucuuaaaauauauauauauauauuuuaaaauccauuuugacuuacaguauuuucaauuuaugauggguuuacugggacaaaguucuaucauauaaguugaggagcaucuguauaaaaauccguauuucacuacaacuuaacacagugggagaaagagggaucagguucacccugccagagaggaaugaucguuaauaacacaccuucuuuuuuuucuuuuucuggguuuuucgacuugcagaacucuggaggagggccuggaaaacaggaagaagggaaaaaaauuuugagaaauguggaggaaauuaaaaauaaaggguuacuuucaguacugcagcucuuuucaggacuuugcuggcauuuagcccucacucccaagcaggauaccauguacauacucaccaccuucuauuccauacuaaccuuuagcucugcauccuggaccuccaucucagacuuguagaggucaggcucgaagggaccacugguuauccgcauggggccauugggcaugagcagaacuguaaauuuaaacugggcaacaaauucaccuauggcaaaaaugaagauguguuuugauaaaaaguuccuuugucauacuuagcucuucugaacuuacaggaaggauaucuuauaaucagggaauccaaagugaagcucuuuuuggaacucacccuccuucucauagagaacauuaaaugguugcagcaguucauguuuggcgcacuccaccacacccauccgagccuucuucucaucuucaaaugcucuggcagggaagaugauauucagagguaucuuuaacuccccaucaagucuuaccauuuugcucauauuuuaaaauagcuccuacccucaggcagaaaucaugcuuaggauugcucuuuuacauuaccuucaaugagaaggagauggggagagagagggagggagugagcacaugcacgcuacaagucuaggcaggaagggagaggaaaaaguguuccuggguguauggucugugagucagacugguuccaaguacuaucauugcuuaguaccuuaaaguaaacggcauggcaucaaaacgccuuuccaccucacugaagaaggcacgugaaguuuucauuuucaguccauacuguuuagaggggucucguuuguaaauagugguucucuguccugcauccuuggccugaaagaguaauuuaaguaacauuuggucuggugaacacucucagucaccccucuuugccaacucugguacucuccucaccuugcccucuccugagcugacgagaacauccacagcauauacuucauguaccucaaauucagcuuuuucaugguccuuccuaaaaggaauagagagaaaggaauuuuuuuuuuuuuuugacacagagucucauucugucacccaggcuggagugcaguggcacaaucucagcucacugcaaccuccaccucccggguccaagcaacucuccugccucagccucccaaguagcugggacuauaggcacaaaccaccaggccuggcucauuuuuguaguuuuuaguagagacaggguuucgccauguugguuaggcugguucugaacucgugaccucaggugauccacccgccucagccucccaaagugcugggauuacaggcgugagccaccgcgcccggccuagagaaagggaauauuaagagcaacaggucacuccugaaaacauggaguagagggcggacaagauucaguugggaguauagaaaaaaaccugaugacuagucuugugugguagaagguaauaaguaggguuggcaccuacuucugcuggucugugggauucuggauaaugguuuuuucuccaucgaugacaugcugcuucaacuggugugacagcauaccuguagauaguacacaaccuauggaacaagcuauccaguaucccaaaagguuuccaaauccacccacuucaguaguuugaagugguaggcagugagacaacuaccugguuauggaaacacagggcucugagauuucuggcuuagacuggguuauagccaggauagaucuucaagggagcaaaagccucaauucugcaaagccacucauucuuuuuuuuuuuuuuuuugagauggaggagauggaguuucgcucuuauugcccagacuggagugcaguggcgcaaucuuggcucacugcaaccuccuccucccggguucaagcgauuaucucgccuuagccucccaaguagcugggauuacaggcacccaccaccacgcccagcuaauuuuuauauuuuuaguagagacgggguuucaccauguuggccaggcuagucucaaacuccugaccucaggugauccgcccaccucagccucccaaaguucugggauuacaggcgugagccaccgcaccuggcaaagccacucauucuuagacccucaacccuguuaucuguucucaccuucuauuggcgugcaguuaaaugagugggcaacuuuguuccaggcuucugucacuuguguguucuagaaguacaacaucaaaugaaaggugagauaucaggagcuaauaaguucucuacaaugagaauaagaagcauaaaagaacugagcguuuuuuuuuuuuuuuuugagauggagucuggcuuugucaccaggcuggagugcaguggcgugaucuuggcucacugcaaucucugccucccggguucaagcuauucuccugccucagccuccugaguagcugggauuacaggcacgcaacaccacgcccagcuaauuuuuguauuuuuagaagagacgggguuucaccauguuggccaggauggucucgaucuccugaccucgugaucugcccaccucagccucccaaagugcugggauuacaggcaugagccauugcaccuggcagaacugagcguucuaauauccuccaucaagccccaaugauugucauucacugguuuuucauuucauagcuugauuaucccuacaaucuaaaaauacuuuauacagaugcuccccaacuugcaaugggguuacaucuccaaaaaacucauaaguugaaaauaucacuaagucaaaaaugcauuuaauaccccuaaccuaccuaacaucacagccuagccuauguuaaaugugcucagagcacuuaaaaaacauuauccuacaguugggcagaauuaucuaacacaugccuauuuuauauuaguguugaauaucucauguaauuuacuaaauacuauauggaaaaugaaaaacagaaugguuguauggguacucaaaguauagcuucuacugaauguagcaucaagcugaggaccagcuguaacugcauaucauuuuacccagugcuuucacaaagauggucuaacucaauaaauuuugcaugugaacagggcagauguauaucccaaucuagaagacaaggaaacugagucucagguuaaaugauuugccccagguuaaaugaguguuaagugaaagaacuuggucauaaaccuggguuuucuuuuuucuuuuuguagacgggucucgcuauguuucccaagcuggucucaaaugccuggguucaagcaauccucccaccuuggccucccaaagugcugggauuacaggcaugugccaccacaugccuauaauauuaaguccaguguuuauccuuuuuuaccuggcauucuaaucuguuuuguggggacagcaaaugcuuauuuuuccuuuuucuuuugugagacaggguuucauuguugcccaggcuggagugcaguggcaugaucauagcucagcacagccucaaucucccaggcucaggugauucucccaccucagccucccuggaagcugggaauacaggcacauguuaccacgcccagcuaauuuuuguauuuuuuguagaaaugggguuucaccauguuucccaggcuggucuugaacucccagccucaagcuauccuccuaccuuggccccccaaagugaugggauuacagaugugagucacugugcccagcuaaauauagcuaauuuuaaaaagcuguuuuauaaggggucuguaggggagguugguaguuucauauagaguagcuauaggugccuaaugcaucuuugguucaaacgagcuuuggaauuggauaaaauagcuuaccugauuuccagguuugaccaggcguagggcagcuucagcacaaaggugagcugccuuaauaacaucugcuuuccucccuguuacuuggguccccuguagauaaggacaugcaaucaguaucuuccuggaaagucuguuaacucagcuggcuaucugguuaauaucugugagcccauaugcgaagaccagccaaugaacaggaggguaaaaacaacaacaacaacaaaaaccuuucuccuuuugcuucucuagagacucucucaacuuacguggugauuggggguggggauaagaagcaaauggcagugcauucccucuaccccaaggcuaaacagagaucaaaagcaggccaccuaccugagcuacaucaaccacaaaagugugagcuacauuagcgaugaagccauccacauggaccccaaggucacugaaaggcaagaucagaguacugcauuaggaacuggcauuuuguaaaugcuuuaaaaaaagaaaaaugcuuuaaaacgguuuaaccuuacauuuuuaccaagucaccuuccuugagaauauaauccuggucgcucuucaaaggggagaagugacauacacaguuauuuaccgaaaugcuggugggaaaagcaauaccuguaaagaaagaaucaucagccuacugccuugcugucucccgggagcccuagugcccuucagaaauguagaaggauuuuuucagggucuugcuuaaguuucaucaguuuggauuagguaggaaacugcuuguaucccacuugccauuccaaauuuccaaauaccucagccagagcugggguggggacugcgucauuacagugaaaaaaauaaaaacauauaggaccaaauaagggucaaacggaaaauuagugagggauuuuuuuuuuuuaccuuucuucauuuccuuuucuuucuugaagauuuucccuguuucuuccauaaucauggcaucaccuuucucacacaggcucaguaccgacacaccugagcuagaugcuuccaccaaggaccgaaguaccccugaggacagaaucccaucaugucagccuuguauguauucauugucuaguuaccacccaaggaauaccuggaaguugaauuuaagaguuuccauaauacucccuggugccauugcccugaggcugaaaggucaacauucccuucucuuccuuacauuaugugacaacuggguauauacaauccaucucccuaggcaaggccucagacuuuccaaagaugcuaccuuuggugugacaggacagaguuaugaacuucagaggguucuugccaugguauccccacauacacgcaaagacuagaugaaauuuauaggcaucagggacaagaagguagacagaauugcugacucgaagccgaugcacuguuaaauguuaccgcauuccuuucucagacacucuaauuagguguuaggaaucucaaucuauauagacuuauuuccucauaaacaagugcauaagccaaggaaacuuaaucuaaggucccuggguuucauuucgggggaucauggcuuaucuaaaagaaauaugaggccaaaguuauaaacuguaagagauuuucugauucaaaccacuaguaucucaaauacuaaaaggcaccaaaaaccaggguacgauacuaaauguccacugugauauaaagcacagguuugacuuuugguaucucaguuuuggugauucuuugaaagcugguaaaacucagauuuucacccacaggacgggaggcauccuaaauaccuguuccccaccaucuuugcuguuaaaaccauuuaaaagcacaaugacaagcaguuuguaucucccuaacuggaauaaaauggaaaggcuaacuggaaagagagaaaagagaaaguggcaucugccuagagugacaggcaacugcugagaucgucagagcacaccuggaguaaggaugacuugugaaaauccuaaaaucaguccucccuuuuccaguaauguucacaagcuugccuaguugggauaagacggagaccccaaaacauuugaguugucaagucacugagaacaacaaaugugaaugcuaacuaagacuaucugcacagauuggaaaggugguaguaaugaguaacuucaagaaaagccauauauaucuccaagacuugcauuagaagcuccaggagugcucuccaacggucuccuuagcuggcccaagguagaagggggcccccaccaggguaagagcugaaguaaagaaggaaaggcuccagcaaagcacgugguggggaagcuggugguggggaagcuggugucagggacacuagcggaguaagaagggggccagccauccgcaaugggacccagcaacacgugccggcuuggcuccugacgccccggagacgcuacaaaaacagaggggcacuucugucgccaauagcugggcgcuuccuuuucgagguggccucgccgcugccagaaucagaggaagcaauaaucgggaaugaaggauaggaacaagagaaaacacgucuugccuccuaacaaacggccucgggucggagccugccaggguccccucucugcgcucauccuggucgccgacccgcaccuccauagacuucagccugggccugcccgcucaggucccaggcgcgacaccgggucuucccaccacgccgugcccagcggaccggugcgggccccucaguagcucaguccgcaugaccccuccgcuccagccccuuccgggccagccuguuaccuuucccuaucagccuugauuccccgacccccgaggccgcacucacuguuggcgaugucgccccccaucuuauacuuggucacgaccagguccucagcgauaguuugcuccuguugcucguccucgcccgacaucuuccuacuaccaccacugcagccucguuuccccugagccgccgccgccucugucucccuucccagccacaggcuguggucagaguccccucgauccucgaggagagggcgagcgaaagcgcgagcaagcaagggagcgggcaggcaggcgagagcgagaagcugcgagcgcgcgggcugaggcgcagggcacgcugggacaacuaguccucucggccgccagacucuagccgcucucgagggccuucgaacuacaauucccagccugccucucgcgcuccuaagccaggcccuggggccuugcccuccaagggccucgcacgccggaaucgccgggcacucugggaagggucaggcuccggcgggaaggcggagccguuggggagcuugaggggaagcguggu

SEQ ID NO: 16464 - RNA, 2611 nt, Homo sapiens
accugagcuacaucaaccacaaaagugugagcuacauuagcgaugaagccauccacauggaccccaaggucacugaaaggcaagaucagaguacugcauuaggaacuggcauuuuguaaaugcuuuaaaaaaagaaaaaugcuuuaaaacgguuuaaccuuacauuuuuaccaagucaccuuccuugagaauauaauccuggucgcucuucaaaggggagaagugacauacacaguuauuuaccgaaaugcuggugggaaaagcaauaccuguaaagaaagaaucaucagccuacugccuugcugucucccgggagcccuagugcccuucagaaauguagaaggauuuuuucagggucuugcuuaaguuucaucaguuuggauuagguaggaaacugcuuguaucccacuugccauuccaaauuuccaaauaccucagccagagcugggguggggacugcgucauuacagugaaaaaaauaaaaacauauaggaccaaauaagggucaaacggaaaauuagugagggauuuuuuuuuuuuaccuuucuucauuuccuuuucuuucuugaagauuuucccuguuucuuccauaaucauggcaucaccuuucucacacaggcucaguaccgacacaccugagcuagaugcuuccaccaaggaccgaaguaccccugaggacagaaucccaucaugucagccuuguauguauucauugucuaguuaccacccaaggaauaccuggaaguugaauuuaagaguuuccauaauacucccuggugccauugcccugaggcugaaaggucaacauucccuucucuuccuuacauuaugugacaacuggguauauacaauccaucucccuaggcaaggccucagacuuuccaaagaugcuaccuuuggugugacaggacagaguuaugaacuucagaggguucuugccaugguauccccacauacacgcaaagacuagaugaaauuuauaggcaucagggacaagaagguagacagaauugcugacucgaagccgaugcacuguuaaauguuaccgcauuccuuucucagacacucuaauuagguguuaggaaucucaaucuauauagacuuauuuccucauaaacaagugcauaagccaaggaaacuuaaucuaaggucccuggguuucauuucgggggaucauggcuuaucuaaaagaaauaugaggccaaaguuauaaacuguaagagauuuucugauucaaaccacuaguaucucaaauacuaaaaggcaccaaaaaccaggguacgauacuaaauguccacugugauauaaagcacagguuugacuuuugguaucucaguuuuggugauucuuugaaagcugguaaaacucagauuuucacccacaggacgggaggcauccuaaauaccuguuccccaccaucuuugcuguuaaaaccauuuaaaagcacaaugacaagcaguuuguaucucccuaacuggaauaaaauggaaaggcuaacuggaaagagagaaaagagaaaguggcaucugccuagagugacaggcaacugcugagaucgucagagcacaccuggaguaaggaugacuugugaaaauccuaaaaucaguccucccuuuuccaguaauguucacaagcuugccuaguugggauaagacggagaccccaaaacauuugaguugucaagucacugagaacaacaaaugugaaugcuaacuaagacuaucugcacagauuggaaaggugguaguaaugaguaacuucaagaaaagccauauauaucuccaagacuugcauuagaagcuccaggagugcucuccaacggucuccuuagcuggcccaagguagaagggggcccccaccaggguaagagcugaaguaaagaaggaaaggcuccagcaaagcacgugguggggaagcuggugguggggaagcuggugucagggacacuagcggaguaagaagggggccagccauccgcaaugggacccagcaacacgugccggcuuggcuccugacgccccggagacgcuacaaaaacagaggggcacuucugucgccaauagcugggcgcuuccuuuucgagguggccucgccgcugccagaaucagaggaagcaauaaucgggaaugaaggauaggaacaagagaaaacacgucuugccuccuaacaaacggccucgggucggagccugccaggguccccucucugcgcucauccuggucgccgacccgcaccuccauagacuucagccugggccugcccgcucaggucccaggcgcgacaccgggucuucccaccacgccgugcccagcggaccggugcgggccccucaguagcucaguccgcaugaccccuccgcuccagccccuuccgggccagccuguuaccuuucccuaucagccuugauuccccgacccccgaggccgcacucacuguuggcgaugucgccccccaucuuauacuuggucacgaccagguccucagcgauaguuugcuccuguugcucguccucgcccgacaucuuccuacuaccaccacugcagccucguuuccccugagccgccgccgccucugucucccuucccagccacaggcuguggucagagucccc

SEQ ID NO: 16465 - RNA, 1225 nt, Homo sapiens
ucuacacccaaugccacggggaugccuggcaucagagucaucagaggggcauguaacaggcucugaggcugagcuccaggagaaagugucaauguguaggagccggagcaggagccggagcccacggccacgcggagauagcgccuaccauucccagcgccacagucugcugacuccuguuaccccacucuccccacccggguuagaggaagaggaugucaacgguuaugucaugccagauacacaccucaaaggugccugacucuuccuagggcuuuccucaauuuuuccucgaauucuuuccccgggcuccucuuuuuucuucucugaucauaugccucucuguccuauuaauuuuuucaaacuuuccccuacccucaugaaguucuucacauaccuagccuuucuucucaacccccagguacucccuccucccgggaaggcacccuuucuucagugggucucaguucuguccuggguacugaagaagaagaugaagaugaggaguaugaauacaugaaccggaggagaaggcacaguccaccucaucccccuaggccaaguucccuugaggagcuggguuaugaguacauggauguggggucagaccucagugccucucugggcagcacacagaguugcccacuccacccuguacccaucaugcccacugcaggcacaacuccagaugaagacuaugaauauaugaaucggcaacgagauggaggugguccugggggugauuaugcagccaugggggccugcccagcaucugagcaaggguaugaagagaugagagcuuuucaggggccuggacaucaggccccccauguccauuaugcccgccuaaaaacucuacguagcuuagaggcuacagacucugccuuugauaacccugauuacuggcauagcaggcuuuuccccaaggcuaaugcccagagaacguaacuccugcucccuguggcacucagggagcauuuaauggcagcuagugccuuuagaggguaccgucuucucccuauucccucucucucccaggucccagccccuuuuccccagucccagacaauuccauucaaucuuuggaggcuuuuaaacauuuugacacaaaauucuuaugguauguagccagcugugcacuuucuucucuuucccaaccccaggaaagguuuuccuuauuuugugugcuuucccagucccauuccucagcuucuucacaggcacu

SEQ ID NO: 16466 - RNA, 8372 nt, Homo sapiens
ucggcuccaggaggcggguuccagccaaugguugagccacccgcuuccagccaauggcugagggauaagcugaggggagugagaggucacuuacugcagccggacauaacggcgcuggccccgccccuucucgagaacucgcagagcugggcugguaaaauugcagugcugaagacacuggacccgguaaggagacugggggugguaaagaagcuggggaggaagggcugcugagcugggcagcggagggggccuugguguccagcugugcuccgaaccucaagggcaacaaaacuaucaguaccugccuccacuccuucugucugggugcucuugagaucgcgggguguugccgcaagacccuuuugugccuggaugccggacguauguuccuaccuaacgugcccauggggagugaggggucaucaccugcaccaacggguggcauuucuguauuacagcaaaaggcugucccucccaaaccugggauucugggcucacugaguucaccugcgagucagcccuaccugcacugcucuggucuaguacaaacaggcugcuggcauugagguagguggcagagagaguaauggucccauggcccaggggcaaggugaagacugcuccuauucccaucucuagguuuccuuuccucccuacccacgacccacccaccccagcacauuggucuccagcaucucaucagcaguuuagacauuugucaccccuccucacuuuggcccugcugggucagugcucucuguucagcaauuugaggaagaaacuugcagggcagagagcagaaaaauuaccuuccuucuccagccugccccugacacucuggccauuaacuccucaauuugcugagcucacuacaguggcacagagaagauugaggugguccgggacccuagguugggguccaguucccagcuggguucaauuuuuuuuagggugaauggagggagaguuggggacugaaaagccuucaaagacaauguuauuacagcagucuccccuuauccaaaguuuccuuuuccugaguuucaguuagcuauggucaaccgcuuggaaaauaguugaacacaguacaauaagauauuuugaggcugggagugguggcucaugccuguaauaaucccaggacuuugugagaccaaguuugaaggaucacuugaacccaggaguuugagaccagccugggcaacauaguaagaccucaucucuacaaaaaaaaaaaaaaaaagaccaugcaugguggcacacgccugugguccccgcuacucaggagguugaggcaggaggauggcuugagcccagaaguuugaugcuauagugagcugagaucacgccacugcacuccagccugggcagagcaagacccugucaggggcagggggaggggaggggaagccggacaguggcucaugccuguaaucccagcacuuugggggcuaaggcagcaagaggccaggaguucaagaccagcccugacaacauagacucccaugucuacagaaaaauuagccaggcuuggugacacacacuuguagucccagcugcuggggaggcuaaggcaggaggauggcuugagcccaagagguugaagcuucagugagccaugaucgacacuugcuccaucgcccaggcuuuuuuuuuuuuugagacaaggucuugcccuguugcccaggcuggaguacgguggcgccaucauaauucauugcagucucgaccuccuggacucaagccauccucucaucucagcacuccucuccccaccaccccgguagcugagacuacagacaggcaccaccaugcccaguuaauuuguuuuuuuuuuucuagagacacagucucacuauguugcccaagcuggucuugaacuccuggagucaagugauccuccuuccuuggccucccaaaauuuugggauuauaggcaugagccaccaugacuggccaaaaaaaaguauauuuugagagagagaccacauucauauaacuuuuuuuuguuuuuguuuugagacagggucucgcucucuguugcccaagcugaagugcaguggcacagucagcucacucuguaaccucaaacuccugggcuuagaucuucucagccuccagaguagaugggaccacaggugcgcuccaccaugcccaacuaacuuuuuauuuuguagggacggagucuccaacuccuggccucuagcaguccuccuguguaggucucccaaagugcuaguguguccggaauugguggguucuuggucucacugacuucaagaaugaagccgcggacccucgcagugaguguuacaguucuuaaaggcagcguguccggaguuuguuccuucugauguucagauguguuuggaguuucuuccuucugguggguucgugcucuugcuggcucaggagugaagcugcagaccuucacagugaauguuacagcucauaaaggcaguguggacccgaagagugagcagcagcaagauucauuguaaagagggaaagaacaaagcuuccaccguguggaaagggacccaagcggguugccacugcuggcuugggcagccugcuuuuguucucuuaucuggugccacccacauccugcugauugguagagccgaguggucuguuuugacagggugcugauuggugcguuuacaaucccugagcuagacacaaagguucuccacauccccaccagauuagcuagauacagaguguugauugguguauucacaaucccugagcuagacauaaagguucuccaaggccccaccagaguagcuagauacagaguguugauuggugcauucacaaacccugagcuagacacagggugcugauagguguauuuacaaucccugagcuagacaugaagguucuccaccuccccaccagacucaggagcccagcuggcuucacccaguggaucccgcacuggugcugcagguggagcugccugccagucucggugccaugcgcccgcacuccucagcccuugggugguugaugggacugggugccguggagcaggggucggugcuccucggggaggcuuaggccccacaggagcccacggcgaaggggggcucaggcauggcgggcugcaggucccgagcccugccccgcggggaggcagcuaaggcccggcgagaaaucgagcgcagcgcuggugggccggcacugcugggggacccaguacacccuccgcagcugcuggcccaggugguaagccccucauugcccggggccggcagggccagccggcugcuccgugugcggggccugccaagcccacgcccacccggaacuccagcuggcccgcaagcuccgcgcucagccccgguucccgcucgcaccucucccuccacaccucccugcaagcugagggagccgacucuggccuuggccagcccagaaaggggcucccacagugcagcggcgagcugaagggcuccucaagugccgccaaagugggagcccaggcagaggaggcaccgagagugagcaagggcugugaggacugccagcacaaugucacuucucacuaggauuauaagggugagccaccacacccagcucuuuuauuacaguauaauguuauaauuuuuuucuuuuucuuuguuuuuuuuuugagacguuugagacggagucucacucugucgcccaggcuggagugcaguggcgcgaucucggcucacugcaaccuccgccuccuggguucacgccauucuccugucuccggaguagcagggacuacaggcgcccgccgccaagcccggcuaauuuuuuuuuuucuauuuuuaguagagaugagguuucgccgcguuagccaggaugguuucgaucuccugacaucgugaucugcccgucucagccucccaaagugcugggauuacaggcguaagccacugcgccgggcuaauuuuucuauuuuguuauuguuguuaaucucucuuuuuuuuuuuuuuuuuuuuuuuugagauggagucucucucuguugcccagacuggagagcaguggcgugaucucagcucacugcaaccuccaccucccagguucaggugauucuccugccucagccucccgaguagcugggguuacaggcacgugucaccaugccuggcuuauuuuugaauuuuuguagagacagguuuuccccauuuuggccaggcuggucucaaacuccugaccucaggugauuugcccgccucagccucccaaagugcugggauuacagacgugagccacugcgccgggcauuguuguuaaucucuuacuguggguaauuuaguaauuaaacuauaagagguauguauguaugggggaaaaaacaguaauauaggguuuggugcaaucugugguuucaaacaucuacugggggucguagaacauauccccaguggauaaggggguacuacuguacuuguuggcucuucauguuagcucugcuaggcagaugucauuucagagaugaggaagcaaguucagaacggcuuggaaucuugcucaggaaaucgggcugguuaaugaauaacaagagauccaguuucacaaacccaaggcauuuugcccccagaaucugggcuucuucacccauuuaggcugucacuacuuuuuuuucacuuuuuuaucccuguuuaagucagucugacccacaguuguccucugcugacuucagaaauaauaaucuggccaguagacauuugguuucgguccuuuaggcccuucgccccaggcaucguucucuaugguggacaaaguucagaauggaagaugggagaaaggugauucugauucuagaagcacccaucccuccuaccccauuccccacccgcauuaccugccauccugucagcacagucugucucugaagugcuccaaguuuucucuaagggcccauuuggacucccacucucaagacuccucacuugcccagaaagcuccuugcugaccuucucugugucuuccucucacccauucccuuaggccucccuaauauccccucccagggucucccuaucuugaucccagaaucuuccuucuacaggucugcuacaaugcugcugcugcacagagcugugguccucaggcuccaacaggccugcagguaggccagcccaucccaggacuugccuccuagccccuaucugccacccuuagugucuuuuacaaugucauaccuugcaaauaagacaguugagagaguguguccagggaggacagagaaagccagaucccacuuuucccaccuaucccuggagaaacuaaguuccaacuuaaggaaccaauggccaaccagggagaaagaaguagaccccaagccuucacuagcccuuucacaugaccauacgugcuacuaagaccgaccucucuuccagacucaagucaauccccucaaggaucugcauucaggccugcuccacaaaugauucauuucagccccagcgccccagccucaccuucucuggugauaacuccagcacccagggauggagagucauggggacccuauuaggucucggugcaguguuggccuaucaggaccaucgguguaggguaaguagggaaagugcuucauugucagaacagacugggugcaguggcucacgccuguuaucccagcacuauaggaggccaaggugggugggucacuugagguuaggaguuugagaccagccugggcaacauggcaaaaccccaucucuaguaaaaauuagccagguguggugguacauaccuguaaucucagcuacuugagaggcugagacacaagaaucacuuaaacccaggaggcuaagucugcagugagccaagaucaagaucaggccacugcucuccagccugggugacagagugagacuccaucucaaaaaaaaaaaaaaaauugucagaauaaaggaaucaguccuaguaaacuccacaggcaacccaggcugugacccauguucuuguaguuaccacagaguucacagugacgcagucuucaugcacaguggagaugaaaucugcuaaucugcuaccuucgcuucccaguggccaacaccguggguugggucagggugagcucaagugauuucuucuuauucuucuucauuuuuucuuuuuuuuuuuuuugagauggaguuucacucuuguugcccaggcuggagugcaauggcaugaucucagcucaccacaaccuccaccucccggguucaagugauucuccugccucagccucccaaguagcugggauuacaggcaugcaccaccaugcccagcuaauuuuguauuuuuaguagagacagggcuucuccauguuggucaagcuggucuugaacucccgaccuuaugugauccgcccaccucggccucccaaagugcugggauuacaguugugagucaccacgcccgaccaagugauuucuucuuaauagucucuucccuuuuaucuuacuccuucccugccaauaggcugcucaggagucaacacacauauacacuaaggaggaagugaguucccacaccagcccugagacugggaucugggugacucugggcucugaggucuuugaugucacagaauuuguggaccuacauccaggggggccuucaaagcugaugcuagcagcuggggguccccuagagcccuucugggcccucuaugcuguucacaaccagucccaugugcgugaguuacuggcucaguacaagauuggggagcugaauccugaagacaagguagcccccaccguggagaccucugacccuuaugcugaugauccuguacgucacccagcccugaaggucaacagccagcggcccuuuaaugcagagccucccccugagcugcugacagaaaacuacaucacacccaacccuaucuucuucacccggaaccaucugccuguaccuaaccuggauccagacaccuaucgcuuacacguaguaggagcaccugggggucagucacugucucuuucccuggaugacuugcacaacuuucccagguacgagaucacagucacucugcagugugccggcaaccgacgcucugagaugacucaggucaaagaaguaaaaggucuggaguggagaacaggagccaucagcacugcacgcugggcuggggcacggcucugugauguguuagcccaggcuggccaccaacucugugaaacugaggcccacgucugcuuugagggacuggacucagacccuacugggacugccuauggagcauccaucccucuggcucgggccauggacccugaagcugagguccugcuggcauaugagaugaaugggcagccucugccacgugaccacggcuucccugugcguguggugguuccuggaguggugggugcccgccaugucaaauggcugggcagagugagugugcagccagaggaaaguuacagccacuggcaacggcgggauuacaaaggcuucucuccaucuguggacugggagacuguagauuuugacucugcuccauccauucaggaacuuccuguccagucggccaucacagagccccgggauggagagacuguagaaucaggggaggugaccaucaagggcuaugcauggaguggugguggcagggcugugauccggguggaugugucucuggaugggggccuaaccuggcagguggcuaagcuggauggagaggaacagcgccccaggaaggccugggcauggcgucuguggcaguugaaagccccugugccagcuggacaaaaggaacugaacauuguuuguaaggcuguggaugaugguuacaaugugcagccagacaccguggccccaaucuggaaccugcgagguguucucagcaaugccuggcaucguguccaugucuaugucuccccaugagcauggaaaggagccaccuccaccccuuuccccacccauuagccucacugcuucagaaaaaucuuucccaccuuucaacuucuuggaucacaacucuggccuuccuaagccauacccaaguacacauauagcacauuucacccaaggaccuucccucuuuggacacuauguuacauaccccucuuggccuuugaaccugugccaggaagugugagcuguuacagcaaggggcuagaagugaaaaaaguaauucuggagacaagcacuauuuucucuuccuaccccaccuccauuucuaaugccuacugccaucaaggccuuguuuugcuuuucuuuuuggauuguucagagaaauguguguggcauguguaagaaaaguguauauacuaucuuauacuaccucuccagguugccagagaguugcgaggagagcaaggggcacaaccgucucccuuuauaguucuacuuuucuaauaaauagucuguuuaagaucauaa

SEQ ID NO: 16467 - RNA, 646 nt, Homo sapiens
uucuuuuuuuuuuuuuuuucaguugucaaaugauccuuuauugaaauauuuuccuuugugcuuaacuggcugggcauuccacagcaccacuguugaugucaucgaugaugucaugaggauggcggccaucaacauuacagcccacagacugggcaguccccaggaucucuuuaaugguuccagagaguucucuggcuaaggaucggugccgcaucugucgaacaauguugacgaucucaucaaaagugauauucccacuguguuuaauguuuuucuguuucuuucugucucuuggugguuccuugagggcuuugaugaucagggcagaggcagaaggcaccaccucaaucugggccugucuguucugaauggucaguuucacuguaauccucaggcccuuccagucacccguugccuuggcaaugucaucaccaaccuuuuuuggagacagacccagggggccgaucuugggggccagggcagaaguggcaccgacuucaccuccggugcaccucagguauacgacuuugaucucguuggggucgaacuucggcggcaugguggaggcggcugguguuggaugaacccggauucgggacgaccgaagaaaguugcaccuuggccuccuccgagccgaaagccgaga

SEQ ID NO: 16468 - RNA, 1070 nt, Homo sapiens
ugggggugggaagaagggggaggggagaccucugacuagaaggguauaugcauguguggguauuguguaugcauacauacacacacauaauauauacauacuuuugguggggguuggaaagggaaugaauacaugaggcccucuaguggaaacagggauaucuaagcaguucuugauuguuucaagacaggcuuguuggaacagacuccuccacauuugccagaaauauagcugcugaguaauaggguuugggaguauuguuguauccaaacuggagauuucgggcauagguugaagaggggucugucucucugcuccugugccccuccaagucucacccucucacccccaaucauaaaaagacaagggccaaaggccgggcgcgguggcucacaccuguaaucccagcacuuuggcaggcugaggcaggcggaucacgagaucaggagauugagaccauccuggcuaacacggugaaaaccugucucuacuaaaaauacaaaaaauuagccgggcgugguggcacaugccuguagucccaguuacucgcgaggcugaggcaggagaaucgcuugaaccugggaggcagagguugcagugagccgagaucaugccacugcacuccagccugggugacacgagcaaaacucugucuaaaaaaaaaaaaaaaaaaaaaaaaaaacaaggcccuugacacuccccauccugucuuuacaguauuuucuucacuguuagcaaagcuucaucucuccuuccucuaugaccuccuuagucauaguaaacaaacucuucugaaggccuuuuauacacuaaguccuguacuuaguucugcaauacaagcaaaaacauaguccaguuuagggacuauaucaaugaguggugcaauguguguaaagccucucugcucugagcuacuuuaaacaaacauacaauguaagaauagguccccuaacaccucugccuaucaguuuucugucccuggaucuuucauuuagaaaucuuggaacgauauuaaucucuaaggcacucagcuuuccuugcaaagaaugcucaaaguaaugccacccuau

SEQ ID NO: 16469 - RNA, 969 nt, Homo sapiens
uauaaauugcauucaaaucaguguuuuuuuuuuuugugggaaaucuuucucagaacauccuuaaaugcuuguuucaccugcugguuucuuagaguguaaauaaauggauucagcauaggagcgacagagguauugaguauagcuacuccuuuugucaaagcaacuccuuccuuugcugauguuuucacauacaugaagaugcagcuuccauaagagauagagacaacaaucacaugugaggagcagguugaaaaggcuuuuuuucuuugcugugcugaggggauucucagaauaguucugaugauguaaguauaggagagaauuacuaauaucaaaguggauauaagaguaaacagagcuaaaauaaagcucaugagcucuagaguacuugugucugugcaagagauuugcagcaaaggagcagagucacagguaaaguggucaaugacauuggagucacagaaauccagcuguaagcccauggccagugguggaaaaauuaccaagaaaccagccagccaagagcugauuauaagcugauaacagauccugucacucaugaugguuguauaaugcagaggcuuacauauagccacauagcaaucauaggacauagaggccaggaggaaaaacuccguugagccaaggaagauaaagaaaaauagcugagcugcacaagcauuauaagauauggauuuguccccuguuagaaugcugaucagaaaucuaggauuacagacagaaguaaaugaaauuuccaaggagaaauuccugaggaagaaauacaugggggucuucaggugggaauccagcaggguaagggagaugauaguuagauuuccaguaacacucaguacauacguaagaaauaggaacgagaaaaucacaaccugcaguugcggauuauccgucagacccagaaggaugaaaucugucacugauguucuauuuuucauuucugaugauuga

SEQ ID NO: 16470 - RNA, 948 nt, Homo sapiens
aaaugaagaacaaaucaauggaaauagaguucauucuccuaggauugacagaugacccacaguugcaaauugugauuuuccuguuucuauuucucaacuacaccuugagccugauggggaacuuaaucaucaucauccucacccugcuggauccccggcucaagacgccaauguauuucuuucuccguaauuucuccuuuuuggaaguaauauucacaacaguguguauuccuagauucuugauaaccauugugacuagagacaaaaccauuucuuauaauaauugugcaacucaauuauuuuuuauccuuuuaccgggaguuacugaguuuuaccuccuggcugccauguccuaugaccgcuacguugccaucugcaaaccacugcauuauccaaucauuaugagcagcaaagucugcuaccaacuuguacuuagcucuuggguaacuggauucuuaaucauauuucccccauuggucaugggacucaagcuggauuuuugugcuuccaaaacuauugaccacuuuaugugugaaacuucuccuauucugcagaucuccugcacagauacccauguccuagaauugaugucuuuuaccuuagcuguggugacacuuguggucacacugguauuagugauucucucuuacacuugcauuauuaagaccauucugaaauucucuucugcacagcaaaggaacaaagcauuuuccaccuguacuucccacaugauuguugucuccaugacauacgguagcuguaucuuuauguauauuaaaccaucugcaaaagaaagagugacuguauccaaagguguagcuuugcucuauaccucaauugccccuuuacuaaaucccuucauuuauacucucagaaaccagcaggugaaagaagucuucugggauguauuacaaaagaauuuguguuuuucuaaaagaccauuuuaag

SEQ ID NO: 16471 - RNA, 1822 nt, Homo sapiens
aaacugagaagcccagagcugcugcuaggagacuggagccaggguacccaagggagcccaucuccgggcgcccacccuugguacaggccaccucgcuucgcagcccagggaggaaaggagaggggguauguaaacagcugugggagucgggagucucaggaguugcagcaagcccaaacccaggccccccagcccagcccagaccaugggcucacugguucuuccacccaaccagcccgcaccuguggaauuagauggagcacaguuccaucaucacccaggcacaggggaagaugcccuggugcucaccaagcaaggccuggucuccaagcccuccuuaagaagccucguggauauaacaucuucaaggcccuugucugcuauuuucgcauccagcauggccagucaagcucuuccacugagcucauccauauaaggaggaagccaacaccacugcuaagucggaucugcuccagugucuccaguaccaguuuuaucggaucccagggacgugucugccccaaggugacagaggaagaucaaaggaggaucuguguggucacugaccuggaugaagcccuugugcaucuuuaagcccagcaacaaugcuagcuucacagugccuacagagauugaggagaccacucaagcagguuucuguccucaaaagagcucacguggaaagagacgaaugagagaacucuuugaauguguucccuucacugccaaccuggccaaguaugccaacccugugacggaucugcuggccggugugggguguuccgggcucaccuauuccaugaguccugugguuccaccagggcugcuaagucaggaaccucagccgccuggggaggaaccugaggaaaacccucauccuggacaacuugucugcuucuuacaucuuccacccagagaaugcagugccugugcaguccugguuugaugacauggcagauacugaguugcugaaccuguucccagucuuugagaagcagagcagaggacaucuauaccagccuuggguaggggcaggccucuuagccuucccugcuuccaagcaguggucaucccaguaagggucuuuccuaugcugugccuuuaggaucaccugacggacagagugaaagcuggagggccucaccacaugggccuggaaauagugagaagugauuguaaggagcuuuaggacagcuuagaugccaaguaggcaaaugccagaccaacaauacccagaacuaccugcucccgaguuguuggguucccgagaugugugugugaguguguguucugccaugaacuguggccccagcauauagcguuucagugggggagaagcugaaagacucuuggucuuucaagucgucuccucuccugucacccuaaaagccacugaacucuacagggaugaagacuauugaagacuccauugccaaaccaugaccuuuccucaguguuauaaagccuaugccaaggaaaaaggaaggguaugccuuugggugcuccagguacacaccuuuccaaaaucuuucuccagccagcugcugcagacaaaaauaagacauuucugggaagaugaggacuuguuuccaggccaguaccccaguggccaucaggucuuguggcccaaaagcuacgcuugccucuagcuaagugccuggcaugggcccuuucugugucuccccaagguuggguacugagcucccuucuucaccaucuagccauagucucgaaccuauggggaaggagguuuucuccccacccuggaagagaacagauuacugauuucuguucuuuugacucugaaaauucucuuucuuaa

SEQ ID NO: 16472 - RNA, 1822 nt, Homo sapiens
uuaagaaagagaauuuucagagucaaaagaacagaaaucaguaaucuguucucuuccaggguggggagaaaaccuccuuccccauagguucgagacuauggcuagauggugaagaagggagcucaguacccaaccuuggggagacacagaaagggcccaugccaggcacuuagcuagaggcaagcguagcuuuugggccacaagaccugauggccacugggguacuggccuggaaacaaguccucaucuucccagaaaugucuuauuuuugucugcagcagcuggcuggagaaagauuuuggaaagguguguaccuggagcacccaaaggcauacccuuccuuuuuccuuggcauaggcuuuauaacacugaggaaaggucaugguuuggcaauggagucuucaauagucuucaucccuguagaguucaguggcuuuuagggugacaggagaggagacgacuugaaagaccaagagucuuucagcuucucccccacugaaacgcuauaugcuggggccacaguucauggcagaacacacacucacacacacaucucgggaacccaacaacucgggagcagguaguucuggguauuguuggucuggcauuugccuacuuggcaucuaagcuguccuaaagcuccuuacaaucacuucucacuauuuccaggcccauguggugaggcccuccagcuuucacucuguccgucaggugauccuaaaggcacagcauaggaaagacccuuacugggaugaccacugcuuggaagcagggaaggcuaagaggccugccccuacccaaggcugguauagauguccucugcucugcuucucaaagacugggaacagguucagcaacucaguaucugccaugucaucaaaccaggacugcacaggcacugcauucucuggguggaagauguaagaagcagacaaguuguccaggaugaggguuuuccucagguuccuccccaggcggcugagguuccugacuuagcagcccugguggaaccacaggacucauggaauaggugagcccggaacaccccacaccggccagcagauccgucacaggguuggcauacuuggccagguuggcagugaagggaacacauucaaagaguucucucauucgucucuuuccacgugagcucuuuugaggacagaaaccugcuugaguggucuccucaaucucuguaggcacugugaagcuagcauuguugcugggcuuaaagaugcacaagggcuucauccaggucagugaccacacagauccuccuuugaucuuccucugucaccuuggggcagacacgucccugggauccgauaaaacugguacuggagacacuggagcagauccgacuuagcagugguguuggcuuccuccuuauauggaugagcucaguggaagagcuugacuggccaugcuggaugcgaaaauagcagacaagggccuugaagauguuauauccacgaggcuucuuaaggagggcuuggagaccaggccuugcuuggugagcaccagggcaucuuccccugugccugggugaugauggaacugugcuccaucuaauuccacaggugcgggcugguuggguggaagaaccagugagcccauggucugggcugggcuggggggccuggguuugggcuugcugcaacuccugagacucccgacucccacagcuguuuacauacccccucuccuuuccucccugggcugcgaagcgagguggccuguaccaagggugggcgcccggagaugggcucccuuggguacccuggcuccagucuccuagcagcagcucugggcuucucaguuu

SEQ ID NO: 16473 - RNA, 29633 nt, Homo sapiens
ggggacaaagcgccgaggccuggcggcagggcccauuaccagagcacccggcgucucacagggcugcgggcgcuggggaugcuccgggcuuggagaggccugaggguguccccgacuccuccggcacccccacuucccugaggauugcuggggcuuccgggggucccugccccguccaucgcccucauauugucgccucccggagcuggugacuucacgcuccccggggacaaagcucggcgugcugugguuugggggagaagcuggacgcuggcuucaucucuccagcucuuccgggcgcgcagcccaucagaucgaucaauguaccgggugcagaagcagcuccggagguucggccugucuccggccaggaccccgggcccucucugguguuugaagcagggaggcggucgcaggcgacuucugggaauuucacgcaugaaagcggggcuccgaaggguggacgacgcccgcucgaccugcgagugcgcuucgcaggcuggggggcccggauccgcaccccucaguuccugcccccccacccugcuagccgccacucucagcgggcaggggaggggcagugggagcugguuugcuggcucggcgcuucguuugcauugguccgggggggcugagacugcagcccccggccccgcgggcgggguggggaggcgggggccggacgggggcucaggcugcucuagcauuggcggaucuggggaauggggagggggggcaggaagcggggggagcggacugcgggggggggguguauaaauagggaaggggggacgugcauccucgucuuggugaggggggggcgcucggcacaaagaaaguguaaaguuugcagcgccaggcggcccgggcuaggcauccgggcgcgcacgugcaaggccggggacgccggggcccccacucugagcucgccguuucuuuuuuuucugcaagcgagaggggggguguuguugguaucgcccccuccuucuccuccccccaggggugaaagugcaagaggaagugcagccgcugccaucuuuccuccgcuccgaacacacggagcccggggccgcacagccgccgcuccgccgccgccuucucccggccugaggaagggccuacucugccgccgccgccgcccgcccgcuccagccgccgccgccgccgccaccgcccuccaggcuccgggacccggcccgcgccaccgcccccgugcgcgccccgccgccgccgccuucgccuucgccuuuuguuuccuccgcuccggcgcccccgccccggcucgcgcuuugcaggggacgcagcgcgcgcccccagcgggcccgggaaaagccgcggcgcgcgcgcgcgccugcgcggcggaccccuccuucuccuccccgcgugcgcgugcccuucuuggcugcgcgccggcgccgccuggcgggcgggaggggagguggcaggcgcguuugcaggaggggcgcaccucuucgcucgcgcacccccccggaagguagaccgggaaggggaggcgggcgggcggagaggagagaguggcgcgcaguccagcgagggcggggguuggcuaugugggggguggugcaccccgcagucuagacagucugauccgggcugggggcguguacacucggcgcaccugcgagacuacagagccucgggccggcacguguggggaguguggacacgucugcugcgccccgcuucucgcugcugaggggaagggagggggcgggcaggugcagcggccgggcuagugggagggggcggcggccauggagcgggugaacgacgcuucgugcggcccgucuggcugcuacacauaccaggugagcagacacagcacggagaugcugcacaaccugaaccagcagcgcaaaaacggcgggcgcuucugcgacgugcucuugcggguaggcgacgagagcuucccagcgcaccgcgccgugcuggccgccugcagcgaguacuuugagucgguguucagcgcccaguugggcgacggcggagcugcggacggggguccggcugauguagggggcgcgacggcagcaccaggcggcggggccgggggcagccgggagcuggagaugcacacuaucagcuccaagguauuuggggacauucuggacuucgccuacacuucccgcaucguggugcgcuuggagagcuuucccgaacucaugacggccgccaaguuccugcugaugaggucgguuaucgagaucugccaggaagucaucaaacaguccaacguacagauccugguacccccugcccgcgccgauauaaugcucuuucgccccccugggaccucggacuugggcuucccuuuggacaugaccaacggggcagccuuggcagccaacagcaauggcaucgccggcagcaugcagccagaggaggaggcagcucgggcggcuggugcagccauugcaggccaagccucuuugccuguguuaccugggguggaccgcuugcccaugguggcuggaccccuauccccccaacugcugacuuccccauuccccaguguggcauccagugccccuccccugacuggcaagcgaggccggggccgcccaaggaaggccaaccugcuggacucaauguuuggguccccagggggccugagggaggcaggcauccuuccaugcggucuaugugguaagguguucacugaugccaaccggcuccggcagcacgaggcccagcacggugucaccagccuccagcugggcuacaucgaccuuccuccuccgaggcugggugagaaugggcuacccaucucugaagaccccgacggcccccgaaagaggagccggaccaggaagcagguggcuugugagaucugcggcaagaucuuccgugauguguaucaucuuaaccggcacaagcugucccacucuggggagaagcccuacuccugcccuguguguggguugcgguucaagagaaaagaccgcauguccuaccaugugcggucccaugauggguccgugggcaagccuuacaucugccagagcugugggaaaggcuucuccaggugaggaaaggcccccucuuccuccccugccacacguuaucuuaguccugaaaaggcuccugccaagaucugggggugugggauuugugggggucauuugaccuuauagaaccaugccagguuuggguagaguguuuuuaagggcccuuauuuugagaugguaugccugagaccugcuuuccauucccucagggaaguuuuuuugacgcuaagugugcccuacugucucuccuccuggggccggauuccucaggccagagccaccggaccucaccauucuucccccagggcucccuuuguguuuccggcaccaggcguggggcccccucugggggcgggagacugggcuccuccagcgacuuccccgcuugaauggcugccgagggagguacuggaacaagugcaucugggacucccuacacucuugaggcaccagauuccccaacacagaacacuggccauccugaucaguagacuccagcugugccucucacaccacccugggaucaugggacacagagcuggucacccagagcugcugcuuaacaccaaaagcuuugaucugcucugaccugguagcucuagagccuaaugggacccacgagccccuuuauguuuucaggacagaaaggaauggggacaggaucucuauguagguucacuuucuaguuagccuguuggggaacugaggacuugucugggagcagagggugauuuuguuuuucuccuaaaaggccgguuuuaaccuggauuguaggaccuugugugugugaacacagggauggagaacucccucagagggccccgaccaggaaccagucuuaccggucaggcagccccugcccaccugcucaggcgggcaucuggcuuaccagcccagcuggggacuuaaggcuccacugcuggccucuggggacugaauuccauccggguggcauucauuggcugcccguggcgggagaggcugggggaggggauugcugaguuucuaaggggcuuuagucuggacaaugaaucacauauccccuccuggaaaggcugcagugaggcagcucuguuucauucuacugccaccgccucugguccuagaaaacacugaguuucugguggggagaauugagggaguggggaggcaaaaucagagacaaaugcccauuucucuuccccccuccagagaaaaccagggcagagaggccugggccuguggagccagaacuggguggugacuuugucuuugucaugcugggguuggggagagggaguccuuuccagcagugaguguguguguguguguacacacguaugcauaugugccugugugguggggucuggccaaguuucuaaagucccucuugguucucucuuuuccaggccugaucacuugaacggacauaucaagcaggugcacacuucugagcggccucacaagugucagguaggggcugggucagggcagagaugggcugaaggagaugaugcuguucucacggucgcagccuugagccagccgcugcgugugccgggggcccggcugaccgcccaccgcuuugcacaccuccccucuguuccuccacccucccucugcucuccuccuuuguucuucccccaggcccccuucccccacagcugacguuccuccuuccugguugcuugguccugguucccacccugucuuugccuucacucuguugcuuggcuuuccucuccugguguuugccggcuccuuggauggugggccguaucacacagauguuguguugggagacccggcacugcgcugggccugacuguugguuuccagcaguuuguagggacugcagguuuuuuuaaaagggcuccuggugguccagccaaccacucuuccccuuuucugaccucaguuagagcuccuccuggguccccucagcuuagggcacaaggcagugggggagguaggagguagggagugggugguccccucucccacacuggcaucuguuuaacccauccuaagccaggguuucuggaggacuggagagcaaagugggcucuucuucuuuuagcucuuugcaaaguagcagguaggaaacgcuggaccagauagauucucacccuugguuuaccugcuugaacaauaucugggggcccugcugguacccaaaagauugaguuuccucuccuggccacugagccuuccuguguggauagcgaacacaccucugucuucuccuugguuaucuccccucucccaugccaaguucccaucaagugagggcgagccaugauuguggggugugcacugcagucucugauaggauaaccugcuucuccuuauccuguugguggcaaggggagaggguucagggagaccagcagggagggaugaaugugccguaaguagggcagagccccugggggucaggcguggacgguguucacaggugcugggcuaggcagucucccuggaggaugacccagggugggccugcugggaucugucuuugccuugcugccuucucucucucugucucugauucucucaucacagagcacauucugacucagguagugugcugauuagcccgggcagaguaggaggagcccagagggcagugggggcaagcccgguggccuggggggguaaccugcacucucugcccuuuuuccagguguggguugggagcagcagcggccugccgccccuggaaccucuuccuagcgaccugccaucaugggacuuugcccagccugcuuuguggaggucgucccauucgguuccugacaccgccuuuucccuuucucuaaaaaaaucauucccagcccuugaaaaccugggcccagcacacuccagcaacacucucuucugcccagccccgccgggauaucugaggcagggcuggaccaccccagagggcagcagggccuuuacccaguggccuguuggcuagccugggccucccuggagaggguugacaguggaagggaacaggaggggcauuuggccugagaccccugcuuuugggagaggcuagcagggugguuccugcccagcaugcccagcuccucccugggugacucggagucuuucccaugucagagcccccaaauggggguagcaaggagcaccuuucuggaacccccuauagcauccaaguuucuuucugggcucucuugccuuuuccccccuuucacagauggcaccccugggcaucuguccuugccuaggugauuuuggagguuggugccuuccugggaacuagccaccagcuuaucugcuucccuuccccuggcaucacuucccauaggccugggguuucuagacuggggccuggccaccccuuuccccacuccacgagugagucggccuccagagaagacuggcacaauuccaacuagagucaacccaugcugcccucugcccuucccacucagaucuagauccugcuuucauuucuggcuagugaaguagacuuuuguguuuuugagguuuauuagcaggucugcucaggaaccaaacuaaugaguagcuuuauauugggccaccccaauauauggcuuugggggcugaaaaagcagauguagacccccucccucggauccuuauuggugugcccuuuagcacuccgcagacucugcggggugaacaggagugaugauaaaauuuuucauucuaacauuugaggcuuuguguguuuuguccuuggucugugucauaacacugacaucacugucccuugguguacaaaugcgcuccugcccugccccucccaacauacacucucacagaccugcuggccccuccuccagcccuacagccacaacuccccuaacggacccagcaggugaagacaugcuggcucucuugcucugggcuggccagccaggugugccuggacuugguuaaacagcaggggcaccuguuggcauaguguggggaugcugaaaacauaagaggugaagagacggcucucugggaguucauuccuugaguuccccacuggcuaggcacaguccguaucgcucauccccuccugaugccagagagaaugaaagaggccaguuacagagacuagugccauagcuuaaguagaaaggccaucugaauguaggggcaggaagccucaggcuugacaguggcaugucucuuugggacuuggccugaguguccuuaacuggcccagaugccccagguacugcuggauuuaugagcuuagugggcugggacauuucccccacauggaguucaaccugaagcugagaggcuggagcagcucagaccucccuagcuuccacgggcuccacuucuugggggcugguuagagaaggaaugcguugagaugggcauaugcucgagaagaagggggccaaagagcccagggagcugaaccuucaugcauugcccuuagaguuuuccagggcugugggagaaagcugcuugagacuaccccugaggcugccugaguucaagggcuacuaagggugggggugugcacuagugcccuugguaccacuugggccccauucccaagcugcucaauccuuaggaagaaaagcuuuaggaagucugggaagggagcaggacuggggcucaguguugaguggugaugaccugcacucagggugccugggccaggaccuggcaggcauggcccuuaauuacagcaggcugucuaacuaagcacagggcugugggccgggcagcucuuccgagugccacaggcagucaaagcauucugccucuggcucacucucuucccaucagcgucccucugucuucucccugucucuaggacaaagaaugcucuucuccugacaccccagcauggaaguucuggauguucccuuugagaucugucucccuccgccccuucucuccuggguugugugaccaggcucuuucauguucuguguugucugaacuucugcugugccuagacuuuggacuuucacaggcuccccagaaaaccuggggacugcagcagcagagggucaauccuggcacagagaagccaacaaucacuucagcuuggcuuugaacacagggaaagcguuugucauguuuguguuuuuucccccagcagcagauuuacauuccuaauucuguuugcucaggcgaaaguuagcuuucauuccuugagagauaaucaauggaggacagggugggggaagccagcccagucugggauuuuaauuuugcuuagcuaauccccaaauggauaagccacuuguggguaacugaaguuuggcuauccaucaucuuuagguagcaaagcaugacaggcaaagccuuuagaggacagaucccaaaagaagguuggcaagagaaacaaggcaucucuuuccuaucccucuuguggcucccucucccagagacuguggaagacaaaauccugaauaugcuuucagcccccgaguagcugggacuacaggcgcccaccaccaugcccagcuaauuuuuuuguauuuuuaguagagacgggguuucaccauauuggccaggcuggucucaaacuucugacauugugauccacccgccucggccucccaaaguguugggauuacaggugugagccacugcgccuggccucagcccuguuuucuuacaccugauccauguugguuccuuugaguucugaggcuuagaacacacccucucucaccauuggagggguggucuuugggucgcugccuggcaaagcuagcucuuguccccaaauaaaucaacagguguaccucucuuucccggggguguuuaugcagccccugcucugguuuagagacugcugggcuguguagagguuaggaguuuuuuucuccuacuguggccugucacugggucaugaggucccuggcugacguggggcccacauguggccaugagagcaagcauccauggugcuuucugacuuccuacaugcuggaauuuccuugcacaaaucuguucaccuuucccuuuugggaguccuggcugccaaguacuguacacuguguuauaaaguaugagcaccuuucacucagcagaagcucccucuccugaaucuggagaugguaagagcacaggcucugggacugguucuuaguccagcugucucauauccucucacggccuccacuggcccagcuguaaacugggagagaucagaaucccccaggguguccaggaggauugguaaaguacuggccuggguguggugggggugggugugcuagacuuucuuuaguagcugagucuuguguuuuaagcaaguucaccuucugaagguuuccucauuuaugauaugaauacacugaauauauaaaacagauaaaagcaguaugucauugcuacaaauucaguucaaauguauaauguuuacuuaaaaagacaaugacagaagagcuagguaggcugugcuaacguacacagauauuugggacugggguaguaaacaguggugucuucuaccuugacagcauugcaugcguuuguuucuugcuauggcuguacaguaaggagacaguuagaugucuguauguguugacaguguucagccacuuaccuugagcucucagguucucaggaugugcuucuguuaaagagagauggcagaggcaguuccguucuagcacaagguaaugggguggucuucaguggguuaccauuugaucugugacacaaaggugaauguugcuuucucuuacaguucuaaaacaguaaacacacacacacacaaaagaaaugagucaaaauugacuagaacccaugaaacaccucccuggaaccaaaauagcuugaaagccaacggauucagcucuucucagggcuuucccaauauucuaugacccccacagcuggaaugccuuuguaagcuccagcugaggaagggauguugugaggagacugaucacugguacuaagucaggugcucagguacaggaagugccugccaaccugaguccuccuuccagggugcugguucugaccuucagcuccugacucauccaaccccgggggccuggcugugaguuggugcucagcucacaccacagcuuuccaaagccacgcugucuuggagggugaucacacagcuugccucggagggcugcugucaggauggguugcaugagauaagugccucuaaaaggcugagcaccgugccugccuggcacacaaugaaugcuuaaucaauacaggguaguaucaucauccuugcugucaccagcacuuccccagcuuaacguuucacaaaugcuuuuuuuuuuugagacggagucuugcucuguugcccaggcuggagugcaguggugugaucucggcucacugcaagcucugccucccggguuuaugccauucucccgccucagccucccgaguagcugggacuacaggcaccugccaccaugccugguuaauuuuuuuguguuuuuaguagagaccgaguuucaccguguuagccaggauggucuugaucuccugacuucgugauccgcccgccucagccucccaaagugcugggauuacaggugugagccaccgcgcccggauuuuuuuuuuuuuuuuuuuuuuugagaggaagucuugacuuguugcccaggcuggagugcagugacacgaucuuggcucacugcaaccucuaccucccagguucaagugauucuccugccucagccucccaaguagcugggauuacgggagucugccaccacacccggcuaauuuuuuauauuuuuaauagagaugggguuucaccauguuggccaggcuggucuugaacuccugaccucaggugauccacccaucucggccucccaaagcgcugggauuacaagcaugagccaccgcacccggcccacagacacuuuugaagccucuggcccuugcugucugcuaauucucaugucgucagaauugccacuaucauuuaaugggcugcuuuuucaauucaaacucgugaaaauauuacgaauaauuaucucugcacuuuguccugccuuuccuuuccauuucccuggccaagacuaaugucacuuuugaauaaaaugaacaaauauaauucuuuguauaaaacuaggggaaacccagggauacagaacaggaaggcugguuuauaugccaauaacucaucuguaaauucauguaaauguaauucugugcauuauagcuaaugcaccuaaagucaauucuuaaugucuaaggaugagcaaauguguaacucuucauuguguagagggguauagagcuuagcuugccauguccuggguacauuuccaguagucauuuaguuaguaccagugauucccacucaagugucccguaaggagguaccaugggaaauaagagcagccucuuggcauucuggguagggagccugagccaaacucuaaagcugucuuuauaaagggaggucaugugauggccagaaauugccuuugcuucauggugcacuugguggggagucagguguggggugcuggguuucacaucaucccauuuucuuuucugccuucagaccugcaaugcuucuuuugccacccgagaccgucugcgcucccaccuggccugucaugaagacaaggugcccugccaggugugugggaaguacuugcgggcagcauacauggcagaccaccugaagaagcacagcgaggggcccagcaacuucugcaguaucuguaaccgagguaaucugcccacuguuuccucacuuccagaggaugggccugagcguguaugggaggccuaggggugucucaaucacccugccucagacuccacucuuugcacagccacccccuacuucccacugaaugauaaacaccuucaucacccaacuagcuauuugcuaccucuuccuucccaagaagcuuggggugcuuagaaugggaagucccaggagaccagcaggucaaaacagaaggagagagguucuucccaagcuugggcccauaacucucaccugcuacucagauggcaggauggaugcauuuugcagacaccacugaaccacugagguuggugggggaguuaguaggucccaaagugagagaaaaagagguugguccggcuugagagcuuuugcugguugauucacuggcauaugaaauucagcagccagggaaggagguugagucuggagauaaacaaggagcagacacuuuguagcacaaguagucagaagagagcccaaacucagguagauuguggccuugagagaggaaaguggaaggugcucugagcagggcagcaugcuugaggacaaggugggccuaaguagugucuaacucuguggcagugguguuguguugggugaagucaagccuguccccaagguucugccgggucuaguuggcuguuggaagugcuagauguuuguguuuugcaagcacagcaucaguggaggcuugcacugugucugugcuaaaggagguuggagcagcuaucugugaacgugaggaugcuucugcauggugugcuuugcuuuggccaguggggagcacugggauguccuuaucuccuggggcauucuugcuugucccaaugcuuccgaaagccugcuuagugggugcagcacugaaccaggagucaagagacccaggguuuagucccagccucucacuagguggccucgaguucucccauucccucucuaagcuugaguuucuucaucucucaaaugggguuaagaauagcccccuuucccaccucacagggcuguuaugaggaucccaggagacaagguaggugaaaggagccgcacacuugggagacucuauccuugcacuuuguaacaauguugggaaagacaugcuuguugacacucuggguuggaccaggcacaacacuccugcaggccuuggcggaaucguugggugccugugcuguguucaugugccgagguccacgguggaaggagauugcugaguagcuggguguucuugguguccuggaacugggucccuccuugcagcuucauaccugggguuuguaccaccaggacaccugcugugaaagcagggaaguaguagugaaggucucuuaagcugucuguucuguuuucugacaugucauuagagcccauugcugacaggagcuuccuccagguugcaagcggugggcuugcgcaugcagggagaguuaucaggcuguggcugacugucuugacuggggcuuccccagcccuagaaauaaugucguuucuugucuugcuucauccuaaccuggcuuccugacagcucccccggauaacucaaaaccugcuguaacaagcuguuagcaggcauuuugucaaguuuucaauauggaaguucccagucugagaacuggggucagagaccagagguugaaaacugcugaguggagaagggugcucaugauaaaacucagaaagcccagaccagaugguggaguagggcagaaacuggacaggagacccagggcuacagcccuugaagcccagcucaggaggagagaaaaacugagagcagcagggacagugggaaaguuggcccaguaaggaagcagcugauguggcaaagccaacaacuauuguacaucaggauuuauuuuccaagggcuaguaaagagaacuugggcaacagccauaagcuacaugaccggaauggagaauccagaagaguaaaccagagucuacuuuuucucagaaaagccaagacugggucuggaucacaggccaaacaucucuggguuccagagccagagcgggaagucccuuuccugcaagaagacuaaagaaggugcugguccaacccaugcuggguacucagaaagaagagaaaacaauugcaguuuuuaucagaagagaaggagcaggauucuacuccuggacucauuccuugggcagaaauaggaagagacaaaaaaaaaaaaaaaaaaaaaggaagaggauaaaguucuuucugagcaccaaaaacauugagacauuggaaucaaaaugcagagagcucuguguccuccuuugcccugcugccaccaagccuguaccuacaggagggguugcacgaauaaacgaauguucuuaucucugcauguguucaaacaaaggcugaaugucagaacaguuaagauugaaucaggugaacuuccaggugcccucagauccuucaaucccaacaauucuuaaauaguugacuuaaguaucuaccuauagaucugucuuuuucaauuuuugccacaaaaaugacuccuggcugugaagaauggcaaagaggaaaggcagccugacuccugcagccucacacgugagucagaugcaaguugaagagacagaugacucuggcuuugucauacagacauaucaggauguguaugauacuauuuguacaggaagaucauuugcaguggagggaguauuauggcuagaaaagcuuguucccacauuuuugaguugaggaaaucaguugaguugaacaguggaaaagggagaaggcccuggcugaucaccaugauuuucuuccuuuaaaguuucuguagcaggaucuuuguauauaugccuaugugcugguauggugaagaggaacagauuaucaggaauccgccuuugacagagacauuugaaugcaaacaucauugcuugaaagguagaggaagccuucuccccagucagagguaagcacacaaguggauggaugcagggaaccugcuguuccccuggacucacaucaagcuauguaggcccacuccaacacagugcaguugggaauggccccuucaggguuuggacaaggagaaagcaguccccaaccccugcauugauguggaaccugccaaaggaugauuugcuucuggagugccaagugcaggcacaccaggcaagaaaaugcaacugaggagcaguggccuuuugcuaauaagaccaucgucucuggagugaaagggccgguggcuuguugguuguaguggcagucauaugugugcucagcaucuccauugcguggauggcuggaucaagcugccucuuuggaucuugguuaaucaguggugaauggguggguaaguuuagaauuccggcuaaauaugucuggcuucaaagacguauucugcucagaagcucagcuucuguuucauccuaacacuuggcugcugaguugcucuguguuuaaauucuaggcuuuaaguggcagcuguggauccacuccuaccaccccgccaugugguuuugcuauagauaguacagucugcagcugggguaaagucaagaggacucagccacguguuucuaagacuguuuuucaggaaaacucagcaagacaguuucgcuguuguugcccagacuggagugcaauggcgcgaucucagcucaucacaaccuccaccuccuugguucaagcgauucuccuuccucagccucccuaguuagcugggauuacaggcaugcaccaccacgcccggcuaauuuuguauuuuuaguagagacaggguuucuccauguuggucaggcugguccggaacucccaaccucaggugaucugccugccucggccucccaaagugcaugagccacugcgcccagccaaacucagcaaguuuuuauugagcaucugcuguguucucuugguauagcucucccaguaaggaguaaacauaauaauuccuggugcucucccgcuccuuucuguccccuuuugauugcaguggaccugcucugguucaucacagggagagagcuucaugcuauuuuagagaccccacaagggauuaaaaaacuaaggaaaggccgggcacgguggcucacgccuguaaucccagcacuuugggaggccgaggcggguggaucgcgaagucaggagauccgagaccauccuggcuaacauggugaaaccccgucucuacuaaaaauacaaaaaaaauuagccagguaugguggcgggcgccuguagucccagcuaccagggaggcugaggcaggagaauggcaugaacccuggaggcggagcuugcagugagccgagauggugccacugcacuccagccugagcgagagugagacucugucucaaaaaaaaaaaaaaaggaaaaaauuaccuucuaaagugguaucaucauauuaucagaaaguucuaauaucuuguacugauuggugggagccaaugucuccugguucugcuuuguuuuaggggacucuacaguaccaccccaaggggcagggcuaacagccucuuucccauuagccuugucuccucacuccugacuacagccucccucuuagggaugucuacaugggacccucuuacaccaaucuauacccaugaucagccucaggcagaccacugcggucauagcacaggacaacuugcucuaccaggcagggcaggacaccagcaccuggucuagacagaucuuugaaguagcuguauugggaaaggaaggaaaauuggcccaaucccacauuucccuucagaaccacuaacugcugcugucagaggagaacuuguuaaauaaaguucccacaggccagcccuguuuuuccagcagcuuccauucuaacauaccauuauggucgaaaaauacaugaguguaaaugguaauaaugaaaccuauuguaaaaguccacuggauauuucuagggcucagggcuaagacacaggaaccaauuaacccauuuaugcuggagguuacaaacuuuuuugugaaaaaucagacuuuaaugaugaucuugagcaguaggauacaaauaauuccuaaaagguuagcgucccaauaauggaacaugaggcauaaguggguuaaagcaucugcccaguagcuaagggccaaguucugguggcacaugauccugggguuggaguccaggcucugccacucaguagcuguacgugugaccagguuacuuaaccucaccaagccucuuuuuuuuuugagacggagucucgcucuguugcccaggcuggagcgcaguggcaugaucucagcuuacaggugccugcuaccacgcccagcuaauuuuuuauauuuuuaguagagacgggguuucacuguguuagccaggauggucucgaucuccugaccucgugaucugcccaccucagccucccuaaccucacaaagccucuuauuucuuuaucuguaaaauggguauaauaguaaucuguagcacaaaggguguugggcaaauucuauagaauagugcaugcggugugcugggcccuggugugccaucagcacuuccuaaaggugaaccuuuauuacaguuccagcagcauucaaaauaccaugccaauucagacuuuuuuaaaacaaaucucaugcagacauuacacaguacucuucagccucugacccuuuacccuuuagcaguggaucucacuguuauccugugacuguguaauuuugaaagugaauggaaacaccugaugaugagucaaccagaucugaaguggauuaaagggacacugucagggugcuggcacccuaagugggccuuauacuaaaaagcuucaguuccugcuaaaagcaccuucugauccuugacuacagugggguuugauggcauaccuccuuccugugaaacccaagucaaaauccuuuuaucggccugccugauucuguauccuuggacgcauggcugcuguggaaguuggcccaagauguguucuucccagccugagauaucucguggaucagacugaccgaagcaucugggaggugggcuggaacagucccaagaaggccggauuguccucccccaaaauaaagacagagaucauccguguuucuucuccuguacgcgaaccugguggaugcuccaaaaucgaaccaaaacacuaccaugaauaagagaugacugcacuccucugacacaacuuccuauuuuugucuuuguucuucaaaaggucuaaacaguuacuaaauccuguuaugcugaagguggggaaguuagaaaaauagaacaucuccugacagguagaagacgggauccuuggaggcguuccuuugggauuucauuuuaccuccaucucguuuguuguccaguuuccuuuuacgaggauuaagcaggcauccugcuggcuagaauccuguggcuucccuggagccucaaauucuugucuaaccacauuucuagucaugguuccugcaggagacauccacucaaaccaccuguuacugaggcaccaagcaacccuagaggcaguuggccucuggcccuagcaggagcaggaucucaggccaucccaccaggcagccagccucagccccucaccgcagccuugcagagugggcucugcagagaagccgauuuguggacagugccacccuccauccugagucacauggcucaugugguugcagccauuuuugagccaggagggggccccuucuaggugcagcugaccugggaaugcuagccagagcggccagaggagaggaguugggggaaggagagagguaucucuugcuggccgcgggaucucaucuccuuuugucuuguuuagguuucuccucugccuccuacuuaaagguccauguuaaaacccaccacgguguuccccuuccccaggucuccaggcaccaggagcccauccugaaugggggagcagcguuccacugcgccaggaccuauggcaacaaaggcaagcgaccccuugcucugcacuuugcuucucugcgcagacuguguugugggggcgcugggcugggcguggggaggcgggaaggcugccggcuuucuggcugccuugaggagacucagagaucugaguggcaguggccuccaggacaaaagucacaguggguaucucacuccagggcagugagugaggcuuuagggcacugccgagauccagccuccgccuccucuuccccagcccuccuccuuuccuccuggccagcccccacugucuggagcccugcagggaugccccgggcccugggcagaagaagagcccugcaugaugagucacuaugggccugucacugccugcugcccuuuaggaugguguggagcugcggcugaaugcuuucuccucuuuugacccagugggccggugggagccaaugucuggcuucucucacaguaggagugguugguuacugugaguggcccuuucuggagagccucuggcuaugguugugagaugcauggcaauaaugagcuaucugacuccucugacuugggaguugguuugcagaaagcuccccaggcccaccuucacuuguugauucagguuguuuugugguaugucacguugucguugccuuggggaugaggccaggggcuuggcagaugguagaaacagcagagauggcaugcuccaugcucccaucacagaccucccuucccggcauggcucucuggacccaggcaggaagcugcugauugguggaggacuccagugugggccgggcaaggcagagcagccaggguugucucuuggcccagcuugucuggggccuaggguggggacacccagccgacugaguaguacagaguugcuuucaaucucugugcuugggcugcuuggcccugaaaagguuuuggcagaaggaaggcgguaaggacagggcuauguuugcagcauuaggaaaaggauuggcuucugucugagccauugauggggucuacccagguugaggaccuaauggcucugguucugccugucuugcuagggugcagcuagucuggugcaggaggcgaggcuacuauuacacuggcucggcaucaucagaauaccaauuuuacccucagaggcacccaaaagagcgccuaggaguugggggucuuugaguuguucugggcagcuguagcagaguugcccucucuguaucccuuccuugaagcaggcugagaugacggugagcaguacaugugcagcugcaugaagaguccacagcaagggaggcuggcagcccuagggcccugccguuucaccccuguaggcacuccaggcucccagacugaccagcugacccuccguggguucugccagggcaguggcuggccaauggcugcccuccacaggucugugagcuggccccucaugaccccuccaggagggggcaucuccagagccuggccucaucgcucuccuauauuuuguuuuuucguagaaggccagaaaugcucacaucaggauccgauugagagcucugacuccuauggugaccucucagaugccagcgaccugaagacgccagagaagcagagugccaauggcucuuucuccugcgacauggcaguccccaaaaacaaaauggagucugauggggagaagaaguacccaugcccugaaugugggagcuucuuccgcucuaaguccuacuugaacaaacacauccagaaggugcauguccgggcucucgggggcccccugggggaccugggcccugcccuuggcucaccuuucucuccucagcagaacaugucucuccucgaguccuuuggguuucagauuguucagucggcauuugcgucaucuuuaguagauccugagguugaccagcagcccauggggccugaagggaaaugaggcagcugcuguguccccacggaaacaaccaucuggggacugcugggaaaugcugugaaugcggagggaagugauguuuggguucuguagcugagagauuuuuauucauuuuuaacugccccccaaccccacuccaacuccuucuccaccacccauucucccaauggucuuuagaaauagauuuucaucugauauucugcagaaauaucaaugagacuugguaugggacaggggcagaaaacacuacauaggccuccaaggcaaaaccagucccaguuucuuuaaugggaagaagcuggaauuccuggugcucaauucuuagugaccccaauccuauacccaaaucuaugauauucugggaccucagugauuuugguccccucccacuucucuaguucgucauccucccuucccauauccuucaaaagaaccacacuagggucuccaccuacuuauacaaugcggaugcccaacuguuuuuaaggaagccagaagcaucccauggaccauggggugaguguccuccaagagcccccugagcucagcccucugccuggagggcuccagaccuuucugagcccugcuuggaggcgagcauuuucacugcuaggacaagcucagcuguugaggacacccccaccccaaauuucaguucuuacgugauuuuaaccauucaacaugcuguuggguuuuaauucucuaauuauuauuauuauuguuauuauuuuuuaggaccaguuguagugaauugcuacugaaagcuaucccaggugauacagagcucuuuguaaaccgcagucacacauuaggguuaguauuaaacuuuguuuagauguaccauaauuaacuuggcuaguugauuguuugaagucuauggaagaaauaguuuuaugcaaaauuuuaaaaaaugccagucuggucagggaaguaggggguuucaaugcuguugggaaccaggaaggugggacagccggcagguagggacauuguguaccucaguugugucacaugugagcaagcccagguugaccuugugaugugaauugaucugaucagacuguauuaaaaauguuaguacauuacucuaucugcucccuugaguccaguuuuucagcugugggggucuuugggacccagaggugggcaguccauaccccagcaccuggggugggagugggaucccaggagaccccuuuuccacuucauugcaccaguuccacugggauugacagguagauggucccacugaagacuuagaaugccagaauucacccauguguucaacaaauauccacugcuugucuucacugcuugugugccaggcaugguuucaugcucuugagauaugguggugaacaagacaccacugugaggcuuaaugggauagacagacaacuuaaauaugaguucagauaaugagaaauacaaggagaagaacugggcaaggugaggggacagugacagcaggagggugaguaggguggaccagggaggugugaagugggguuggggcucugggagggaaggcuuauagaggggaucugacacagccuacccagcuagcaccugaggagggaugugggcagggacuccucauggccaaggggcucuaagaagcucagcaacuugucucccccaccauguuaucuaccugauguuaaguaaaagguuggugcaccguuaauggugaauguaugaagaaaagagggaaagaacaacaaacaggaggcaagaaguaagcacgauggagaauuaauaggaauaagaaugaggaacaagaagggacaggcagacuuaaggcacccugggcaucuugagaaaucucagggaagagggaaaccccuaaaaggauagagacagcauuuaaccuccaagcaagaagaaaacaaaacaaugguaaaggagagaaaaacagaccuaggggaacaaacagcacaaaaauuuuuagacccacauugguaucagaauuacauuauuuuuuguuuuuuugagacggaguuuugcucuuguugcccaggcuggagugcaguggugugaucucggcucacugcaaccuccgccucccagguccaagcaauucuccugccucagccuccugaguaacuggaguaacugggauuaaaggcaugcaccacaaugccuggcuaauuuuuguauuuuuaguagagacgggguuucaccacauuggccaggcuggucucgaacuccugaccucaggugaucugccugccugggccucccaaagugcugggauuacaggcgugagccacugcacccugccuagaauuacauuguucugguguaaagguaaagacucucagcugaauuuuuuaaaaaacaauucuaagccauuuacacaaaauccuugguaagcugcugggcuuugcagacuguguggaauagaggcuuaggccauuagaugugaguaucaaaggaaagggugacccuagaauguggaggcccuguggacacguagcuuugugaccaccacagaaucuggucacacccacugaguguuaagagaaccuggccuugaaccaaggacuugacugggccagcccgagcuccugaacgcauuuuaguucugcucccuggagaccugugagcauguccauggacagguagggaccacagguauuagaaaggaguaucugucacauggcaggaggggaacaacagagcaagcaggcuguugcaucuuccaaagcacugcucccuuggcagccuaagcuuugggaggcuaaggcaggaggaucacuugaggccagggguuugagaccagccugggccacauaggaagacuccaucucuacaaaaaaugaagaacagcugcacaugguggugcccgcuuguaguccuagcuacucaggaggcuaaggcaagaggaucgcuugagcccagguguucaaggucacagugagcuaugaucacgccacugcauucaagccuggguaacagagugaggcccuaacgcuaaaaaaaaaaaaaaaaaaaaaaaggaagaaccaccugagcuuuggcuauucggcuccaucaucugcucucugccaaccuuggggaaaucccuaaaucucugagccuguuuccugaucaggucuuuuguggagaccaaaagaaaccaucaucaugagcuaauccccugcacaaccuauaagguugguuucauuauucuauuaucaucccccucuugcaggaaacaggcucagagggauggaggaacuccccugggucacauaguaaguggaagagucaggauucaaacugaggucugccuuguccucagacuuuacuccuaagcucccagugauaguuucugguuuuuuguuuuuugguguuuuuuuuuuagacagagucucacucugucaccuaggcugcaguggugcuaucucggcucaccuccaccucccggguucaagcgauucuccugccucagccucucaaguagcugggauuacaggcacacgccaccacaccuggcuaauuauuuuuuuguauuuuuuguagagacaagguuucaccauauugguaaggcuggucucaaacuccuggccucaagugaucugcccgccuuggccucccaaagugcugggauuacaggcgugagccauggugcccagcucacaagugccucuugaaggaggaaauuccacagccaugcccucucuuaccuugagugacaaugaucagcacucacucuaaagguaccuaaaacuuacccagaaguaucacuagcgucucacaaaucccuccuguccauuggaggaggaaggcuggcgggauucccuccaguuuacauaauugugccuggcugcuuagcaccuggcagcagugucuccagaauucuacuccuuacaaacucuaccucucagucucucucccaaggcugcguacccuacucugcaccucuccaagaguggaggacgacugguagauggugugaaaugauuuucacugggggaagguaggagaagggcagaaugauuaaugucuggauuugcaucucuugcuaaacugcugugaaaggaaauaccaaauauuuaucuaagagacuaauccauccuaacaaaacaaguuuccuuuaaggacagggcagugcagagguaggagccucugaaauaaaacuucuuuguaucacugugaaugggcauaccaaaaaaauaacuuauuuuuccuucagggaagucuucugcccuccaaaaucuggcacccuaccccauggccaguccauaccaggcagaggucagagccuguggcagcaaugaagagggacuucgagauuauuaacaucucccucccuccuuccaagucaaaaucugugcccugaagcugcugaauguuuuggaguccauguuaagcagcacaaacuccaugagcuguggggcuuguguuucauuuuucaaagcuuuucuuuggaugaugauaaacuauuguuuauuugugaaguuuccucugccucuaaaauacuuaucucuugucuaucuaaggaacucuuuuucagaagcucaguucagauugccccuugccuacaaagcuuuuccugcccccuccgcaagacagcuuauguguauuacaucacuaccaugugcuaagcaccaugacaggggucuuacauacaucaacaacccuaugcuguagguauuauuuuguucucauggagucccagagaagcaacugccaaugucacauagcugugaaguggcagagccaggacuugaauucagaacugucugaccagggagcccaggacuccaucaugauggaugugauacuuugugccaccucccuguuuugcacauauuuccacuuuugcaucaucuuuuuagggaucuaucuccccacaugagaccagauuucuuugccaauggggaucaggcaaagauaauucaucucuguauucccauugccuagaauaauaguuccuggcacuuggcagccacuaauucauucaacagauauucugagugugcuaagagagacuuaauuccuguccucaaggagcuuuagcauaaaguagcacaggacaugggacauacacauaaauaagugucuauaacacaagagagaaugaggcaugggaagugauggaaaauacaugcucuggugcuguggagaaagaugggaugccguccuggucuaagaugcuggccagguggcauuagaguaggacccuggagcacacuaggacugggacauguagggaggggggcagggugcucacaggcggacaugggcaaacuugcccuucaaguccaaguaacagcugacauuugaagugacaaaccucuucaugucaccaagggagacaaagggcccuuucagacuguagaagcugcuggaaaaugcuggccagccaucggacugugaagagccccgggggcaggauagaccauguucuaacauggaggccaguuuggugggaagcauacugaggcuggacaccaggaugaacacaggauaaaaugauguuaccuucccucacucgaggcugccuuucccaauaacacagccccauaccucacaacccucuugcaugcccagggccagagcucaggaggaaaggccaagccagagcauugggugggaaugcaggagagguggacauccucauuacauggggccucuucccagggcucaccccacuacagguccugagaauauuuuaaaaugcuuucaacuguguaaacaaacgaggcaccugagaaccccaaguaggccaugccuauggaagccauauucccugcccguuucacauuuccucagacuguuguuuaaugucagccugagcaucugcccuccacaccuccugcuguaugggaucauccuucucauuaauacugaaguuagaauggcuuuggccccauuccauaaagggugggaggcaucuccuccaacaucuccaaacauggugaaacccugucucuacuaaaaauacaaaauuagccaggugugguagcacacaccuguaaucccagcuacuugggaggcugaggcagggaaaucacuugaaccugggaggcagagguuacagugagccgggauugugccauugcacuccauccugggcgaaagagugagacuccgucucaaaaaaaaaaaaggucccuucucaagcaaggugcaguagcacaugacuguagucccagcuacucaggaggcuaaggcaggaggauggcuuaagcccaguccagccugggcaacauaccaagucccuguuucuaaaaaaaaaaaaaaauguuuaaauggucccucucuccacuggcaucagcccagacauggaaccuagggcuuuuccuucauuuuuuuucaaaaucaguaggugcucugauguucacccugauuuggggacaacagagacuaagucauagccagcacauaaaacgcacugacaguccagucccuucauaccugccacaggaaacaucucccuggugaggcuguuccucaguacccucagcugcccucagguggcugcucauucucaaucuccccagccaccuguccuacuuccuuggcccccucaauuccuucauccugggcuuauccccauccccuccccagagacacacaauucucacuguauuuugcagguuacuuagauuuuuucuuuuuccuuuuuuuuuuuugagacagggucucuguuacccaggcuggaguugcguggugugaucucgucacugcagccucaacguccugggcucaagugauccuccuaccccagccccccaaauagcugggacgaccacaggugugcaccgucacaccuggcuaauuucuaauuucuuucauuuuugguagagacaggcuuucgccauguugccuaggcuggucuugaacuccugagcucaagugaucugcucaccuuggccuccuaaagugcugggauuacaggugugggccacugugcccagucgagaucuuucuuuuucuaauuaugaacuauguugaguggggauaaggaggaacagggauucaccuuucauguccaaacagauuaucaagguacuuccugaaaaaagacaauuuccuaagaggaauacugcagccagcuuuuuagauagcaaucuuuaucuucucauuauaauauuaacaacuaccauuuauugagcacacuucuaauccucaugaccaugaacgguagagucaucuccacuucauagguaagaaaugaggcucagccugggcaacauagugagaccucaucucuacaaaaaauauacaaaaaauuagccaggugugguggcaugcaucuguaguuccagcuacuuggaaggcugaggugggaggauugcuuaagcccaggagguuaaagcugcagugagcugugaucaugccacuacacuacagccugggugacagagugagaucuugccucaauaaauaaauaaaaagugguuaugagaaaacagcagguuuuaaaggaacaaaauugccuaggugguaagaccugaacaauguuuaaaaagaugcaugaaaggccaggugcggugguucacaccuguaaucccagcacuuugggaggccaaggugggcggaucacuugaguccaggaguuugagaccagccugggcaacauggcaaaaccccaucucuacaaaaauacaaaaauuagccuggcaugguggugugcaccuguagucccagcuacucaggagccugggagguggagguugcagugagccgagauugugccacugcauuccacccuggguaacagagggagaccccgucucaaucaaucaaucaaucaaauaaaaagacgcauagaaaaaagacuggaagggaaugcaguugcaacagauuuauuggggugucucauccuacauaaauguaagcauuuuuagugauuuucacuagccauccucaguaacaccaugucaaguuccucuuuuccaguggguagcuucaugauggcugccauagacucagcugcuuucaggaauuagaacagucuccaacuuguauuuaagauucauuuaaaauguuuacacauaaaaauauucauuuaaaaauguccaucucggcuggguacaguggcucacgccuguaaucccagcacuuuaggaggcugaggcggguggaucacuugaggucaggagucgagaccagccuggccaacauggugaaaucccgucucuacuaaaaauacaaaaaaaaacacaacaacuagcugggcaugauagcgugcaccuguaaucccagcuacucaguaggcugaggcaggagaaucgcuugaacccaggagguggagguuguaguuagccaagaucacacaacuggacucagccugggcagcagagcaagacuccgucucaaaaaaaaaauccaucucaagguucccuucaaagcucacugccucacugcagccuuaaccucccagggucaacugauccucccgucuccaccuccuaaacagcuggaaccacagguacacaaccauaccuggcuaauuuuuguuuuuguuuuuguuuuuuuuuuugagacagagucucgcucuguugcccaggcuggagugcaguggcgcgaucucggcucacugaaagcucugccuccuggguucacaccauucuccugccucagccuccugaguagcugggacuacaggugcccgccaccaugcccagcuaauuuuuuuaaaauuuuaauuuuuaguagagacgggguuucaccguguuagccaggauugucucgaucuccugaccucgugauccgcccgccuuggccucccaaagugcugggauuacaggcgugagccacugcgcccggccuuuuuuuuuuuuuuuuuuugguagagaugaggucucauuauguuguccaggcuggucucaaacuccugggggcucgcaugcaauccucccaccucagcuucccaaaguauugggauuauaggcgugggccaccacaugcggccugauagcucauuuccuuuuggcagugaauaauauuucauuguuuggauguaccacaguauauucauuuauuuaccuacugaaggacaucuugauugcuuccaaguuuuggcaauuaugaauaaagcugcuguaaaccuguguguggagguuguuguguggacuuaaguuuucaacucguuugugaaaauaucaaggacugugauugcugaaucacaugguaagaguauguuuaguuuu

SEQ ID NO: 16474 - RNA, 47470 nt, Homo sapiens
agcucuuugaaaagcugccgaagcuccaagguuccuccgcuuccugcccgcaggcggaaccuuagagcuucagccauggaaauuaaccucuuccgguuggggccggaagucccuccgagaggggcggcuccgcgucaugugacuggaguccgcguaggaggggucggaggucuuacccaacagauugacgcggcguuaguauuggccguguacccgaaaaacugauugacugggcuggcguuaacugugcggaggcagguaugugaggggcugggguuggggcgggggcgccaaaguuuagggacgggggcgggagacccggguccgccuucccaggacacacgggcuugaacaucugagcccaggggcccagagacagcaagaccggucgugucuguccccgaaaagaggacgagcuggcguugugguucugcgucccaugaauacagauuggggaaacugaggccuugcgaaagagaagggcucccacaagcucuccuuucgaggcaugggcacugauucccauucuaucccccgugcgagaccgccucuaucaucugggagugcauuucacgaguuugcccugaguggagaagcagaggccggggagcgcggugaacagaguugggcugaaaguaagagaccuggauucgagacuucgccaccgacagacaauugugcguucugggccaaaucucuucccugugcugggccucaguuuucucgucucuaaaacggggcaguguuuuucaaaauaugguucuuacaccaucugcuuuguaauucucugagaugccggcuuuacagcgcgggacucaauucagacuucugguuuagaaucugaacuuaugcguagggggguccuguauauacuaauguuugaagcucauugauuuuaagugcuuuccugcugugagcacuagauauccauucuucgcuuugaggcagcuggugccaguucaggaacuuugaaagaacuggaaugguuagcucaguaaagagagcacuggaagggaauuaacuuuuuaaaaauugaaaauacuguuacggcaaagagggcuuccacuucaucuuuaggcuaaaagaggcagaacuaggacuaacaggugaauucuacaggaaggcaagauuuuugcuuaauagaagaacuuaaauggaagaaucgucagaggugaccaccgauggagugaauggauugccuccgugccuccuuucgagggagguauauagguauuagaugaagguccuuuccaacuugaaagucugugauuccaaggaguuguucugcaucuuucuggugcugacucugcucucaaggcaaaugugacuuuuuucuucucuuuugacacuuccaucacuuuagccuacaucuccuguaaauaaggccaaugcaucugaccuuacauaaucucuuccugguuguccugugcaccauccuucuuuucaaggacuuuggaaugacccaauaucugauagaggcaccuuaaauguuuauugaaugaauaaguaaacugggucccaccccauggguuaguagcuuuuuucuaagaacaaguuggaaaugccucugaagauuuuauguuugaccaggagaagccagugaacucugaaucacaaaauugaggacucucaguugaaagcaccccuugagguuguucagaccagccuucucuucccuggaacauaaucccugcuugaauccucucuucagcaauauguguauagaugugagagaauuuuugcagucuguuggcuagcuuuccaugcaucauauaaaaacaguccucuuauagacuugacuugccaguucacacacaugacaaguuccagcuuuuuuuuuuuuuuuuuugaguauuuaguagagaugggguuucaccauguuggccaggcuggucucgaacuccugaccucaagugauccgccugccucagccucccaaagugcugggauuucagguguaagccacugugccuggccucuagcauaccuuugguuuucuaaucaaacauuauuauguccuuauuuugugcauuacaaagcucugccuaaaucacuuuuucaacaccugcuagaaugcuuaggaauguuuauguugucuuagggagcagaggcuccauauuaugacccaguucugcugacuugcucccccgccgccacaaaaguuaggguugagccaaaacuuccugccaguuaucgacuuguguuucccaagauuaaaaaauaaaaaaguugugaaaugcuuauucagauguuauccagguacuggguaaaaugaucuuaauuuguuggaguuuuuagaacuucucgaucuaaaaguuuccuuuuaaagaagugucugaauugacauucucauaaguauguucuucaggccacuggucugaagaaguggcucugaaaaaaggauuugaugcuaauaauaaguuugagaaagccacauaccauuauucuuucuuggagcuucucaauguguaauaccacauuaaaaccacugagagguccugcaauaaggaaaugugccuuauaagccaagauaauaacuuguuccauuuguuuaaucuacuugaugucaaaucuuuuuuuuuuuuuuaauugaagcacacguuagcaaauucugaccuagaguggggaucugcauacuauauauaggcugugaaccaaaccuggaccuacugcuuguuuauauggucugugagcuaagggugcuuuuuacauuuuucuuucuuuuuuuuuuuuuuuuaagacggagucucgcucuguugcccaggcuggaaugcaguggcuccaucucagcucacugcaagcuccgccuccuggguucaugccauucuccugccucagccucccgaauagcugggacuacaggcgcccaccccgaugacuggcuaauuuuuuguauuuuuaguagagguaggguuucacuguguuagccaggauggucuugaucuccugaccucgugaucugcccgccucagccucccaaggugcugggauuacaggcgugagccaccacgucuggccugcuuuuuacauuuuuaaaugaugggaaauaaaagaagaauaauauuacauaggugacaauuacaggaagauaaaauuucaguguucauuucagucacacccauuuauuuauauucauauauauuuacauauugucuuugggugcuuuaaugcuacucaguggaguugauuacuucccauaaaaaccauaugguccacagagucugaaguauuuacucuauggcccuuuauggaaaaaaaauugccaauuccugaccugcaucguguacauuuuuuuuuuuugagacagugacucgcucuguugcccaggcuggagugcaguggcacgaacauagccuacuacagccuugaccuccugggcugaagccaucuucccaccucagccacccgaguaguugggacuacgggcacacaccaccacacccagcuaacuuuuagguuucuuguagagaugaggucucacuauguugcccaggcuggucucaaaucuccgagcucaaaugauucuccugccucagccucucaaagugcuaggauuacagguaugagccaccacucccagccauguauuguuuuuuaacuuuuuauuuuauuuuauuuauuuauuuauuuauuuauuuauuuauuugaaacggagucucacucuguccuccaggcuggagugcaguggcgcaaucucggcucacuguaaccuccaccucccgggcucaagcaauucuccugccucagccuucugaguagcugggacuacaggugcacgccaccuugccuggcuaauuuuuguauuuuuaguggagacgggguuucaccauguuggccaggauggucucaaucuccugaccucaagugauccacccaccucagcuucccaaagugcugggauuacaggcuugagccaccgugccuggccccuuauuauuauuauuauuauuuuuuagauggaguuucacucuuguugcccaggcuggaaugcggugggacagucucagcucacugcaaccugugccucccagguucaagcgauucuccugccccagccucccaaguagcugggauuacaggcaugugccaccacaccuggccaauuuuuguauuuuuaguagagguggguuucaccguguuggccaggcugguccugaacuccugaccucaggugauccacccgccuuggcaucccaaagugcugggauuacagccgugagccacugcgccuggccuuuuuauuuugaaauaauuuuacucuuauacuaaacuugcaaaaauaauucacaaacuuucuguauaucugucaucuaacuucaccuaaugucaaaacuguacauaauuauaucagaauuauccaaacaagaaauuuaacauuaauacaauauuacuagcuaaucuagagacuuuauucagauuuugcuauuugucccacuguguccuuuuucuguuccaggacccaauccuggauccuacaucacauuuaguugucaagucucccuggucucaucagauaucugggacaguuccucauugucuuuuuuuuuuuuuuuuuuuuuuugagacggagucucacccugucacccaggcuggaauacaguggcaugaucucagcuaacugcaaccccccucccggguucaagcgauucuccugccucagccuccugaauagcugcaauuacaggcgugugccaccaugcccagcuguuuuuuguauuuuuaguagagugggguuucaccauguugggcaggcuggucuugaagucccaaccucaggugauccaccugccucggccucccaaaguucugggauuacaggugugccaccacacccggccugcauuugcacuaaaauuuauuuuuuuuuuaauuguuuguuuuugagauggaauuucacucuuauugcccaggcuggagugcaguggcgcaaucuuggcucaccgcaacaucugccucccagguucaagcgauucuccuaccucagccucccgaggagcuaggauuacaggcaugcaccaccacgcccggcuaauuuuguauuuuuuuuuuuuuaguagagacaggguugcucuauguuggucaagcuggucuggaacucccggccucaggugaucugucugccucagccucccaaagugcugggauuacaggugugagccacugcgccuggccauuugcacuaaaauuuaugaggguuccaguuucuccgcauccacaacacuuguuauugcccacuaaaaaaauuauaucucuccuagugggugugaagugauaucucauugugguuuugauuugcauuuccuuaauggcugaugaugaugaugaugauguucuuauuggccaucugcauaucuuauuuggagaaaugucuguuuagaucuuuugcucauuuuguaauugaguuauuuguuaucguguacaauuuugaauguagguauucaaagaguuugcagaucucuugaaauaacucagugauuugaccugcaaauucugaggcaaugccaguaugucccugaucugaauguaguuggauuuggacauacuaaagcacaaaguaaauuuccauuugaggcuacugaccaugcagagcuugacucaaacccagccacuucuggccauguggaguuggaguggccaugggcaagugaaaggaaggguacuauuugcguccagaaaugagguugucauccaagauaugauaagacuagucagggagccuucauuuugggugccacucugcuguaugucugguuauaggcagggaguagaggagucaguggugguuugaaugcucaggacuagcugcucauagcuacauaacuacagugcuccuaggccuaucuugacccuacagcauuuggccauaaccaaaccaucuuggacacauaccuugaaacaaacaaaagcuucaguaauguaaauugugaaaguaguaugugcuuauuuuauuauuauuuuuuuuuagagauggagucuugcucuguugcccaggcuggagugcaguggcacaguguugacucacugcagccuccaucucccagauucaagcaauucucgugccucaguuccugaguagcuagaauuacaggcaagugccaccaugcccgacuaauuuuuguauuuuuaguagagaugggguuucaugaucuuggccaggcuggucucgaacuccugaccucaagugauccgcccaccucagccucccaaagugcugggauuacaggcaugagccaccaugcccugccgaugugcucauuuuagacauuuugggaaauacagaaaaaucucccucuccccacccuagucaucccuagcucuaguaucuagagaaccuuuguugcaguugcuauauuuccuucuuguuuccugcuacggggcacauuuuuaauaguuggaaucacucacuguacacagguccauaucuugcuuuuucuuauuaacaucuaaaacugaagaaaacacacacuuuaauuuuaaugucuccauguuuuugccagccucuucuauaagcauuucuucuucuucuucuucuucuuccccuuccccuuccccuucccuuccccuccuccuccuccuccuucuucuucuucuucuuccucuuccucuuccucuucuucuucucgagacagagucuggcucuguugcccaggcuggagugcaauggugcgaucuuggcucacugcaaccuccaccucccggguucaaaugauucuccugccucagccucccgaguagcugggauuauaggugccugccaccaugcccagcuaauuuuuguauuuuugguagaaacgggauuucaccaugcuggccaggcuggucucgaacuccugaccucagacgauccacccaccucagccucccaaaguguugggauuacaggcgugagccaccacaccuggccuauaagcguuacuucugauggccuacauagauuuccauuuccuuaacuguucauuuauuuaauaagucuuacuauguagacguaauguguauaauaaguacuugguguguucuuagugggauagaaauguaguuuugauuuuuaaauaaggagcauagauuuucuuaaaauuuuuuuuauugugguaagauguacauaacaauauuuacuguuuuaacuaauuuuaucuauuuaaauuuuuuuugagauagggucucacucuguggccuaggcugaaguguaguggcaacucacugcagccucaaccucugaggcucaagcaauccucuugccucagcccccuaaagugcuggaauuacagcagugagccauugugccuggcccauuuuaauuauuuuuaaauguacaauucaguggcauuaaguaaauucacaauguuguauaaccaucaccacuauuucuaaaacuuuuucagcauaccaaacagaaacucuacccaugaagcaauaacuccucauucucuccuccccccagcuccugguaaccucugauccacuuucuaucuguaugaauuugccuauucuggauauuucuaauaagauucuaauaagaaaaucacacaauguaugaccuuuuauggaaacguagggggguuuuuuccuuuuuuuuuuuuuuuuuuuuugagacagucucacuccguugucacccaggcugagugcaguggugucaucucagcucacuucaaccuccgcauccuggguucaagcaauuauugugcuucagccucccaaauagcuggaauuacaggcgcucaccaccacaccuggcucauuuuuguauuuuuaguagagaugggguuuugccauuugcccaggcuggucucgaacgccugaccucaagugauccgccugccuuggcuucccagagugcugggauuauaggcaugagccaccguaccugggcccaguuuuuuaaauuguagugaaauucauauaaaauuuaccaucguaaccauuuuuuuaaauguacagcucagugguauuaaguacauucauguucuagaaacaucaccaccaucuaccuccagaacuguuuucaucuugcaaaagugaaacucugugucuauuaaacaauaacucccuauuucuucuucccccuagccacugccaaccacuauuccacuuucugucucuaugauuuuguuuacucuaaguacgucauauaaguagaaucauacaguauuuguccuuuuuauuuuugaagaugaggccuaaccguguggcuggugucagacucuuggguuuaagugaacuuucugccucagccucccaaguagcugggguuaugugugggcaccacugcacccagcuuaguauuugucuuccuuugacugacuuacuucaccuaacaugauguucuugagguucauuuauguuguagcauaugugagaauuuuucuuccuuuuuaagauaaaaugauuuuccguuguauguauuuugcuuauccauucaucugucgaugcaaacuuggauugcuuccauguuucagcuauugugaauacugcuacugugaacauugauguauagcuauuucuuugcgaccuugcuuucaauuauuuggguacauaccuagagguagaauugcuggaucauaugguaguucaguuuuuaauuuuuuugaggagccucugugcuguuuuccacagcagcuguaccauuuuacauucccaccaacagagcacagggguucuauuucucuacauccuugccaaaacuuguuauuuucugguguuauaaaaauaguagucauucugaugguaucucauugugcuuuugauuugcauuucccugaugauuagugauguugagcacccuucuguguacuuuugggacauuuguauuucuucuuugaagaaaugucucuauucaaguccuuugcccccccgccccaccaccacccuuuaaaaauuuuuuuugagacagagucucucucucucuugcccaggcuggagugcagugguggaaucugggcucugcaaccuccaccuccuggguucaagcaauuaucuugccucagccucgcacguagcuggaaguacaggcgugugccaccacaccuggcuaauuuguuuuguauuuuuaguagagacaagguuucaccauguugcccaaguuggucucaaacuucugaccucaagugaucugccugccuaagccucccaaagugcuggaauuacaggccugagccaccauaccuggccccacuuuugaaucagguuguuuguuguuaaguuuuaggaguuaucuauguauucaggauauuaauuccuuuucagauauaugauuugcaaauauuuucucccauucugugaauugccauuuuacucuauugguagugucuuuuuaugcacaaaauuuuuaaauuuuuaugaaauccaauuugucuacuuuuucuuuuguuaccuguacuuuuggugucauuccaagaaaucauugccagaaauauaguuuuuaaagucaugaccaaguggcuccugguuuaaaauucucagaggcggcccuaauugcugccugguuaucauacccuacuucucuuuuuuuaauuuuuaguuuuuuaaagacagggucucucugucgccgaggcuggagugcaguggcgugaucucagcucacugcaaccucugccucccggacucaagcaguccucccaccuuugccucuugaguaguugggaccacaggcaugcgccacugcucuuggcuaauuuuuguauuuuuuuguagagaugggguuuugccauguuacccaggcuggucucaaacuucugggcucaagugaucugccugccuccaccuuccaaagugcugggauuacuggcugagccaccacacccagccuucaaaccguacuucucuacucugcaucugcuguagaugacaggaguccaucucuucauuucauuggucguugggaacaaagcucccgaguguuggauccuugucuuccagcuggccuaaggacaugcaaagauuagaagcagcacuucuauguucauugagccagauugugucugcuucuguggaaauggccuaggggacucacuggccauucuguccuggguccaguugccagguuaauuccugugauaguuucuauagcaccugacucugauacucgcucucuuaauugcuccucagaagugccuugugauguaacagugaugugguuuuuuguuuuuuuuuuuuguuuguuuguuugagacagagucuuguucagucgcccaggcuggagugcaguggugcaaucucugcucacugcaagcuccgccucccggguucaugccauucuccugccucagccccccgaguagcugggacuacauuugccugccaccaggccuggcuaauuuuuuucguauuuuuaguagagacgagguuucaccauguuagccagauggucucgaucuccuuaccuugugauccacccgccuuggccucccaaagugcugggauuacaggcaugagccaccaccucuggccagaugugguuuuuauuuuuuauuuauuuuauuuauuuauugagacagagucucacucugucacccaggguggagugcgguaguaugaucucagcucacugcaaccuccaccuccaggguucaagcgauucccaugucucagccuuccaaguaacugggauuacagacaugugccaccacacccagcuaauuuguauuuuuuaguagagauaggguuucaccauguuggcuaagguggucucgaacuccugaccucagaugauccacccaccuuguacucccaaagugcugggauuacaggugugagccaccacgccuggccagguuuuuauuuuuuaauauuuauuuauuuauuuuugagacaaggucuuuguaugcugcccaggcuggucucaaacucuuguccucaagcaauccuccugccucagccuccugaguagcuggcauguuccacugugccuggcauguggggguuuuuaaagauggacaggucucugaauacaggaguggauccugggcaaagccuaaggaaguuuguuguuuuuucuuaacacuaucaucucugccaaggcacuucuuagugugagaagcuuuuuguuuuuuaauaguuacauucugacuugguuauaaacuccuugagcacaggaaccaggaccuucucugauuuacuuauuuauuuauuuauuuauuuauuuauuuauuuuugagacagaguuuuguugcccaggcuggagugcaauggcgccaucuuggcucacugcaaccuccgccuccuugggucaagugauucucccgccucagccucccuaguagcugggauuacaggcgcccaccacuaugaccagcuaauuuuuuuuuuuuuuugguguuuuuaguagagacaggguuucacuauguuggccaggcuggucuugaacuccugaccucaggcgauccacccgccuuggccucccaaagugcugggauuacaggcgugagcuacugcacccagcccugauuuauuuuuaucaugggucugguaguuggcauucucuaaguguuugccaaacagcacugguaacaaauacaauggagguggcucaaggcacaagagcaauuuguaaaagucaauauuauagacuuuucaaaaugguaucauuuugguuuuaucuuuaaucacaguugguccuagucaggaccuucuguugaaagaagugagaggcugggcaugguggcuugugccuguaaucccagcacuuugggaggccgaggcaagcggaucaccugaggucgggaguuugagaccagccugaccaacauggagaaacaccaucucuacuaaaaauacaaaauuagccaggugugguggugcaugccuguaaucccagcuacucaggaggcugaggcaggagaaucgcuugaaccuaggaggcggagguugcggugagccaagauugcgccauugcacuccagccugggcaacaagaacgaaacuccaucucaaaaaaaagaaaggagaagugagaucauuguuuugucaaguauauaccggguauuaaaauuuaaaaaguuuucuacuuaauugguuagaucuugucaaacuuauuguuuuuauacucuaccuucagaauaucuuagaggucuuuagcucaaccucagguaaaauaugaauuaaugacauuuuauagaauaugaauuaaugagauuucacugacugugugaaaauaaaagugaaaccuggccaggugugguggcuaaugccuguaaucccagcauuuugggaggcugaggcgggcagaucacuugaggucaggaguucgagaccagccugaccaacauggcgaaacccugucucuacugaaaauacaaauaaauuaggcaggcauuguggugcacaccugcaaucaugaauucagaauauuaaucuuacugcuuccucauuaauuucuuugucuaauaggggcuaggcacuguuucauacuuauuuaaaauaacaacaaggcugggcgcgguggcucaugccuguaaucccagcacuuugggaggccgaggcaggcgcaucaccugaggucaggaguucaagaccagccuggccaacaaggugaaacuccaucucuacuaaaaauacaaaaauuggccagucaugauggugcacaccugugguccccgcuacucaggaggcugaggcaggagaaucacuugaacccaggaagcagagguugcagugagccaagaucuugccacuacacuccagccugagcaacagagugagaccccgucucaaaaaaaaaaaaaaaaaaaagcaaaacccuuauuuuuuaaacuuuucucaugacaaagggauggcuggaacaauuauuccccauuugcagguaaggacacuggcauagugagugacagaccugagccuuaggcuaaguccucuggcuccagauuauuucuuucaugguguuauacuagaaauucacagcccuugacugguaucuguccagucugaagagcuuuucuuuaaaacacuauuuuccucagcuguauugguuugauugaaauuaaauccccuucauucauucacauaccuuaaucaaacaucuacuuccugucaggaacugugcuguuggcccuaggagguaucucacuggaguggguaauaguucaguggauaaccaaaccucugugugaguauguuaucuuuaauagggagaaauuugagaaaacuugaaacuacuucugguugcagaucccucaauuuuuuuuucauuuguguaagaguuuuggguaauacuuaaaaaaaaaaaaauugacucuaaguuauguaacauuuccaguucugaacagcauguuuugcuguuauaggauacugauuuuccacaacucuaguuggcuauauugaguuguacaguucuaauugcuccugggcaucagaucugucaacucauucacacacacacagacacacacacacacacacacacacacguauguauauaucaggugcuccugaggcaccuagcccugugcugaguaaggaaccuggaagcugggucugcgcuugacaagacgcacaagaacagaucacugaguuaccauuuguuaaggacguuggcuuggguugggaagcuuugccucugacuaggucugugaccaugggcaagugaccuaacuacucugagccuuuauuuaacaucccaagggaugcuaaugaugauacaguaguguuuaccuaaaggcaggccauaaagauuaaaugagauaauucauguagagggcugagcaguguuagcuauguuacuuauagugauaagaaauauaacaaguguccccuaauuuuaacacuuggggaaaaucugauuuucucugggucaaauuguaucuaauuuuagauuuccucucaguucauaaacauacacaguucugaugucucaucuacucugcauucaaggaaugaugcucauugagaaaggaaaguugugacucauuuacucagcaaauuaaccaaguaccugcugguugcauaugucuaugaggaauauacaaaaacaguuuaccuucagugaacucagagaccuuaaaagggagggggauuaacauuucaugaguacuuaacuaugugccaggcacuaugcuagucccguacuguuuuaucucuauuucuuagaacugucuugugaggaagauauuagccucauuuuagcaaaugagaaaaacaaaggcucagaaagaaaauaacuugucugaaaucacagaauaaguugcagagcugagauuugaacucagccaucacauuccucugugccgugcuaguuuuuaaggaaaaaaguuaaggaacauuuuaugacaaaaggcaacuucuuagaugacacuuaaaaguuugugccagugguaguacaaaucccauuucacucuuuaaaaaaaauuuuuuuuuuuaauuuaagaaacagagucuccuucugucuccuagguuggagugcaguggcgucaucaucgcucacugcagccuugagcuccugggcucaagugagcauccugccucagccucccaaggagcuagaacuacaggcacacgccaccauaccuggcuaauuuuaaauuuuuuuggugauggagucucacuauauuguucaggcuaguuuugaacucuuggccuuaacugauccuccugccucggccucccaaagugcuaagauuacaggagugagccaccauucuuguccuccauuuuguccuuuuuuaaaaaugaaacaugguaauuuuucaaaaauaauugaagcuuaaaacccaacaaaugaacaaaacauucuuuguauuuaaaaauaauggaagaggcugggugugguggcucaugccuguaaucccagcacuuugggaggccgaggugggcggaucaccugaggucaggaguucgagaccagcuugaccaacaugcugaaacucggccucuacgaaaaauaccaaaaaaauuaguugggugugguggcgggugccuguaauccuagcuacuugggaggcugagaugggaggaucgcuugaacccaggaggcagagguugcggugagccgagaucgcgccguugcacuucaguugggcgacagagcgagccuccgucucaaauuaaaaaaaaaaaaaaaaaguaguggacgaaaaugugaaaaaguaggaacagcuggcucuagaauccccacucagauauguguuaucucugggcuugguggcugauugccuguaaucucagcaauuugggaggccaaggcugaggcagguggauugcuugagcccaggaguucaagaccagccugggcagcauggcgaaaccccaucucuacaaacaaacaaacaaaaaacuagcuggaugugguggcgcacagcuguaaucccagcuacucaggaggcugaugcaggagaauugcuugaacccgguagguggagguugcagugagccgagaucacgccauugcacuccauccugggcaacaagagugaaacugucucaaaaaaaaaaaaaagccauauaucaucuuuuggaaaacauacaugucauugucaaggacuuagggaaacaaaugucuuauguauuucucauaggaauauaaauuggcacaucuucccuggggguauucagcacugucucaaaguuacaaauauaaauacuuugacccugcaguucuacuucuaggguuuauacuaauaauauagucaagcagucuugaagguagaaaacagggcuguuggguuccagggauagggagagacuuuucagccuauauccuuuuguuguaccuauugaauuuugagccauguaaacguguuacuuauuaaaaaaauaaauucauaaaauuaaaauuguuaaaauuucugagaugauuauuauucuaaggaccauucacaccucaguugugaauguacuuaauucagauugguuuccuuuuuguucucuacugagaucugaagguauuggaccuuucacaucuuuuauuuuguaauuugagaugggagcucucuguguugaccaggcuggucucgaacuccuggccucaaccaauccucccaucuuggccucccaaagugcuaggauuacagaugugagccaccaugcuuggccuauuuucuccugaguauuaacagaguacucacuauggaaaagguggcaaguacauguaaguauuuuuuaaagcuuaagaaauuuguccauaaguccacuguccggagacuacuacaguuaauauuuuugaccucuuuuuuugguaucuuuuuaaccugcugauaacaaauaaauucaauuuuuuuuuuuuuugagacagaaucucgcucugucgcccaggcuggagugcagugggcucgcugcagccucucccucccagguucaagcaauucuccugugucagacucccagcugcuccaaauccugggcucaagcaaucuuccugccucagccucccaaagugcuaggaaugcagguaugacccaccgcaccuggccacauauauauucaacuuuguauacaauuuuacauccugcuuuuuucuuuuucuuuuuuuuuuuuuuuuagacagagucuugcucugucacccaggcuggaguguaguggugcgaucucagcucacuguaagcuccgccucccagguucacaccauucuccugccucagccucccgaguugcugggacuacaggugcccgccaccaugcccggcuaauuuuuuguauuuuuaguagagacgggguuucaccguguuagccaggauggucucgaucuccugaccucgugauccgccugccucagccucccaaacugcugagauugcaggcgugagccaccguguccagcccauccuguuuuuuucacuuaacauuaugucauguaauugaaauuccuacguaagcaaaaucucuguggaagcauuauuuuuaguggcuguguaaucuauuauguggacguaccaguuuauuuaaccagguaaugggagcuaguuggggagaaaaagagacguuaaaaucauggagcccuuuggaagguuaggcagaucuggguuagguacccuauaggguaugugagccaggcaggccagggcugaagggcacugagagucaaaggcuuuucuucuucccuuagucccagcccuugcugccuuaccaugaauuaugcacuuguuccuuguacugugucuacauccuccccagcauucccugucuucagguacuauguacacacuucugucaguucccaguacacuggguugccuuguugguucacuugucugugucucccuuuagacugaaaaaaaaguuuuauuucuguaucuugaaugccuggcaaauaauaggaucuuuaaugaaucuuugaagauucauuccuaucuacuaaguagauaggaagauuagagggaaccagagaaaaggaccagugcagccccaaugaaaagaagccaguccuuucagccuucucuguucuucugauccuguauuugagggccaaaucuccaugggcuagccuaggaaccuaaacaccacuuagacuuuaaaauuucaaagcugguuuauguguuuccaaguuccaauaaacuuauucagaguucuucccauuccagccuucuaugagugugauguagacauucuuggaaugcaggucccauuucugccuacgugugguccagcagcagucuaaugagcagcguagacaggcucaggcaugccaggguuccuggcagaaagcuucugugugaauaagcaugugcucacagaaaugagaccucugcugggaucaugccuguuauuuaucacccaaauucauagucuucauaucuaagauuaacauuucuaggugucucacuacacccuggucuagaaauucuuggaguuaaagggacagaaaaggcagaugaugaauuccuacaguucucuagaacuugauaauugaauuuaagaaugcuacagagaaauuuccucaugagaucaaguucccuggugguuccugcagggauauucaacucucguguucucuuucuugcucaauuccugugaggugggccagaccaaguagaccaaaggccagcucugggaagguaauauauugaagauacugggucagucaacuucagccgccaggcucuguguuccuacaggaucauuaaguauugcaaauccgcguuagucccagcaccacauguguugcccuggacaucucaaaguuaggacuguuuuuuaaaacuaggugugaacuuauuucuuaaaaugaucagcuguguuccaguuggacuaaaugcugauuaaucugaauucagcagauuugucccuuaccccccaaguuuaucugaccucucuguagucccuguggauuguagcuggauaggcccugagguuucuguccuucuaaaauacuguauuuuguugguauugcuuugugcuauugauagagcuguacccucuucuagagcuggguuuccaaaacucuguuaauuagagaaucaucuaggguagaaagugagggcuacauuaaaagcauacagauucuuaggccugaucuagguccagauccuauuuaaaucucugaagggaucugggaaccagaucuuucguggggugagaggaugcuuuguuuaagaaaaacaggcaaaaacaacaacgaaaggaaaaacaggugaguuugauggagccccuuguuuagaauucuuaaaauuaaucuaugugccuucagcuccuguacuagacuccaagaccucaacuuggucuuauuccucuuuguaacuccuccacaguugguagcaccagaccucaaauguaauuggcauuggaaaacugcugguugguugaaugaauaaguggaugagugauuaauuuacucuguacucauuucaaacagcacaaaaguuacaacauugcacgauaaauuugagggaagacaaaaaccagguauuuaauuuuguaaagcagcauguuaauagaaaaacauaagaaugaagagagugcugaauauuguguuaggaagucugaauuuggcauugcgugguguccuggccuuaggcaguccucuaaugucccuggcccaguguccucaucuguaaaauggcaugaggauaaaaugcagcgauagaugugaaaugcuuugaaaacuagagaguggauucuggucaggagaaaagaauggucaggguagggacagaggcacagaacuagccacaacaagguugcucugugguuaggugaaagucuauagcuucuacagggaccaugagaaauuuuagcaggauggccauauagguaugcucaggaccugauucucuuucugccuaguuccugagccgaucaggaaccucuauguuuugggccacugucccaguccugguagacccauaugguucuguaggugcucaguagacaauccccaggggaagcugcugauuucugccaugccaccuugguguacugagauuccugugcauagguguaggagaaggugagaagagguggcuccagggaugaguaugcagcuguggggcccagaauauguuacaaagaaaaguuggugaccagccagcugggaguugaccaaagucagucaugcgugcccauccucacucagcaaauauuugagugccugcuaggaugaggcuguagauccuggguggggaccauguggugucuacuaagauuuacaaggagagugauauggccugccuacaguugggacaugcaggccugucucagugccuggccuggcacaaggcugccacucccugcaaacucugagcugaccuguuacugucccuuaaccauuccuacuccaacaccuaccuugauccugguuguccccucaugccuguguguaggaguaugggccaugcacagcuuuguuggguccacgaagugggguggcaguggaccagguuacaugguaugaaaugugugccuccccaacagcaacagcccuguccugccuuggagggcccuccaggucacuguguuauuucauaaggccaccucaguagccauguaggaggcaugauacucucacuuuucaggugagaaaagagauucaaaucaucaagagaucuaccguggccauauggacagucagugauggaaccaggacuugaacucagaacuuucaggauuggggaaaaccagaacaugggguggaaaccagaacauggcgggggggugggggguaggaaauuuuauguauuauuauucuuuugacugauuucaaaaguaauacauguaaaggccgggugcaguggcucacacguguaaucccagcacuuuggaaggcugagguggguggaucaccugaggucaggaguucaagagcagccuggccaacauggcgaaacccugucucuacuaaaaaguacaaaaauuagcugggcgugguggugggcaccuauaagcccagcuacucaggaagcugaggcagggagaauugcuugaacccgggagguggagguugcagugagccgagaucacaccacugcauuccagcuugggugacagacugagacuugucucaaaaaaaaagaagaaaaaaaaguaauacaguugaguauguucuuccacauuguuaaagacuuuuuuuuuuuuuuuaauacaaucagagucucgcucuaauugcccaggcuggagugcagugguacauucauagcucucugcagccucaaacuccugggcauaaguaauccuccuaccuuggccucccaaaguacuaggguuacaggcaugagccaccaugccuggccuaaagccauuuucuaauaccuauauucauuauuguaacauauguaaaauacuucacauuuuaugauuuccuuuuuaaaaauguucuugugaaaguaauacuuauuuguuauaaaacauugaaacaggguaagaauauaauaauucaaugucuccuagcccuuauaaucccagaaauaacuguugaugguuuaauguguauuuucuaggcauuuucucucucucucugugugugugugugugugugugugugugugugugugugugugucugccugucugucuguguauggauccacacacauacauacucauauacauacuuaguuuuuacccaaauaaguuuauauacauacucuucuacaacuuaaucuuuuuaaaaaauaccuuuuauuggggcuaggcaugguggcucacugggaggcugaggcaggagaauugcuugagcccaggaguuugagacuacccugggcaacauagaccuuguuucuacaaaauaauuuaaaaauuagcugagcaugguggugugcaccuguaguccuagcugcuugggaggcugaggcaggggauugcuugagcccaggagguugagcuugcagugagcugugauugcaccacugcacuccagccugggcaacagagcgagaccaucucaaaaaaaagaaaaaaaaaauaccuuuuauuguaauuuucaaacacacacacagacuauuacagugaaccuccauucaucacccagcuucaacaaccaacuuccuuguucuuguuucaucuuuucucuccauuuuuauuuuuuuccccuggaguauuuuaaagcaaaucccaaacauuguauugcuucaaaaauaugugucucuacaugcacacguauguuuauugcgggacuacucacaauaguaaagacuuggaaccaagccagauguccaacaaugguagacuggauuaagaaaauguggcacauauacaccauggaauacuaugcagccauaaaaaaugaugaguucauguccuuuguagggacguggaugaagcuggaaaccaucauucucagcaaacuaucgcaaggacaaaaaaccaaacaccucauguucucacucauaggugggaaaugaacaacgagaacacuuggacacaggaaggggaacaucacacaccugggccuguugugggguggggggagggggaagggauagcauuaggagguauaccuaauguaaaugacgaguuaaugggugcagcacaccaacauagcacauguauacauauguaacaaaccugcacguugugcacauguacccuagaacuuaaaguauaauaaaaauauauauauauuuaaaaaaaugugucucuagcagaucagguuuuguuuaaaaaaaaaaacacaauaucauuauuauacccaacaaaauuaacaguaauuccuuuuuuuuuuuuuuuuuuugagacaggguuuccacucugucacccaggcuggagugcagcagcacaaucacggcucacugcagccuccaccucccaggcccaagugauccucccaccucagccuccugacugucuggggcuacagguguguaccaccacacccagcuaauuuuuuauuuuuauuuauuuauuuuuuuugagacagagucacuaugucacucaggcuggaaugcagugguauaaucuuggcucacugcaacuuccgccucgcaagcuuaagcgauucuccugccucagccucuggaguagcugggaccauagacaugcaccaccacacccagcuaauuuuuguuuuguuuuauuuuguuuugguagagauaggguuucaccauguugcccaggcuggucuccaccuccugagcucaagcgauccaccuaccuuggccucccaaagugcuggaauuauagacaugagccaccaugcccagccaacaauaauuccuucauaucgaguaauaccuaggcuaaacaguuuuugucaaucaugucacaagugucuuuguacaguugguuuguuugaaucuuguuccaauaagacccacauacuacaagugguuggaauaucucguaucucaaucuauaaccccaauccuguccaugcuauuuauuuuuuguagaacuuuauuguuuguccuguagaaagucccacauucuggauuuggcugaugacaucuucauggagucguuuaauacuugcaccuauccuccauauuuucuguaaauagguaauuuauuuuauuuauuauuauuauuauuauuauuauuauuuuugagauggagucucucucuugucacccagguuggagugcgaugacacaaucucaguucacugcaaccuccgccucccggguucaagcgauucucaugccucagcuucucaaguagcugggauuacaggugugugccaccaugcccagcuaauuuuuguguuuuuaguagagacaggguuucaccauguuggccaggcuugucuugaacuccugaucucagguauccaccugccucggccucccaaagugcugggauuacaggcgugagccaccaugccuggcugguaauucauuuuagaugcuugaucagugucugaguuuuaacgcaaacauguuucauugguggugcuguguacuucuguugcaucacaucaggaggcugaugugacugaucugacuuuaugguugucuuuccaaaaucuauaugcauaauuuuuaauuuuuuuuuuuuuaauuuuaguauuuauugaucauucuuggguguuucucggagagggggauuuggcagggucauaggacaauaguggagggaaggucagcagauaaacaugugaacaaaggucucugguuuuccuaggcagagggcccugccgccuuccgcaguguuugugucccuggguaguugagauuagggaguggugaugacucuuaacgaguaugcugccuucaagcaucuguuuaacaaagcacaucuugcaccgcccuuaauccauuuaacccuuaguggacacagcacauguuucagagagcagggguuggggguaagguuauagauuaacagcaucccaaggcagaagaauuuuuccuaguacagaacaaaauggagucugcuaugucuacuucuuucuacacagacacaauaacaaucugaucucucuuucuuuuccccacauuucccccuuuucuauucgacaaaaccgcuauugucaucauggcccguucucaaugagcuguuggguacaccucccagacgggguggcggccgggcagaggggcucccaccucccggacggggcagcuguccaggcgggggcugccccgagcucccggacggggcagcuggccgggcgggggcugcccccccccaccucccggacggggcggcuggccggucgggggcugccccucccuucccggacggggcggcuggccgggcgggggcugcccaccaccuccuggacggggcagcugccgggcagagacgcuccucacuucccggacggggcggcugccgggcagaggggcuccucacuucucagacaggguggcaggucagagacgcuccucaccucccagacggguggcgguggggcagagacacuccucaguucccagacggggucgcggccuggcagaggcacuccucacaucucagacgggguggcggggcagaggcgcuccccacaucccagaggaugggcggccagggagagacucuccucacuuccuagacgggaugaccgccggggagaggcgcuccucacuucccagacugggcggcugggcagaggggcuccucacaucccagacgaugggcggccaggcagagacgcuccucacuuccuagaugggguggcggccgggcagaggcugcaaucucggcacuuugggaggccaaggcaggcggcugggagguggagguuguagcgauccgagaucacgccacugcacuccagccugggcaacauugagcacugagugagcgagacuccgucugcaauccuggcaccucgggaggccgaggcuggcagaccacuggcggucaggagcuggagaccagcccggccaacacggcaaaaccccgucuccaccaaaaaauaugaaaaccagucagguguggcggcgcgcgccugcaaucccaggcacucggcaggcugaggcaggagaaucaggcagggaggcugcagugagccaagauggcggcaguacuguccagccucagcucggcaucagagggagaccgugcaaaggggagacgaggaccgugcaaaggggagagggagggggagggggagggagagcaauuuuuaauuuuuuaagauuuuuuuuuuuuuuuaaaaagaaacacacauagguuggguacuuaggauugauuguugagcuggaauaaugaggaaagauaguaauguggcccucaaaaguggguuuuauccuaagaugaagagagcacauguaauaugaagaagaggaaggucagagagaaggucuuggagccgaggccagcgcacgaaacuggugccaccagcauccagcuacccuucugggacauuauguaaaaugauguaacugagugaaaaaguggugagcuggccuccucucucugcucaagucacugagcugguaucguggugagggauacucaugaggccagagcucugaguccaccgugugaaggcaggaagcuuucugggucugagaaggcuguaacuuuuuugguccuugucuucucauacucuggaagcugacaucagggugaccuucugguguuccagugguaaguccuaaauuugugaaggggccgcuuguuuuggagguaacaguagguuaagaugaccuggagaggcacagucuaagagcuggagggggccacccaggacaccagggaguccagugccucauuuuacagaugagaaaauuaugaucaguagagggaaagggagguucccagaaccaccuagcaagcuagaggcugaguccaguauccaggccuccacuucucugacugugguagccagcgaacauuuccuacuuggaauuucugaggugaugaggguggccagauaaggcuccugacagauuguuaaugugcauccagaauuccuggguaucccuugguguugguuuuauccucuuucuuguucaacuccuggcuggguucuuugacuuggaggugguggucaacaguggucuguuuauaccagcauuuaguggccaguuuaguauguagugguacggugcaaacaggguguccaugagucccagucucagccccacauuagucagcuagccaagguaacugcaguuuccuaaagaaauuggaccagaucaagauuguccaaaacauaguaugagugugccaggugaugucaggugguaugaggguaaacuuuucauuuguuacuuuuauauuaaccuuuuuacuuaugguaaguauuacugguuuuccauuuauuacagugacauaaaccucuucuuuaaauguacugaggcuaaaaaguugauauauuuagauaaaauaaggugaauaguauuccaauguggcagaaggaggauugaaaaagauugcaauauggaagaccuuggaccagaugaucuuucugguccuuauuagcuuccuauccuuucauaguuacaggaauuucuuaauauucuggcguaugggcugggcacaguggcucacaccuguaauccuagcacuuugggaaacugaggcagguggaucaccugaggucaggaguucaagaccagccuggccaacaugaugaaaccccaucucuacuaaaaauacaaaaauuagccaggugugguggcaggcaccuguaaucccagcuacucgggaggcugaggcaggagaaucacuugaaccugggaggcagagguugcagugagccaagauugugccacugcacuccagccugggcgacagagugaaacuccaucucuuaaaaauauauauauauguucuggcauaugacaaucacaaccuuccugccucagcagauucacccaucaauauagaggcuggacagccugaacauuccauuuaauguagcauguauuugucaccuggguugauugucaugggggaaucuaaagacaagugagacaagguccugguuccuguggagaaccaucuggaggcugcucuguauuugguggaguuugcguaucugugugauauauucuggaccauauucaugagaaguuucugggucacugcccuuuggguagugcccuacaacucuugucuucuguagcgcuuugggaagucugcucagggauucagucauaaucagcucuggagccuagagaagacaggaauguuggcauggaagcuggggggagagggcugcagaaauggacagucaagaguucucugccuuuuaggauuucccuggggaaagucuucacucagagcuucgcugacagccaaggauggcaagcaaggggcccucggccucugcaucuccugagaacuccagugcaggggggcccagugggagcagcaauggcgcuggcgagagcggagggcaggacagcacuuucgagugcaacaucugcuuggacacagccaaggaugccgucaucagccuguguggccaccucuucuggucaguaccccuacuuccaccccagagagcacauugccaaguuuggaaagccuguggcccugggugguuuggagcagaaugcuuccugcucacuuugggaauacacucaggcucaagggacaagagaccugaguucccaucccagcucugcuaccaaugagcuggaugaccuugggcaaauccugucuccacucuaagcucguucuccccaucucuaaaguaauaauacuuaccauuuagugagcacuuacuaccugcuacuugcugugcugagccuagaggcaguauagcauaaugguuauaagcaaggacuguggaacugggcuuccuccuuuugaagcuugacucugccaccuuccuguuugaccuuggacaagguacuuacacacauucugccucauuuuacagggucguuugcaagcauuaaaugacucaaaauauguaaaaggcuuagaagagcacauagcuugcaguaaauacuauguguuagcuaugacuauaauuguuacuauauuuuauguuuauauauagauagauacacucaucaaaaugaagugucaaggucggugucuguuccagccuugacgguuacaggagcccuuucuggcucugagaaccuaggugcuaggugaaggucggauuuugguuuuuuguguguguguguguguuuuuuuuugucuugagauuuugagcugaaccuugaaaggucgaucaaaaaaugcuagguaaaggcgaagggugugugugucacuccaaggcagggaguuucuagggacaggcacaugcacuguuggacucaucugagacccuugaggcuacuguauaccucucacagcacucuggaugagggucugggaguguuaggaaaaauaaugguuacaguaguguugagccagauuaucaaacccagauucgacuaaagggacauagagguaaugaauauuuuugagcagagaaaucgugugaagaaaaggccguuuaaacaauauuuaagggauuuuaaguuggcaacagcguaaaacaucaauuuauuggugaauaaauagaauggagcagagauuuuuguucuugaggcucuugcccuaauuaccaucuuguguaaaagcuguugugauccacauucuccuagaaauucaggauacuucaggguaucguaaaaccaggacuugaaaugauugacaaaauuaagaauucaaagacaggauaccccugauuugauuaugugaauguaucaaauuaucacauauaacauaaaaaauguguacagcuauuauggcugggcucaguggcucacaccuguaauccaaacacuuugagaggccauggugggaggaucacuugagcccaggagugcaagaugagucugggcaacauagugaggccccacuauguuuaaaacuagucaggcaugguggcgguaccuguaguccuagcuacucgggagacugaggugggaggaaggcuugagcccaggaauucgaggcuacagugagcuaugauuguaucacugcacuccagucuaggcgacagagagagacccugucucuuaaaaauauauauauauucugggcugggcgcgguggcucacgccuguaaucccagcacuuugggaggccaaggugggcggaucacaaggucaggagaucgagaccauccuggcuaacacggugaaacccguuucuacuaaaaaaaaaaaaaaaaaaaaauuagccgggugugguggagugcaccuguagucccagcugcuggggaggcugaggcaggagaauggcgugaacccgggaggcagagcuugcagcgagcugagaucgcgccacugcacuccagccugggugauggagcaagacucugucucaaaaaaaaaauguguguguguguguguguguguguguguuuguguuuguguauguauuuauuaaauuuuauaauuauaaauuuuaagauuauaaauuauguauuuuauguauauauuaacuauacauauauuuaaauguacagcuguuguauaucuuuuuuuuuuuuuuuuuuuuuuuuuuuguggagacagccuugcucucuugcccaggcuggaguacaguggugcagucuuggcucacuugcaaccucugccuccugggcucaagugguucuccugucucagccucccaaguagcugggacugcaggaaugcaccaccacgcccggcuaauuuucuuuuuguauuuuuaguagagauggggcuucgccaugcuggccaagcugguuucaaacuccucaccucaagugaucugcccaccccgaccucccaaagugcuaggauuacaggcgugagccaccaugccuggcccugugucaaauuuuuuuuuuuuuuuuuagagacgaagucuugcuuugucaccaggcuggagugcaguggcacaaucucggcucacugcaaucucugccucccaaguucaagcaauucuccugccucagccucccggguagcugggauuacaggugcacccagcuaauuuuuguauuuuuaguagagagagguuuucaccauguuggccaggauggucucgaucuucugaccucguuaucugcccgccucggccucccauagugcugggauuacuggugugagccaccaugccugcuaucaauuuuuuuuuuaaaggcagaaugccauuggaaagaacacagacucuaaaaugaaacagaugcuuccagucuggauggugcaucccugagcaaaucugcuagcuucccuguacuuugguuuccucaucuguaagauggagaugaugguacugccucauagguuaaugugaccguccagugacauuaagaaaugaaaagguauucagccacagcguggcacacaguacagucaugcaguacauaaugacauuuuggucaacaauggauuacauauccaacagcgguuccauaagaugaugauggaccugaaaaguuccuauaaucuagugauuuuaaaauguuauagagcagugcguuaccuuuucuguguuagguauguuggauuuuuuguuuguuuguuuguuguuuuuuugaggagucucacucuguugcccaggcuggagugcaguggcgugaucuuggcucacugcaaccucugccucccagguucaaacgauucuccugcuucagccucccgagaagcugggauuacacauacgugccaccacaccugacuaauuuuuguauuuuuaguagagacgggguuuuaccauguuggccaggcuggucuugaacuccugaucucaggugauccaaccgccucagccuuccaaagugcugggauuacaggcgugagccaccacgcccagccugguuuuugguuuuuuuugagauggagucucacugcgucacccaugcuggagugcaguagcacuccagauugaguagcacgaucucagcucacugcaaccuccaccucccagguucaagugauucucgugcuucagccuccuauguagcugggauuacaggcaugugccaccacacauggcuaguuuuuguauuuuuaauagagaugggguuucaccauguuggccaggcuggucucgaacuccugaccucaaauaaucugcccaccucagcucccaaagugcugggauuacaggcaugagccaccacaccuuggcucuauguuagguauguuuaaauacacaaauauuuaccacucuguuacaguuaccuaugauacucacaugcuauucagguuuguagcuuaggagcaauaggcuauacuauguagccuagguguguaguaagcuauuucagcuagguuuguguaaguacacucugugaugcucacaaugaugaaauugccuaaugacacauuucucagaauuaucccugucguucagugauacaugacuaucguugcuuaauaaaugggaggaauggucguuguuauaaagccugacuuuccccugagggucauucauucaccuccacuucuccccuagagucuuuaagggaacuugccaguggagaucugccaugauuugggguuauucuccacucaguuuagaaugacauugcaagauuaauguuggagucagauguuauggccaggaagauuguguauuugguuugugaagcuaaacugugguucaggaauuggaaaaggaacuauccuuugaguucaaaguguacucagcuaaagauacuugguaugugagguacagaagccaugccugcauuuuccacuguccuggccuacauaguagguacacaguagauauguguuaacuaaauaaacgagagaaagaaauuaaaaaugugggccagacacgguggcucacaccuuuaaucccagcacuuugggaggccaaggugggcggaucaccugaggucaggaguuugagaccagccugacuaacacggugaaaccccguuucugcuaaaaauacaaaaaauuagcugggcgugguggcacacaccuauaaucccagcuacucaggaggcugagacaggagaaucgcuugaaccugggagguggagguugcagugagcugagugagcugcacuccagcuugggcaacaagaacaaaacuucgucucaaaaaaaaaaaaaaaaaaaaguggaguugaauacuuuucuuucaauucuguagauaucauuuuuuuuuuguaugugguguuagauuauagaaagggcaaugaacuagaagucaggagacuuuuuuuuuuaauccugaugcaguucauuuuauguuucugagcuuugguuuccucauuugaaaauggagagagauuggacagcagcucucuaagcugaagguaacccuuucugucaaguagcauccccauccuuucuauuacuuaaagaugcuuuuagaguagaccugaacuuuuaagcugcuuccugcuaggagaguucucaaggaugaggacagccugaagauuuuguuaaacuggaucuggacuaccugagaguccacacaucccuugugagcccgaggagacuaugaacccacugaaauugaguguaaaauaguguguaguacauguguaugugaaugcccccaucaauuuuuugcacaggguguccuuagcuuuuauuggauuccuucagauguuguaaccucucacagggugauuuguagagaagcugggucuguguggucugagcccuggggauuucacauauacugagaucucaggggcagaggcuggggucuuaucuccauugcguuauuuauuuucugugauuuuuaccccaguuuuuuuuuaauuuccgauaccaguaaucccuacagaaccucaaugggcaugcagugcuccauaguuuacuccuguuuucucauucugcuacuaccacuccacccaucaaguguuucugcuaaugaaaacauuuuucuuccuuuccccuuuucuccuucuccuugaugacugguugcccuggggacucuggcaguuggccguguuuacaucagguaagaugcauuucauuuuacuuugucuuucaucagcucugguugcacaagagagcccuagucucaggagacugcuuucagaagcugcaaucugcccugcuugugggcucauuugcuuacuuacccccacagccuucuuuacauaccuguccacugacagacacuugaugaaaucgggaugguccuaauucugccacagagggccuuuuuggaucucaguuacucauuuauaaauuggauuggauugauaguauguuaguuagguccuuuuuauuuuugagauucugcuucuauuaaaacagugccuccuaucauaucaacagucccccagcccuuaaagguuaugaaaauauuaggaaggggaaaauuuuuuuggugucaacaaagagcuuuugugaggagagaaaagucuauuuuccuagcuuuagcaccuacuuggugagacagagcugggccuggcauucacaaguggcugugaauaaucacagccugcugaaagucucccuggucgucagcaguagaguaccacacucguagguggccugggaaugugggggaggacagaaguuccagacugcuaaagcuucagaaucuggaugggagaaagaaggugggaacagggcugcacauucuguccccagcgggaccugguaguacauauugacuaugaguuuaugaagaacacauaacacauuaaguuuuggagcuaugaacaguaagaguaguaaauaaaaucauucagugcugccaucuccucagcccugaaguccuagauucauguuuauagaaugucuauaaaaacacauuuuggccgggugugguggcucacaccuauaauuccagcacguagggaggccaaggcagguggaucacuugaggcaaggaguuugagaacagccuggccaauauggcaaaaccccgucucuacaaaaaauauaaaaauuagcugggcgugguggugcacgccuauaguccgagcuacuagggaggcugaggcacgagaaucgcuugaaucugggaggcagagguugcagugagcugagauugcaccacugcacuccagccugggugacauagugagacucuguuucgagaaaaaaaaccaaaaaaccgaaaaaaaaaucaaaaacaagcaaaaaacaaacaaaaacaaaccaaaaacauuuuuuaucacuuguuuuuuuaagaaaauuaauuuuuuuuuuuuuuugagacagucucauucugucgcccaggcuagagugcaauggugagaucucggcucacuggaaccuccgccucccggguucaagcgauucuugugccucagccuccuggguagcugggauuacaggugcacaccaccacacccggcuaguuuuuuugucuuuuuaguagagacaacggaguuucaccauguuccccacgcuggucuugaacugcugaccucaggugauccacccgccucagcuucccaaagugcugggauuacaagcgugagccaccgcgccuggccuaaacaaaaaauuuuaauguaaccagugaaagggccugagaaacccaaaacgggauuuuuuuuauauugaaagaaauaggugaaugcaaaaaaucaaugaaaguacacaaaaagcauuaagcaaauuuagauaaugagcaaaaccuauccuuuagcaugugguaagucaccagaaaaugaucagcuuaucuccugauucugaugccugggauacacaguuguugggaaaaugcuauaaaaaugagaaauuggccgggcgcgguggcucaugccugugaucccagcacuuuggcagaccaagggaggaagaucacgaggucaggaguuugagaccagccuggccaacauggugaaacccugucucuacuaaaaauacaaaaauuagcugggcgcaguggugggcgccuguaaucccagcuacuuggaaggcugagacaggagaauugcuugaacccaggaggcagggguugcagugaccugagaucaugccacuacacuccagccugggugacagagcaagacucugucuggggaaaaaaaaaugagaaaucacagaaagaagaauaugacugacaggaaaauacaguugcuccuacugggaagguggggauuuaaaguuugcuguacuuacaccagcagccuaaauugaggcugggcaugucagacuugacagccccagacuugcaguuucccucccccuguguugcuaggaggcccuagagagaaacaaagcaugaagaagccuaauugugaugauuuuuuuucuuuuuuuugagacagagucuugcucuguugcccaggcuggaaugcaguggugcaaucucggcucacugcaaccuccgccucccggguucaagcgauucuccucccucagccucccgaguagcuggaacuacaggcaugcgccaccaugucuggcuaauuuuuguauuuuuaguagagacgggguuucaccuuguuggccaggcuucucuugaacuccugaccucaggugauccacccaccuccgccucccaaagcgcugggauuacaggcaugagcaccgcacccggccaauuaugaugauauuuaaaggcaauuuugauuuuaccacugguagguauuugcugaaugguaggagaaggaaugggagucagguuccuugagauguucccugcucaugcugguguuucccaguuugaggccucuggccuguguuguucugguggcucuggcugaucacucuggugggucuugggccauccacaugcauuuuucucuccuguuugcagugguuggagaccagaccuaacagacagguguguccuguuugcaaagcuggcaucagccgagacaaggucaucccccucuauggaaggggcagcacugggcaacaggaccccaggugaggacucaggaugccucucccaaccacuucuccccuuggaugugaauucacucccauucagcauccccuaaccccacccuuuacuuaguacuagaugaucucuugguuucgaagcagucucauccagaugagagucagcuaggaggggagggaagagaggggauccaaguugccacuugcuaggacccagcagugaacagacaucacaaucacaagugugcagagcccugugaaagagcauuucugcaaccugggaagcaggauauguagcaggagaggcuccagggagcaggguugcugcaucagugauguauaaagcauggcgggaggggaaacaggaucugggugacuuuguggaguuugggauuucuagaaauggagaugugcauggguccagcauucaacaaacacaaguauugagagcccuucauggucuggcauccccaagcucuccagaagaaucucuuaccuuuauccagcuacccuagcauaugcuguguacccgacauauuagacuuucucuuaaagggacuugcucuuucacauuuaucagccuguguauuugcucucucuucugccuucuucccuccccaguccugcucaagcuaccccucuacccccaccugcuccucuaacuucuacucaucucuuaugagcagcccuaaaguucccucuuccuugaaguggucugucuucuucacauuaguugcucucacccaguucccaccacagugucauaugacuggcuuuaucccccuugaaaccaugaacacuucaaggguugggucugucaucaguauuacagcauccugcauaaugcuuauuguauaacuaagcccucaauugaguauucauggguugagugauuugagggggugagacucaaaaauaauagcauuggguauuugcccaagaauaguaggagauagagcugaaguuaauaggggaaggucagagaaaccaugaaccucagcccuuacugcugacaacccacccucuguuccaguauggauuugggauuucuguuaucuguaacaggcccagggaaggcaucuggccaugauuccuaaccgaucugagucaggaucucuguaagaggaguaggcuguagugcaaucuggugaauaucucauaacgaguugauuuucucccugguucucuauacacgugggaagaacaguugcagguagaaugaagaguucguauuuggagaauuaaucuggcauaaguucauguccuggacaagaaagaggcuauggcccugacccuguugguaaagagcuccagguccucacagggagcaacucaaagcaauuuguaauagacuuauuuuacaccauuucuguuucagagagaagaccccuccucguccucaaggacagaggccagagccggagaauagaggggugaggaacauucuaggagaagcuucuacaaaugagcugauggcuuuagaaguuuccuucuuagccuuacaauuuuucuccuugauuauaaaaguaaaggaaaacuuguaaaauacagaaaggaaaagagggggaaaaaaaucacuuauaaccacaccaauccagagguaaccacuggaaacauuuugguucuauuuucuuuuccauuuuucuauaauuauauauacacacaaauuuuacaaaucugugcguguauuuuacagauguguguauacuuuuuacaguuuuuguuuuuuguuuuuuacaauauguggcuccuguuuuguaacccucucuuaaaauuucauuuguucuacagauacuuaguaccuucuuugugugagugggagucuuuuaguauuaucuugagauuuuacauugccagcaauauuuuacuaacuagcuguuuagcauuuaguuguguggauuuaacauaauucaauccuuuguuagacauuagcggcuuucuuuuuccaaguuaaaaaaaauccugaugaacuuacagauaaauuugugagcauguucauuauuauuuuauuaggauaagacagggucucacucuguagcccaggcuggagugcaguggugugaucacaguucacuguagccucgaccuccugggcucagucuaccucagccucccauguagcugggaccacaggugcacggcaccaugcccagcuaguuuuuugaguuuuuuuuugucuuucuuuuuuuuguuuuguuuuguuuggguagaaacaaggucucacuauguugcccaggcuggucucuaacuccugggcucaagcaauccucccaccucagccucccaaaguguuaggauuacaggcgugaaccacuguaccuggcuuaggauaaauucuuagaaguaagauuacuggcuaaaaaaaaauugcacauuugucucuaguggucuaguggcuaggaacaaaaacauuuacauuuuuugcauauuuacaucaaauguuacucuuaaaaaaauucuguuaaaauguuaaagaaauuuuaaaagcaaaauauuuacccaccauugccaagagcccagaacaaguauauucucauauccucauguucucuucaucuguaggcugugcauauguauuuuuauguagccaucaccauucuguuugcuuuaaaauuuaauuuuggcagguuuuccaugaugcucugaaguguccucuuuauuauuuaggcugccauuuauccuauugaguuuuuuauuauuuuuuauuuuuccaugcuauugcugggaacccauugaguuuugguucauuguaauuuggguuuuccucaucgaaggaccuuuuaguuguuuccccauuuugcuguuuaaauaaugcuacaauaaccaucuuugcacacuuuuuuuuuuuuuuuuuuuuuugagaugaaguuucacucuuguugcccaacuggaguguaguagugcgaucucggcucaccacagccucugccucccggguuuaaacaauucuucugccucagccuccagaguagcugggauuauaggcaugggccaccaugcccagcuaauuuuuguauuuuuaguagagacgagguuucuccauguuggucaggcuggucucgaacucccaagcucagaugauccgcccuccuuggccucccaaagugcugggauuacaggcgugagccaccgcgcacugccacuuucuuuuuuuuuuuuuuuuuuuuuuuuuuugaguuugaauaauggcauuuuauuaggauuuccaggaguaggauuauugagucagggaucuugaaagaaauuaagguucucggcugggcgugguggcucacaccuguaaucucagcacuuugggaggcugaggcggguggaucaccugaggucaggaauucgagaccagccugaccaauauggugaaacccugucucugcuuucuuaaaaacauaaaaauuagccgggugugguggcaugugccuguagucccagcuacucgggaggcugaaacaggagaaucacuugaacucgggaggcagagguugcagugagcugagaucacaccacugcacuccagccuuggcgacagagcaagacucugucucaaaaaaaaaaaaaaagaaagaaagaaauuaagguucucuucuccggauuacccuuaauaauaauacuagcagugaacacuuguugaaugguuacuauauggaaauaacuauauguuaagagcuuuauaugcaugaucucauuuaagccucacaucaacucauuuaacggaggaggaaacugaggcccagauagguaaagugaucuguccagggccacacguacagugcugaaacccagaucuggcugguauugaagucucugcucuugaccaccaggugacaccacuuuaacauuccuagguuuugguuuccuacagagcauuagcaacuaaugcaggaaucagaggcccccagaagccagaggcccuggccuuguugaccaaagugcauaccucuagcauuuauaagcaccugcagcuacuagcgauguuuuuuugcauacucuggcccaggaacauaaucccaccaaauguauggacuggugagaucauaaagauguugcuagaagggaagcagaacgguuaguccucaggauugcacugaaugaaucugugguuccugaugaaacaauugcaccuucccaaguaaggcagccucagucccaggagccauuagauucaaccaugaacugaguaggaggcauuuuguauugaggagauggaaacucuuuguuuucccucccuuuagguuugcccucucauuaagucagcuguuaggcuuuauaggugaugccaucuggcaagaaguuuggaacuagaugccaggcugaucagugugugauggagagcagcuauuuuugugacuugcaaaaaacucauaaaugaaggccauugagcucuuugugaagagcauuugacccaauagucugucugcuuuuuauuauuuuuaaaaucauuuguucuaaaccucucaucaggggugcaggggaagagaaaaaaauauuugaaagaugcgcacaguaauuaagagcaugaaggccgggcacaguggcucuggccucuaaucccagcacuuugggaggcugaggugggaggaucacuugagcccaggaguuugagaccagccugagcaacaaagugagacccuaucuguacaaaaaauuuaaaaauuagcaaagcauggagggguacaccuguggucccagcuacucaagaggcugagaugggagcauugcuugagccugggagguugagucuacagugagccaugauugcaccauugcacuccaggcuuggugacagagcgagacccugucucaaaaaaaaagaaaagaaaaagaaaagcauguguuuucagaucaaauugaccuaguuuuagaucuaaacuguacuccuuggucaaguuauuucaccucuccaagccucaguuuggucaucugugaaaugcagaugaagccaauguaaaaauuaaacaugauuuauauguccuagugcuuaacauggugccuagcacagagcucacgcuuuaaaaaagggaguuauuuauucacaguauuguuccugcugaaucuuuucaugugaaagaugaugcaguguagaacaugcacauggaaagaaaacugagggugauauaccaaacugcugauagugguuauuucagagguaaaguggaguggcugcgaagugggaaggugaauagaagaucucugacucugucaauuauuucuguaauaugugaguuucuuauagcaaguauauauuacuuuuauaaccagaaaacauuauaguguuuuaaaauguaaaaauucuauguaacaguauuaaaagaaauuuuaauccguaacuuguccauauaccuacauauugucauguaguugugaccacaguguucaaacaauuuugucugauaacuuggucacaagaguuguucaguguuaccgcuuaagucaggguaaugguucuuugaaugcauguaucaagauuuugaucaugacuuccauuguuggcuaauuagaguuucaacauuuuugcuauuaaagauaauguguagcuuguuugauguucccuugggcacagggguggcugucaauauugcuccuauaaagcauguagaagguguuacuagcuaaugugggacuauggaaaauauccucaagcccugugagugcugacuuaugucagcagaguguuucacacugggucagagccaguccuuuuuggcccauucauagauucuuagcuggaagcuaaggcuaaaagggcagagggcuugccagaguuccucuacuucaggguauauaugggaggaaaagcugucccccaccuucgaaacauguggcacaagguagggagaagaggcaggugccacaugcaagacaacgugagguauguugaguuuugacaggcacaggagaaaccugccugauucuccugcccuuaauugccuuucuuccacacagggauuucaaggauuuggauuuggagaugguggcuuccagaugucuuuuggaauuggggcauuucccuuugggauauuugccacagcauuuaauauaaaugaugggcggccuccuccagguaagacccuauuuccuugagaaauuaggaagauaucuuaguaauauugcuugaaagcuccuuggaauucagcaguauauaaguuacagauaauugucacuacauggauaaucagccuuuucaaaauaucuuaagcuguuuuuagaucacuuacagacaugguaacaaugcugagcacuuaccaacuauuaggcaugcauauauauagcacuuuccauuccaagcucaggggaucaucacaaccacccuauggaacaggugugugauuagcugcguuuaacagaucagaaaaugcucaguaauguuaccaagacauaccccaugucuauaaaauggaaaacuguaagugauacucagcugaggaaaagccuaguucugcacauuuacuucccacuuugaccauuugggggccuggaaaugugagaugacccauaaggagugaaggcaucuccauucucuggcaucucugucuagcuuccuucaggacacaacaugaggcuggucagaagcagccucagcccugugggaaccaugccuaggucuaccaacugcugcugcaguucucccuccuacugcuugaaagugccauccgcauucgguauagagcccuugcucuauaggugcaagccaccucuaugaggugggugccuugaacucuuaucacagucugacacccaagccaagauccuuacuguggagccugcagagaugccaugaucgguugagcucugccugcacuuguuggagcuucaugugcacuggacacagcauaugguacagaagugaccauugugugguucacgccaagagcuuaugcccuaaagaugguaacugggucaucccaguuauucucauccccacccugguccuugguacacagcaggugaucuauaagucuuucuugacugccugccugccugccugucugucuucgugaauccaucagagcaucuagcugaggaaucucagcaccaagauaucuugggaaugccuuuuuuuuuuuuuuuuuuuuuuugagauggagucucgcucugucccccaggcuggagugcaguggcacaaucucggcucacugcaaguuccaccucccagguuuacgccauucuccugccucagccucccgaguagcugggacuacaggcgccugccaccacgccuggcuaauuuuuuuguauuuuuuuguagagacaggguuucacuguguuagccaggauggucucgaucuccugaccucgugauccgcccgccugggccucccaaugugcugggauuacaggcgugagccaccgcgcccggcccuggggaugcccuuucuuacuuuaucugccuugaagguuuauccucuguucacauuuguuuuucagaggaaguauaccccaaaagauaggguguacucugcccugaagaaagggcaaauuccugugaagccagcaagaaccugccugauagcuugcauccuucuaaccuggucgaaggcuaaccuuggauuccccagcuaagcagaguuccacagccaggcuagacucuggauuacuuuaucccccugccacagucacaguuuucccuugucaugcuugguacaauuugcccauccuggacacagauucuuuuauccuccuucccccaaagucaggacagggagcucuaaaugguagcuuuuccuaaagcagagaggaguggagacuuagguucucaccccaguucugccucuaccuugaaaaacaagucauuuugccugucuggauccuaguucucuucuggaaaaggaaggcaaucccuguggggcccuugagaggcaguguguggagaggcugcagagcucugccacuaauuucugagccuuucaaucuugaacaggucaccucaaaccuauguuucagcugcuuccuacucaaaauggaaauaauaauauccaccaaauaauaacauguacaaaacacuuagcagauagaagauacuuaacaaauaguaggcuugcuuucauuauuuccugcaagaguuuccuguuaaucaccugguuuauuugcaugugcaggccaaaccuuuuaugauaaauuggaccgugucuuguccuuauuguuauuguuccacauaguuucauuuugccugauauuauuugggguuuagaaauuuuuuuuggcugggcgcgauggcucaugccuguaaugccaacgcuuugggaggcugaggugggcggaucaucugaggucaggaguuugagaccagccuggcuaacauggugaaacccuguuccuacuaaaaauacaaaaaaaaaauuagccgggugugguggugcgugccuguaaucccagcuacucaggaggcugaggcagcagaaucgcuugaaccuaggagguggagguugcagugagccgagaucgugccauugcacuccagccugggcaacaagagcaaaacuccaccucaaaaagaaaaaaaaaaaaaaaggccaggcaugguggcucaugccuguaaucccagcacuuuuggaggcugaggcaggcggaucacaaggucaggaguucgagaccagccugaccaacauggugaaaccccgucucuacuaaaaauacaaaaauuagccaggcuugguggcgcacaccuguaaucccagcuacuuaggaggcugaggcaggagaaucgcuugaaccugggaagcggagguugcagugagcugagaucgugccacugcacucuagccugggcaacagagcgagacuacauuucaaaaaaaaaaaaaagaaaucuuuuuguguguaggauucugauguuguaaagagauaaagauugaugcugucaacuucuggccugagugggcagugugcauagcugcaguguucuaauagccuguuuucuccuuucugucucuccagcugucccugggacaccccaguauguggacgagcaguuccugucacgccucuuccuauuuguggcccuggugaucauguucuggcuccugauugccuaaugcugggcuccugccuacauccguggcagggcucuggacuggugacgugccaccccaacuccugguguuuggcuuccuggcuaaucuugacuccuggaaucagugggaucaguaacacaucaaggagucuuguuucuucaucagagcuuuggaacucgagaccaguuggcgaugaccccugaauaucgccaccgcuguaaacacucuauaacuucaggccuuggcauugagucaucucucaugggugacaccaugaaaucuuguuucagccaguucugcagguccugacucugcagagggaagaggcagaaagagagaaacugucagaguauaauuucaccugaguuuaauauuacagaaacaaagggaugcaccaaaugguauuucuggaaauuuucaugucuuuaaauaccccuugguaaguugcuucugaagccagugggggcuccucagauagagagguuccccuuucaaaucccagugccgcucuguucucuuuccuuccccucccacucccccucuucuuccucuguagagaugcaagaaauugcugucccauaaaaaucauaauugcaguagcuaaagcuggggucacuucgugaauucaccagagacucaaagaucuuuuauuggcucugggcugugcucagugucuuuggccucagagaacaacuugaaugacuuccugguuuccuggcauaaauuauuccuggugagacauguggcuuaacucacagguuucccaucagcuuucucccuaaaacuauguucaucugccucucucugccagagaacauacagccgagaauacugccgaagcugagacugacuacugugcauuaggaaagaccuggagucaggacuuuggugggauuuggagcuccgaggcaguaauaacugaacaagcagcccuguccccuaggcugcagaagcuugaaugcauccucucccagaaccugccacaggaaacugggggcuuugucaggucagcccaacugcaugcaaaagaccaccauccucagaagccaaguugucuuuuaugaagaggcaaggaaaggggaaacccacaugugacccugauuuugguauggcuugauagaguucccugaaaacuccuuguaugugugcuaaaaccagggaagcaugugacugccaagcaggcaaccccugaugauuuguaaagccagguggcagggccuuggggagccccagcacaaugauauuguguggucuucccuccuguggaaucgaggggaaauuauucuucccaauaccuugauuugauuuucaguuucauaagcuucuuccucugaaucuuauugagggacuaugguaccaagcagguaggacuguucaccugguggaacaguucuugcucugccuucuaggcuucaucccagaaauccagccucuuucuggagaccccaaagcuggagggagaugggcuuuccucugggccucucuccuacuuugccauccacacugcuccuggcuaaccccagcaauaaccaacaaaugguaggaagccccaucuauugcuuuuucucaauuaugacugcauaguuuauggaaacaaagaucuugaggaagaugagggaagcccuccccucuucacaguccccaucucuucuccuuuguaccugucaacaccagaguucaguguuuaaacagacaaaauauaaaguauugaguaggugguucauaugccgaauccacuugguaggaagaaaccaccagcuuuauagugugccugauagauuuuaaacauuccugggcacccacucaagagugcucuuuuuaucaccuucuggaaauccgcaaaguugcaggggccucuggagugucucuucucuagagagaauuggugggaccccccucagugcaguggccccaacuaguggagggagagaggacuuaagucagauggacucaacagaaauggguuuccagaagaauaaugaaaaguuguggguaggaaaaugaaucauuuggacucuucaaugaaauggagugagcccaggagagcucagccaacagaggcacucugggaaccuguuaguaaagccaggcuggccaaaugccauuugauuuugaaccucguagguccccacucacccucugccaggagcuaaguaaggcaggagagcugacuugggacuccuggcucggccccaacagggagcccccuucccaccaucccucggcaagcucaccaccucauccuucugccaaggcagcuuuccuuucuuuuguguguuuucuguguucuuagccuccacccuccuccugccacccuuguggacuaggaccagguccugaccccagucagaaaaugaugauauguacaguggcacaccuuaaccagucacuaauuuucacuguugugaaagugauuugauuuagaauuaaacaaaugguuuuacauuacuaugagcuuggacuucuugucuguguuguggagggcgaguggguggggaguagucacacugguaugcccuccuggaggcuccugugcauccuccguaaugucacacugagaacgaaagucuucaaagaagcugggcaugacuuaugccuguaguccuaguuacucuggaggcugaggcaagaggauugcuugagcccugaguuucaaggcugcauugagcuaugaucaugccacugaacuccagccugggugacaaagcgagacugucucuuaaaaaaaaggaaagaaagucuuuaaacgacuauugauaauuagagaugauaaauguaggcuggaggccuggcuucauacacagccuugcccaauauaaaaccugucugacaggcagccccaguccugacaaguacauggcauuccugagcuucguaagugacaagcugccacaauagagcuuagcuugucacuuaucagagccuuuagaacaaucagguuacucacugu

SEQ ID NO: 16475 - RNA, 604 nt, Homo sapiens
aaaacauauuuuaaugaaaacacuuucucaccaucuuuaaauaaaaacaauuugcauuuuccaaucggaagcugcuagggcacuaggacucaugugcuuucuacuccacagguuucagaugccacugcacuacuaacuccccagugcuuuugaggcauguguuagacauguucuccucuguuggaaguccuuguggcaacuucaauucuuaucaaaugcuuaaccacuuucaauuuugcauucacugaagggaauucuggugaacuugagggauaugugauuuuuccaauccaagcuucuuuauuauaucuuuuucccaauauggacguauuuuguacuuuuuauucugguaacaauaugcaguuuaugaggguucuguggauccccaccauauuuuucaugaucuucaggugaggcgugaaacacuuuaucuggaauuuuugaucuggugaauuugugacgaauccaaucuguacaaaugagacucuacaccuuuugucacggucuguagucugccugggggccucugaacuacuaagcgcaaagucucagccguaaguguagugauugcucucuuuagaggcagcacucgcuaaacguucag

SEQ ID NO: 16476 - RNA, 604 nt, Homo sapiens
cugaacguuuagcgagugcugccucuaaagagagcaaucacuacacuuacggcugagacuuugcgcuuaguaguucagaggcccccaggcagacuacagaccgugacaaaagguguagagucucauuuguacagauuggauucgucacaaauucaccagaucaaaaauuccagauaaaguguuucacgccucaccugaagaucaugaaaaauaugguggggauccacagaacccucauaaacugcauauuguuaccagaauaaaaaguacaaaauacguccauauugggaaaaagauauaauaaagaagcuuggauuggaaaaaucacauaucccucaaguucaccagaauucccuucagugaaugcaaaauugaaagugguuaagcauuugauaagaauugaaguugccacaaggacuuccaacagaggagaacaugucuaacacaugccucaaaagcacuggggaguuaguagugcaguggcaucugaaaccuguggaguagaaagcacaugaguccuagugcccuagcagcuuccgauuggaaaaugcaaauuguuuuuauuuaaagauggugagaaaguguuuucauuaaaauauguuuu

SEQ ID NO: 16477 - RNA, 7281 nt, Homo sapiens
cccaucuaagaaggagcugugccaaaaucccaaccccauagugggccacgggggaccagaguccugggaaagucaaggcuggacgaggccauaagagagagacagguuuugugggcccuuauggauucuguggcuucucaucucauuuuucuacucuugagucucaguuccucuaccuguaaaaugaagggagggagggagauguguuugcacacaagcucuagguccuagaguuggcauggggacagaaugaggcauggacccagaucucagguggaggaaagaugagcccacuccauccccuuucuuguuccucuuccugagagcccugucuaccuccaugcacagaggccguagggcaacccaguggggcagggcuccuuccccaaccccaaaggccaggcagccugaccuggaggaggggccagaggagcuccaucuccucagucccugacccuuguccauggggguaaauuaaagauuuacuuuaccuagaagacaagugacccaccccacucucauaccuucccccgcaggcagaggcuggaaccaaccagcguagcccagccacugggcagugcccagcugcugccaugaccuccccaaggcacucugccuguauguucucggaccagcgcauuagacucucugggugucugccucuccacuaucaccgcaggaugugugcagccuggaggggaugagguuagguuuccaaaggugcccgccagucaguucgaccuucccucaggaaguccaagucccagugggggucguagaggcagcacaguccaaaaagagggaaugccaggccugguucccgcacauccucaucucaagguauccacaggcaggcucaggguucuucagccgccaccucccucucuuaagcgaggcucgggcggcgcuggaaaagaguuuuggagagaagcuggagcagugguugaaucucugggaaaggacagaugagaaccugccccggucucgggaucggugccucucgaagucuuuccgaccccgggagcggcuccuccagcacccggcgcccgccauuacugcgccccgcgcgccggcccggcccccgcuggccucguggcaagaacgggggcgucccgagccgggcuccuccccgcggggccgggccauauaaggaaaagcuaggcccgcuccgcccgcccugcgccccagcgucuggccgauuuggggacgcgggcagucgcuuccggccccggcucccgcacauucuugaggauugggccggggaugggaggaauggggacgccuggggacuugcacgccgcgugccccuccaccacccgccgggacgcccucugccucggucccgaguucgaguucgaccuccgccacucagcuggguguccuggggaccuugguuucuucccuuuagauccggacacugaagcaggcgguagcgggugucuuccuaccuggcuaccccuucggcgccuagcgcgaggcagggugggcgaggcgagggcggcgcccugcgagggagggcggucgcagaaccugcgggccuucagcgcccccuggcgaggcuucccuccaccgccggcgggacccccaugggcaaccgggggagcugggacugaaagccuggagagcccccuccguugugcuguuggggagacugaggcccagugagaccucagggccugccaggcguucccaacagcgagggcagagaguacacggagagccggcuccccagggggaggaagcacccucuuuccucccgggagaauuucacugggcaguuucggaaaccgccccauccccuuccccuucccccucgguagacaauggcgcuuuguacuuccuucccucccucccacagcucccuccuuacacagcgguggggccugggcggguggaacucgggacacacagaggagacacugugguccaaccuuugccuccaggcccaaagggaagggucgugccagagggugaccaguggaaugagguugucagucuccagccuugcccacccacuuugggggaucagagggaggcucccauuuuccagauggggacacugaagcuccggggguugugcuguagagguggccaaguuccuacaucaggcuuuugucagagacaaggaccccaucuccgagcccagagcacugagaauggggaccuaggagacaaaaggcuagcccuugccccucugggccucuuuacccucuguacagaaggggcuggacccucuguccccuccagcccccagccuccaaauguaccacagaaggcucuaggccugagacacagccagcaccgggggcuggggagugagccucauuccccccgccucugcuauaaggccuccuuaggccucagagcaucucuaguccaggcuagaggggucuccaacacagugccaggaucccugagguccccaccaugacacacagaccccaguagcagagcuaucuucagccuagggcaggcccuggagucagagagaccuggguucaaauccuggcucaggucauuugaccaugagcaaaucacauguccucccuggacuucaaucuccucaucugucaaaugggaauaacaguaguaucuaggguuuuugugggcuuaggacaaguagggggcucagcacaggguuugacucacaggcucuccauaaauguuacugaugccucgggguauccugcccuucccauuugcccccuugucucucucccuccuccugacuggcuagaaccaaguaugggggugaugcuuauugcaacugcagcuauguacaggagaggccaagucacuguucccaaccccacccacuggcaaaugaaaaaaccaagacacagagaguuuaagggauaugcucuugaucacccagccaggauuggacuagggcuggaaccaacuaagggcucuggccugaguuucagggggucuucucauaauuccucaggaauguggagccuggagggcucuucccccaagacucucccugcucucuucagacuaggacaagcuggcucauggcugaguugggccagcccacacucccugcugaaaacuaucuccaucccauccccacccuugccaccuggccuucccgcuaagcagaaaggaaugacgggggggcgcuaaaaagggagaugauagaggguucuuuggcccuaccccugaaugauuugggggguggggacagaggaaaucaccccgccuuuacuggcucccgucugguuaucagacccacacuggaggcuuaucucugccacuaucuuccaggggaacccugggccaguccucucucccuugagccacggaggaucuguauguagcagguggcucuacaugguggaggugugggggaggcaacaggauuggcugacucacuccagagaagguguucuuuccugaaccugguuagaccagucacccccaauuucccgggaacugagggguugagaaccgguagaagcagcugucacccagggaugcccucuauaaggcccugggguggccccuagugccagccaccuuauaugucugggggauugguccucccacucugcacccuggcuucuuccaugguggcuagguccaggccagugcaguggggacaauagcccucagccaggcaggacuccugagcaccuguccucaguuuccccaucuguggaugaagcagucaacccccagcugggcugugguguuuggugacuagaccagggagccucccuugcucagaggguggacuucaucugucaccuuucccucuagggacccuguuagugacccacaggguggccucccuccuccuccuacaauagcucccugacuuuuggggaucugggcucugagaggcaggaaucgaguuguagaaaggagugccuggcuuggcaccuggcacaagugggcaguuucuggcuguccacucacaguugugugcucugugaaccacaaugcaaaguggacuacccaagaucccugaaacagugggcugggucuacccccgggacccugcgugggcaggcaggcacgugaagagcuugggacacagggaguggacacaggccacacauugugcccuaggcagagccgugggcagcuggugccagcccuccgccccuggcagccaaaaugaccugccucucgcacccacugcagcuggaggucacagcagaucuggcagagcggcggcgcauccgcucagccauccgggaacugcagcggcaggagcuggagcgcgaggaggaggcccuggcauccaagcguuuccgugccgagcggcaggacaacaaggagaacuggcugcagugaguagcgggggguggaacaugcgggugagaaggugagugugagcccuggcucagcucaugugugcaggcaggcgugagcacaaguguaucuguggauugcaugugcuaauggcaguacguccacacacgcuucuggaaaaacagagauguuugugggcauggagcauguacugauuguggcgucgcggccgugcugauguagccagcacgucugagugugugguauuagugcccacguccaugggcauauguguaucagugugcaguuagagggugugcacagccacaugcccuucugccaagguucuggguacucuguucuggcuccuacccuuagcccacauccuccacgaccuggccauggcaguggugguuacagucaugaugucucugcagcucucagcagcgggaagcugagcagcgggcugcccuggcacggcuggcagggcagcuggaguccaugaacgauguggaggaauugacugcacuggugaggcccaggcuggggcaggggaugggggcagggcaggugaagaccuggacuccacagcccaacacccgcgaccugucucuuacccacaguugcgaagcgcuggugaguaugaggagcgcaagcugauccgagcugccauccgccguguacgggcucaggagauugaggguauguggccugucccggccccaccccugcccugcugucugcuguccacagcaccucccugucacucaccugccacuugcuccuucccuuccagcugccaccuuggcugggagguuguacagcgggcgucccaacaguggcucaagagaggacagcaaggggcuagcggcacacaggcuggaacagugugagguaaggagggugggagaguggcccaguguccugugcccauggauaccgguagcacagagugccugagugucuuugcuaggcugguauuucacuguaaggggcccaccccugccauccagccucuauuuagcagucagagggaucucccagaaaugcaaauccggcccuggcaccuccccugcuucaacccgucccagggcugccccucacccuccacacagcccacaucuuuaccuuggcuuauggggccugcaugucagaccccagcuggcucacaguucacucuauuuuccagagugugggugagaggucaggccaugcagguuccccaaguggccagcagaggccgcuggguccacgguccuggcaggaccccacucccacuccagaugaaccaggcugaggccaggagucaggaaccuccacuccagggaucuauuaaggcucccguccccaauaggucuccugccauacccacccacugacaucaggaccugguccucucugaaccccuuuggcuagguagugccaagagauugggaaguggggaucagagacugcccuuagcaugccagugccagugcuugcgcaggugugccuacaggaagccaugccccaccacucugcuuugcaugcccugcccugggcacuugccagccuggcccucagugguggggguggcguucaaagccuagggagccuugguugcauccugugggucccuuacaggugccagagcgagaggaacaggaacagcaggcagagguuucaaagccaacccccaccccugaaggcaccagccaggaugugaccacagugacacuccugcugcgagccccaccugggagcacauccagcucaccugccucacccagcaguucacccaccccugccucuccugagccuccauuggagccugccgaggcccagugccuuacagcugagguuccaggcagcccagagccaccccccagcccacccaagaccaccagcccugagccucaggagucuccaacgcuccccagcacugagggccagguggucaacaaggugagucuggaugaggggcagggaugccaggcaagugagcaggucugggagucaggccuugcucaggcccuguucuucucccuugcagcuucugucuggccccaaagagaccccugcugcccagagccccaccagaggccccucugacaccaagagagcaggugagggucccagcagggguagucacaggcaucuuucuuccccucccccugccucccuuucccugccuagaaaaugggcucuugugccuggcagcucuagcuuccucagguccaugcagucccugauacugcaccccaccccugaaguguccccgcccccagcuaggccagccucccccuccacccccauggcuagaggccuccccugcagccuugaaaggcaacgggccucaggcacauucuucuccccaauaagggaguccacccaucucccagcuggagcugugggcagcacuggccaggagggcuguccccccuccccaucugcagaaaggaucugggcacccuuccuccagccuaagccucgccuggcccccaggaguguccaagucauccuagggucaguguggcaggagaaggaggugccuguaggagagaugcagccgaguggggaugccggagugugggagauccaggaggggauggagaggugggguggggguugaguacaggaaagggugggaagcuagggagguguagaggagaggauuaugaaagguggacacccacuauccccugucuuuucucuuuccccacauggccaucacccccuccccaaccugccagacguggcuggaccccgacccugccaacgcucccugucggugcucagcccccgccaaccagcccagaaccgagguacuaccuauucucacccugccuaggaucugugcagacccugucccacccaguugcugacagcccuccuguuccuucuagaguccaccccccuugccagcggaccuuccucauuccagcgggcuggcucugugcgggaucguguccacaaguucacaucugauucuccuauggcugcuaggcuccaggauggcacaccccaggcugcccu

SEQ ID NO: 16478 - RNA, 44936 nt, Homo sapiens
gacaauauauccaacacaugaaaugcucugugguucaugagaauaaagaagacccauauggguuauucugaagcagguuccacuacacuaagcugcacuaaguaguuuuaacaggcagaaauggaacagaguggaagugcgugcacuuaggagggauacucuccagggagaauucagggauugggugggagaagggagccuugcuuuucaugguccagccuuuuagacgguuuuaauguuuaccaugugcauguuucacuuaaaaaccaaacacccuaggugaggcaugguggcucacacuguaaucccagcacucugggaggccgaggcagguggaucacuugagcucaggaguuugagaccauccuaagcaacaugacgaaacucuaccaaaaauacaaaaaaaauucgccaggcaugauggugugugccugugguuccagcuaccugggaggcuaaggugggagaucacuugagccuggaaggcagauguaucagugagccaagaucgugccacugcacuccagccuaggugaccagggcgagacccccaucucaaacaaaacacccuagaguccccaccccucucguucuuuaaacaccagcauugcugcccuucacuuucuugcagccuugugcaaaggaccuucucaccacagaucagccagaccaucuuccuccuuccaagucaucaaagaguuccaagcuggucaccugucccuugauguucccaggaaaccaggaaagaggaccccugcauuuuaucuucccauccagaguggcaggaucucugccugggaaacaggcuucauucagcacagcugugguagcauuaacaaagcaaagugggcacauguagaaguugaagcuaaaacauucaagaacuccagucuguuucuguggauguuaagggggugaagauaaaacaauggaggugaugaggaggaauaacuugaagacaguuuaaagccacagugauacaaagaaugaagagaaggaaggugcuggauuuuacuaagaaaacagacugaguucaggagucucaccaguagaacuuuauaguauugcguuucgauuacaugugugugaauuuuaaaaacugauuacccuccaguaaaaauguggaaccaauuugcauuuggauuaaaacauuagguuuggggacaaaaguggaccccaugcugccugagaugaagagagagagcaggauggcagaggaaucaccagcucaagaaaccccaagacuuggacagucuuccagcagaagaggccagggucucucaguguacuacuccaaacaggccucuccuagagauguagucugggaagguccaaaacccaccagacaggcacauccaguggggaaaagacuucccauuccaguguggccugcaucccucaccucugcuucccagucuucugcugaccucagaggagcaggguggccauugcugaucuggguuagggagaugccagaaacacacccagguuugaaccacagguuagugguacaaagucacaguccuugugccuucagaaaacccagaggccccaaauacgagugggaagagaguugggaaaaacugaaccagacucuuccaauggccauuaaagagaaaauucagcaacgcuugccuuugucuuugacccugagaaguuaagggacacagauuguggcgccgugauggaacauggagggaaggcauggugugcuuccugcagagaugccucuggagucccuguggccacgggaucucacuggcccccucuucaggcaccuugauggggcucaguggggccaggccgaaggguggaaguagaaaagcaucaacaggcuguccagaucaauuggcaccauccaaggcccugcugcacccacacauggaggucaccagcucagccccagggguucuuucacacacaagcuccuucccuaaggaguccugugggguuccacacucagugugcugcccaagucagagauuuaccacagaucugucucccccucaaccuggacucaaguuacuguggugagaaaccucacuguccaugguuaacugaagaaaucccuccuucagaaagaacuugaguaguagaugaggugguuagacaggaucuuuuucccucaagcuguuuggacgccacagccaggaccaacucugacagcugcgagagagagagccccuccaauguggaaccuccuacacagccccccuuuugggucccuggauaugagcccccagcaggaccaccacucuagggggaagucucccucccaucccucagauccccacauuguuccuccuguaggagaaaagucagcccugccccuggagcuucuccaagauggcacuggacucgccguuaucuugaggagccaggagcugaaauggcuccggcuuagcaacccaguauggccaaaguggaaagguucucuguccuuugcagucaccaaaaaaaaaaaaaaaaaaaaaaaaaaaaaaaaaaaaguauggucucacaggcacagcaucuucuuuuaaaaaauaaauauuuauaaacuuaaggaagauucaaagaaucaggguaucuuuuccuccaaaaacacaaaugucccguguaagucaaaccaaggugcgaccaccaacccaugaaugaaguccccucccccugcagcuacaggguugaggggcaggugggcaggggagcugcucucucuccugccuucagucccccuuggugaugagguccucaauguaggcguccagcucaucaucuguguugaugucuauguccuggaauagagcaggguagggaucaacugggggccagaaagugauuggggggcucaccuuuccacccuucucucagcuccugggauggagcccagaguccucucccugaccucccaccccgcccuggaugucaggcuucuguccugucuuaaucacucuccccucccucaucuauugugcacagaugaugcccagauuuccuacgcccacccugccucuaccccauguucccaauugucuuagauguauauuucccucagauacuacaaauaugcccacuucucucccuucucugucacugcccaagguccaggccaccacugucucagacaacugugggagccuccucacaggaggcucugguucuaacuuugaccccuccaggccuccuccaaccaagcagguacaugucugagacugaaaacugcaucaugccacaccccuccagugaucuccacuguucucgggaucaaaccccacaacuuucaagcccugccucugccccuaccgcccccaagucccugcucaggccucaaguccugcucuucuuccuucugccuggaaugcucgugucacacucuuugcaugacuggcuuccagugucuccaaaugccuaagccccugaacacccuagucaaguggccuccccacacuuuacuguaucuccuuaugaaccaccaucaguaauucucucucuuccaccagacuggcaggcugugagagcaggaaccuucucuggcuugucuuguucauucuguauccacaggacaggcacagagcaggcccucaugcuuauugccuggaugaagggccaacaggcuaaggggugcuccccacuucugggcuacccaaucccaucugggcgucauguggaaaagaacuucguuuuuauggcuuggaggguucucaaaccagguuguacgucggaaugucuaaagggaaaaagccugguucuaugggucuggcugggcugaggaccaggcagccacaccaucucaagcccuccugccagggugcugugcagccagggugagaaccauagauuccugugaguggauagauucuugugagaacaggaacagggcccaggccccccucccugagagaccaggugguccagcugcaacaggaaggcugccgggcucaccuccugcaccuuuugcaggagugccacgauguugguccucagcuucugcagcuucuccuccgucucgcggagcuuccucucggaggugcgcaggcuuuccucggaggccuuggcccgggagucagcacggcucugguaggaauugcacagguuuuggagcccuacuucauauugcuugaaguacuccuucuguugggagcagagcaagagggagaguguguaaguucacagggguccccagggcccuucuaggcugacacgggugucuccagcccgcuuuacccaaggaugccuggucugaaggaacaucuuagauacaaagggcaaacagccucuuuacguccagaguagagagacaucaaugccuaucuuguggggcugccacaaggaagaagacaauuagcacacaggugaagcacucagcacagugcucuggcagacagcaggccgugaggacgcgugaggggcgauucuuaccauuccaagugacaaaaaaggaugacagaaucgcucuuccaugcucaaucauaaccugucugacuucaguacagcccuuucaaccacccacuuccaagacauacccaacaaugucagcgcucaugucaguucucuuuccaccuaccaaccaacagcagauaucuccagaucuguggaguaguauauacuucuacagcaucagagcuuuuuacuauuuucccugaguaccugaaaccuccagggggagagguaggaagggaaacaagcaguuuuucuaguggcuuuucagacuuauaaaagggagcagaauacuuguuucaaaugaaaugucacauggaaucucagugugaaaaacaauguuaaguaguaucucuuuagguucaauuuauuuuccaaguucaaauuuauaacaugacuuacucguaaaucacugagaaucaugaggccacugugaugaacacacacgccacaaccagcaggugcuagcuggcugcugcagucuuaucaacucugguguuuacuucuguaaagaugcauuagcugccuagccuggagaggcuucuagaugccauuuuuaaaaacuguuacuggcaaguauuuaacugugucauucaccuuauccuacuaaaccaagauagcaagagaaacuucuaguucuacacaaaacaguaauugccuuggcagcacaaaauaaauacuggagcaaucuccaaaguauuaaaauucaguauacaacaucuugaaaguagacaugguuuguaauaauuuuuucuuaauuauuuugagguaacuguagauucacauauaauuguuacauuaguuuuuuugaaaaaaugauacuuuaauauugcagggcuccugaggcucuauggaacuccugauccauaugguauaaaggacguaacugacaaggacauaaugaacaguagacuuuguuuuaucccugaugcuaaaaaaauaguuugagugauggccaggcguggugccucacaccuguaaucccagcacuuugggaggccgaggcagguggaucacgaggucaggagaucgagaccauccuggcuaacacggugaaaccccaucucuacuaaaaauauaaaaaauuagccaggcgugguggcgggugccuguagucccagcuacucaggaggcugaggcaggaggcugaggcaggagaauggugugaacccgggaggcagagcuggcagugagccgagauugcgccacugcacucuagucugggcaacagaacgagacucugucucaaaaaaaaaaauaguuugagugauuuuagacauuacaauuagcaggacaaaggugauacacugguauuauaccuccuuguacaaaaagaagcuaauauacuuuuuuuuugacacagucucgcucugucacccaggcuggaguccaguggcacaauuucagcuuacuacaaccucugccuuuccccggguucaagcgauuuucaugccucggccucccaaguagcugggauuacaggcaugcaccacaacaucuggcuaauauuuuuuguacguuguaguagagaugggguuucaccauauuggccaggcuggucucaaacuccuggccucaagugauccaccuuccucagccucccaaagugcugggauuacaggccugagccuccacacccagccuaauauacuauuuuuagacacucaugcacuuuguuugggcccaggcauucaagcccacugcagagauccugcugcacccaggcucuacucugaguuuggcaauaaccuuaaaccaaaaucaacaaaucugacaagaugccaggccaaccuagccacccuauuagcugcuuguuccuccugggauuugcagagagcaccugcagccuaaacaaggacaaaaguugaagcauggaucuuucugugcagcagcugugauuucugcaccuucuagcucccucgccgagcaccacucccucauaucuugcuggcagagcaaggcagcaucgugagcagagcaaguccuaagaaguacauggguucaaaucuggucucugucacugaccaacagacucuuuaccuuucugagccuuaguuucuucaacuccugcuucauuucacauuuuaaaaaguagaauaaagacaaacuccauguuuuuaucucuggcaaacuuuaucaagcacacaacugccccacgaggacccgacaucuugaauauacuaauccugcaguuuccauucccauugucuuuucucuagaaccucuuuccuagaaaacuuagcuauuccuauaauagaaaaaucaucccacuucauguggacaauucccagagccccaucuccagcccuggccucccccucccuccaagugccaguccuugaucuccacgugcacaaugcacaucaccagaaacguagugagggcacuucuggugccacauaaaccuccacucgucaccuucauugcacucacccauuuuucucuccuaguuaauagcuuugucaucaaccuccaauucccacagaccugagucacuugccuacaauccaugaucagucuccugacgaccucugacacagcccuuucacccccaagcccacugccaccacgcugacuccuguucccauucccucaccucugaccuuuuacauaggaccugccuccucgccccugcaucucccauccacccauucuacccaaacacgcugcuacccaaaucacccucuuaggggaaggggcagcagauuacagccccugggccgaaucagccugccaaguguuuuuguaaauaaagcuuugugggaacacagcacauccauuccuuuacauacugucugugguugcuuucgugcuauaauggcagaguugccacagagacuguauagccugugaaccugaaauuacuugccaacuggcccucuacagaaaaaaauguguggaccucugcccuagacaugguuuggaugacaguuccuucagcucaaaacuuuugcaggcuguccucuucauacagaguuuaagccaguaugacuuacacuggggauucaagacacaucagauccugacuuucaggccccuugacccuaaaugcucaccacacagccuguugccuggaccccacucccagagccuuugcucacagaagcccccaccucaaacacuccuuuucacuuacacaggcaggcacuuggcaaaaugcacauuuucuuccaacucaguugcucucucugccccccaggccaccacagcccuccauagccuuucuauccacuuucucagcacucgcugcuccugcccccauguccagcuacccgguaacaacucagucucuacugaaucuugagccucuugaaggcaagacucucuuuugcugcucacuaugagguccagcagacaccugcuugggcaaggcaccccuucagcauuugcuggguuaaguaagauccaaugcuuauguccacacaucacaaguuucucuauaccuccuucugagagucaaguucuaugcacuucgagccucagcucuucacuguugccugggacagguuuacucccucuacuggggcagaagaaaguggguaugcuugucauaaaaugucaaacuacaccugcuaucccuaagggaugacucaacuccuagcaccuguggugggaagggguuggcuuucugcacaccagagucauauccagcuaagccaauuuuuuucccacaucauaaacucuccucuucuuucagcaggagagaggcuggcugagauggagcacacagcugagagcuagcaacugcaacaagcguaacaaucauaaucacaacaguuacaacaaaugcaggggcaggggugggggaaugaagaguguggaaucgaaggucaggccagacucaccagaggaaaagauauuagcucaucugaauucauagcacucagcugcuucuuggagauggggaaacuuggaggcaggaaguaccguaaacaauuccuaaagaaggcagggacaguaauucagaauggcauggagcaggcagagagcugcugcuggcccuggggugggaagacaaaagacacauguaccggaggaucuggacaagcaggucgauggucucgugauuggugcucagggcaguggugucaggcucaaugcggaggcauucggaaguggagggcucugcgacagcuauggccugcugggccacagggcccaccuccuccuccccgcccuccuguuguguaucaaggcucugauguuccggagaaggggguuucaucagccgcacauccucacugccuuucuccacccuguggaagacacacagcuuaugucaugucugacccgggcucccaggaugggcugcuggcagggaggccggggauaccuccuucgaggaaccacugcuccucccugauuggggcauuaccagcggucucuuggugucgugucugugggcacguagucaaacuucaccuuccaccgcaccacaugcuugcccaccuccacggcugugacacggcccguguaccacucccuguucacacgcaccuccacgugcagcccuuuaucugacaauguagacagaggugcgagucagaaaacuagcguagagucccucacuuggccugggccacaucgagaaaggcaguccccaggguuuggaggacaggaacacuuaggugcuugcccccacuacaccagggacacagagaccagggaccagccaccauggucuccuuccccaucugcuaugagggugccaaaaagcaggagaacaagugaccgccaggagugaacaccaaggaauuaguguuaaaaauaaccacaaaggggugaucccuucagaauucugcuugggauuagacuuggauccacugcugcacaagagcccagacccaggacagauucaaugagccuuugguaaauugcugcugguaaggggcuccacuuccacucccacucccacccccgccacaggcugccaagucacucccccagcucaccuuucugagcucucuugaggucagccgaguccucuuccccagcacugucugagagcugcguggagagcagucuauuagaggcauccccagugccccccaagagcagacuugugccuuacuggccacccggggucaucagccaucaucuucacgacuuccugugcuacaguuuaaaucaccaagccccguugagagccacacuccaaaaucacuguccaagguaccuacccuucugcuaccuuuacgaacaagacagcaggcaagggacauguguuucaagccucacugauguacgucugugugacuucaggccugugguuaagccagaagccagucucacucaagacccuaccuggcaccauguuuagucacuuguguaacugagaguccuugagagaucacuaggcuucuggaaggcucaugacacgaauauaaacagaguuggugcagacugcuggugggggggguagacugcugguggguuguguagacugcugguggaugguauagacugcugauggggggugcagacugcuggugggggcugcaggcccuagagagagaggcuuugagaaccucaccucaaccacucaccucauucgaguccuucuuuuccuccuucacaacaaaucugccccgcuugcaccucuccuuccuccucucagcuuccuccucaacuucuuccucaucagaaacugcgacacuccgcuuccgacuagggguagccuagagcaagaggagcgugaggaugugaggggcccuguucagccucuaaggagcaggaagauuucaucuagccuaaaggagucguuccaagaggagcuguacucccugcaaucccugccugacauuacuuggaauguacacaggcaacccacuggccccugcgccauaaggauuuuugcucaaagcuaucauaggagaagcuucucaauucccuucccaccuuagucuaccuggccaacuagcugucaccuccccaagaaccaccgaccacugccgcagcccacucaggcuaucugucaccagaugacugaccuaagcccacacuucgagagccaguggaggugacucaaguuuguggcagaccaaaacucggaggcaacagugaagagcucgcuguacaggcaaccgaugugcugucuggccccaacaaguccguucagcuaucaaggcuucccguccucaggggcagcagcaaagcuuuagauucaguaucuuccgaaggcucccccaguacagcugugacacugcacaauuccauuccuacacuacugacacugggcugggguauuaaagaggacaagcgucucaccggggagaguuugaugggugacucugucuucuucaccacuggagucuugaugacuuugggagaaggaaccucccgagggcucuuggaguugggcaguaaagauggugacaguugcugcaccagaggggcaggucgggaugcagucuugacgagaguguuggcaggcuuucggggugccucagguggcuggagcagccuagaugugcuggccuccucccgggcugccaaagcagggagcuuugggguacugcugaugacaggagccuuucggggcuggcuggcuggucuaggaguuggcaaagaagggggucugcugggggcguuccugaucacagcagguaaagggggcgaccgaggacgcugaggucuacgcacagguuccuaaaaaaaggcccacagagagugagaacacugauccuagcaugagacaccugaggaaaagcccuucccaggccccuggacuucaccucaguggaaggucugguggucacuuccaagggcaauuucuucaggucugcuugggagcggaugggugugguuuucugcaaggcaaacaucaugaugaaguuguuugcauauuuuaguauacuugagcaaacuuuuuggauagugucuggaaccagggacaaaaaaaauagaaaaccugagccauaguccuacucuuacaaaccuccuguucucauuggggagacacaaaauacauaaauacucaacuaucagcaaauuacaggaaacugugugauuaauccagcaacugagagacuggcaaaaagugucaauagacuaaauuccuauaaaaggaacccaaaaagguagaaagggcccgaaggauagggaaaaccuggaugaagccagaaaggaaaggugggauuuagcagcuagggaggcauauaaaacaucauggguuagugagagcacaucugcacagacacagaagccaaaaagggaaaugguuguguacuaaauaugauaaacagaugauaucacagacauaucuagaaaaaaacauagaaaaaauaaaaauguaagugaauaagcaguuuaaaaggaauaaaaguggacacaugaaaaauuaugcaaucuuagaaauauuaaggaaauuaaauuauaaaacaugcaucuuugccuaugaaauuugcaacaacauuuaaaaauaaugcucucauauacugcugguaaauaauagaaauuaacacaucucuggaggguacuuuagaaauaguugcaaaaagccauagaauuuuacaauggaccuuuuaaguccuuuaauuucacuucuagaaagucaucaaaacaauuauguguauguguauguauuaauauaaaacauauacauggcauuaucucccuauuucuauuaaaaaauauauguguguuauguguagguauucaugaguucaugacaaguuggaaggauguaugguuaaugaugguuaccucuaaggcagaauuuuuauuuucuagaguuuuauacauucuaaaugaauuggaccacuuugaaguauauaagcauuuuuucuuaagaauaagcaagguguuauucuuaaaauaacacuguuggcaaauaguacacguggaccuggagguugggguuggaaagcuuuggcaaacaacgcgggugaguggaggguaaaacugagccugagggaacaggaaagcuacugaagguuccugucacaggcagagcccugacacaggcuggcuuugcccacugaccaugacccacguaccugaagggccuccagcuucuccugcugcuggcgaauuuucucugucaguuguuucugcuucucuuccugcgucuucauguccuuucugaauguucccaggggaaccuucugcuuuuguucagaagccucacaccuguagagacaagguacuacagaggucguggcaaacagagcgccaagcucggcaaggaccuuucucuucagccagucuacacugucugucacaagagcaaccaccucagaguucccaaugcacagaauuaaucuuauacacugcaggacauacaucuauuuuuauuucuugggcaguuauuagguguggcaagacagagauguaagguaugugcacugaccucaagaaacacagugaggggcaggggagaaaaguacccacaauccccuuguuagacaaugugcucaccgguccuguucaggaucaggguucauggagcaaacccaggugucaggguaaucuuuuuccacagaacucagcuggaaggggaggguucuccauuucagacacaaaucugcagagagcaaaaaaaccccacauaucagccacgcccaccaacucuaucuguaauccggguuccucacaggcccaccacaaugaugccccagacuuuguaggcaaagaucuucacucgggcuccaacucugccuauccuuagagaauacuaauucuucucagggacacugauuccaggaaggauggaaacuuaauaugcuggacucuuaacacccccagccccucucccuuuuuuaucaagauccuggcucagucauccacgcacaccagaaaccaugugguaccaaaccaagugagccuggccuggcugcagcuggagaggccugggaggacagaugaccuucuuucucacucaagagggacaggugaaacucagcaaagccucaagacugagcucacagggccaucgucaaacagacuuggaucccuaggggacuguaaguccaugaaugucagucaaguuaggaggcuggcaggaagauagagaaaagaggcuugugggcugauggaaaugagucggggggguccaaccacccaacucaccgcacuggauggugguggggauuuccauagcucuccggcguuuguaacgcagcucacuggaugggggcugguuccaguuggcagagagguagccaaacucaucccagaacuugaugauuccccucugggcuggaaagcaaacaccgauacaucauguuaggagccagccucucucucucccuacauucaggugaagagaaaaggcagaggcccagcagcccagccccauuaccgauggcaauauccuuccaauacugcgccaggugcucccccauugcucggagcaggugccgguacuccuuggcaucagcaaaguccuguuuguuguguguaggcuccaggaccagguagggcacaucaacaaccccaacaaccccgccacaugcccuacagggagaaagagaacaagcucugucaccccacuggcaacgcccuccugccaacuauccugggcuagacagcucucuguggguaguacucacaugcccccuuccagcugugggcccacuuucucauacauuuugaucagucggcuacaguuguagaugaacaugccauccagaucccgguguucaauguugacaccaaaaacaaaauucaguuccuuagguucuuuaagugcucuaagaagacaaaaaaacucaagcagaucuacacaucggcacacaagcaccauaguguuuaagauguguuaagcuuaagcuuaaacuugaaacauguuaagccaaaaguuuuguaucucuauuugauguguaaccuguuagacuugauauggacaugcacugggcaccaacucaaagcaucccuaauuaaaaacaugaguguggcuuuuuggcaacagggaugguugccaaaccauucauauucauuaaauaugaauuguuuauuacgaagcugcugcaaaucugugcaaagacaauuauauguuggaauaaacaccagguuaucgucauaccuuccccaaaauuccacuaguaugauaguaaauuauuauaauuuuuuuuugagacauagucuugcucugucgcccaggcuggagugcaguggugcgaucuccgcucacugcaaucuccgcacccugcauucacaccauucuccugccucagccucccaaguagcugggacuacaggugcccgccaccaugcccggcuaauuuuuuguauuuuuaguagagacaggguuucacuguguuagccaggauggucucgaucuccugaccucgugauccacccaccucagccucccaaagugcugggauuacaggcgugagccaccgugcccggccaauuauuauuauuuuaaaaggcaaaaauucacaagaauaauaagcaugugcaauaagacaccaucaugugauuacuaucaacaaaaacuuagagcugaaaagcagauggaugaggaguggacugacuuggagagaaaaaaccugaaacccaugccugugccaaggaggccaacaagaggcaaaacagugaaucaagccacagaguccaaagaggauccagacauggaggugggacaagcaggaaacuuaaugauccaggacaaaugcugguucuaaaugcaaaaguauacaacacucaaucuccagcauuauucuacauacauaaccacugaggagaaaaugaauaugaaaaaauauauauguaacauaaaaaauagggucguaucaccaggugguagaaguauaagggaguuuaaaaauguuacuccuuaaacauuuuauauuuuucaaguuucauacaaugagcauuuuauacauccuuuaaaugaaaagaaagaaagaaaaagggaagaaaagguaagacagugccaaaggaugguuuuggugcucgagccgagguugucagcccugcccugucuuuaugacucaaaaaagggcugagagcuaggauuaagacuucccuccugcaggaggcauuugacaagcauuuggcauuaaaacaaagcagucuuggugacagaauagcaaccugucaauaaucaguccaaaagcuacgucaguuuaaaagauccaaggacaggccuggcacucaccgcugcuuggccuccuugauccucuucuugacaucggcuucucugcgcagagugauggcucuguucuggaccugucgcaacaucaccugcacacauugacaucaggugaggggagguggcacucuaggccacagcagggaauauugaaacauuacaucuaagacaucucaauuuaucucaaagauguaaaaccacaccuggaaauuuacuucuuucuacagaaaacagcccucacuggggacaaacucaaaagcuguguuuuacuugaccaggcucaugggacaugggcuccuagugccagaaacgcuggagaacagccgccugggccgggaccuuacccuggagucccgcgugaggucuccaccuaggcguacuucuaauguccgagcuuugcucucugccucccgcgccuucucuucagcugaaacccagaagagaacaugguaagaaaugcaaagguucaaaacucuuggucaucccuccuggauccacaguacuggacacgaaguguguacaccaccaaggaaaaaaagaguagggggagcuauggcuggugagcaaugugagggcagccucugugccuggacggcagucagucacagaaggaaaaucuggcauucaaaccuaucacggaggccccaaggaaacuuuacaaaugaaccagaacagguuuaaaaaaaaaaaaaaaacaccuaaggcaaccaguugaacacucagcuugagcuggaagcuaaagaagucuucagccaaucacucuccaacaagcagccgagaaacccugagaaacccugaacagcgagagagccccugagauguuugcccugaagucaggaaaagcaauuucacaaguauuugcaccagagaacucagugggauucuucaauugggauaagccaaagagcugacacuuuuaggcccuauaaauggcagaagaagagaaaguggaguguagaaagaagaaaugcugagggaguuggcauguagugaaaggggcugcaaaggaacugaacuaugcuucaggagaccagccuugucccugaguuguggacucagccuuuuccuggaaccccacuuugcccacaagcagcauaccccagaugcacacccccccaacuccugcacccagaguggcauuaccaauccuugcuacgugcucugcuuucuucaccuccugcuccgcacgggucuugaaacggcuugacguguacuuguacauccugaucaguagaaaaagcaagcugauggcccacgcagcaguggggcagguggcacacccaagcacaggaagcacccugccuuccugccuccucccaagcugugcuguccuggccccucaugaugagacaaauccaagcucaauucagcaaaaaggugcaguuccuuauuccacuugcccuuagccuccugcugucuuugauaagcaaccucaccauucaccaggguugucauucaucccacagcagaaacaaaccucaggaguaagccaagcccacugcuuuccuauauagugucuaaaggccccuuggcccuaaagccaagagacucagacagcucacugagccaggcagggcacccucccugucacagaggcacacauacucaaugagcuuagccagccaccuccacagcugaucugucccuccucuaggacccagaacugacccugugaccaaucacaggcaacuuaaagucccaaacguagucagcacugccagagccucuuauacagcaucccucuaacaaugccccagagaaacgcggccacauccucgacccaugggagacagcaggccaaggggcacuggccccuaccugggcuuguacaggcagcaggagagccucuuggucugcaccuugugcccauggaugaagauccucauccggggaucaauauagagcacagcggcauaggcacggaacgagcgccgcucuggcuuccuggagagggcaaaaacagagaagugcugucaccugcuccacaacaggccugaccaagggcacaacauccucucugcaggcucuccaccuuuccauguuagguacugacuucugcugcugcccugaacuggugcucccuuagugugagcaccacaucccgccccucucacguccucagcacaggcaccccacaggcaacugagcuggcccuacauacuacccuaccacagaacacugggcaaugaaugugcucuccccucuuucccugaagccaucuccugagagcacaaacgccaguuccagggccucccucccuucccagccacacucacgugcccucuggggacgucucugccaucuggauaucucuuggauuugagauuaugucuaguucuggcucuccauuauccaugaguuugagauugaagaugaucaccaauguuccugagaaacagaaaucuuuuguccugccagaucccccggcccacccccacacuacuugugauucuggagcucccagauucuaggggcuacaggcucaaagccuacuuaccgcuguccccaggaaucuucauaaacugggucaucacuuccuccucagugcggaauggagaguacuuauagaugaguucugucucaauggcaaauuucucuacauugucugugacagguucccggguccgagcauuccaggugggcagugggacuaucaccuguggaguaaacaugagcaggcacuuuaagggaagccccagaacagccuuccucccaaaugugcaucucucuugucccuccccacagcagcuccacacugcccuguaggugaggcccaagcuccacagccuggcaccagaggcucugugagcuucagggcuucugccucuucccaagacucagccacacaagacuacuuccuucaggagauguugguuuaugugcuuagggucucugcaugagaaguucccugcuugggacgucccuggucauuuucuuaauuugguaaaaauucuacucuuaccacuagggaaaauauauuugcaauuaucuagugaaucaguaaauacacauaacauaaccuaaaacucagcaauuccacuccuagguacauacccuaggagaaacuuuuguacauauguaccaguaaacauguacaaaaauaacccaggccuggugcaguggcucaugucuguaaucccagcacuuugggaggcugagguggauggacugccugagcucaggaguuugagaccagucugggcaacauggugaaucccggucuccacuaaaauacaaaaaauuagccgggcguggcagcgugcgucuguagccccagcuacucaggaggcugagacaggagaauugcuugaaucugggaggcggagguugcagugagcugagaucgugccacugcacuccagccugggcaacagagcaagacuccaucucaaaaauaaauaaauaaauaaaaauaacccaaauauccauucuagaguggccaaauuaaacuguacaauggaacacuauauagugauacaaaugaacuaaccacuacuagcaucaacauggaugaacaacauaaacacaguguuauaugaaauaggauacaaaaaauaccuacaguaagaguccauuucuaaaaaauucacaaauaggcaaaacuaaacuauuauuuaaaaaugcauacaagggugacaaacuauagugaaaaagaaggaaaucauuaucacaaaaguuaccugaaggcaguuccuucgggggcacaagaagaaauaugacugaugagggcacacaggacacuucuaacaucagucugugaugguggcaacacagguguugccuuuaaaauuguccucugaacugcauaaauauuucaauacacucuuccauuuaugugaaauuuaauuuaaauaaugucuaagugauguuuuaaaaaaauccuacucuuucuucaaaaacccaaccucauaugccacuuccccagaggcuccucccucggugguuaugaggccgcagcccuugcagagcccugcagauggcugccugaaggauuuccucugcagagcaggccaggcuaagcaccucagggguucaaacccuuaggaaaaagggacucuguaaucuuaacaagugcuggggugacaaacuguuaagaguucugagacauuuugcuggguuuuuuuauuuuauuuuuuuugagacggagucuugcucuuguugcccaggcuggagugcgauggcaugaucucagcucaaugcaaccuccaccaauggcacgaucucggcucacugcaaccuccgccuccuggguucaagugauucuccugccucagccucucaaguagcugggacuaggcguacacugccaugcccagcuaauuuuucuauuuuuaguagagacgggguuucaccauauuggucaggauggucuugaccacaugaucugcccgccucagccucccaaagugcugggauuauaggcgugagccaccaggcccggcccauuuugcugguuucuaagaagcuuugugcugcaacuauucaacccaagggcuggucuggacacauuccuccucaacugaaaaugaucuuauuuugaaaucuuggcugaguuugcacuagaguacaauccaaaauagcgaccuucuagcaccaaguaaggaaaaaaucucaaccuagccucuccaccacgggaaccgaguuccauuuguguucuauaaaccuguaccucacuacgccucccauucuucacagccaucccaggugacaauggcaucacuuuaaacauuggcuuucacucccaugggcaccccaucccuccccucaggaacacuucuccuuuaguucaaugguacacuugcccaguuuucuuccuaccuuucuggcuaccccuuugucccucuggcccccuucuccucuccccgaccuuuagauauugacaugcucuaggucccagauccucuucucacucuauucucuccauuaggugaccucguuugcuaccaagaaugcugaagcccccagacuucccccaaaugccagacccagacugcacuuugcauguccagaagaaacuuacacucuuccccuccauacuuccccucuucauucuucccaauuccagagaccccacuccccaacugccacagcagaaccuaugagucauccaugacuccccugcuucgcuuucgccuucuacuaaucaaucaaucaccaaaucugugggucccacauccuaaagagauggaaacuccauguauuucucucaccucccuugggcgaguaccgccaagcuacagagccugggccucucaacuggaacacuccaacacucacccuaaccuuuccaacccaaucaccacacaaucgcuacauggaccuucuuaaaagaaucugauacuggcacauccuugcuuaauaaagccccacacauucaucaaggccccgaggucaagccuaaccuggcccucucugaucuccaaaggccaccaccuuucuccagguggcccugcagccaaguccccucccacagcccucagggccuuaagcaggcugcuucuacugacuuccauacccuccugucaccauccucaguccuguaucaggaaacauuccugaaaaccccaacccaggcuauauuuuccuauccuacuucuccuagaagccugcucuuuccagcugccacgcuucucucacucaaguaugcagaaugaacucacauaccacaccaaaaaggcagacaaacccacuggcuugcuacguaaugacggaaggccuaccauucccuaccugaacaaguuugcuaugauuaaggcucagaucuaaacagaaccagaacaaauuuaaucacagcuaaucaacacagaugaauuaaauuguaagucugaauucaauuaccugcuucuguggaaguugcggauuucuuuccacagaaccucuuagccccccuucuuucaagcccuggccuccaugucuuacauaggaaaggagauaagaguccagucugaggcuggguaguccacagagcugcccugaucucccacaaugagggggcauagaccucaccagaaacagcucugcagacaucugagccacaaggagaaucggccaaauguguguuuagcuuacauagucaauuacuaaaaugauuuaaacucagaauauucuggauucauuaguccuuccuuccagcauagcaguaaucacuggggcuguguagcagccacucccaagacgagacccacagcaucagcucuguuuuccuguucuccauacacucaccugcuuuacuaccugcccaggcucucucuagguaucugagucauaguuucugacauagaguaacacauuucuucaaaaggaaaaugagcucauagcacauuccacaaaaucaccaccaaauaggaaacaccaugaucagggaagcccaaaauacucccccugauaaaacaauguuccaugguaacacuccccccaaaauggaauucaaguggcagaucuagaggagcugcaaauccaacucuuaauuccugccacuugacagucucauucucggaaacaguuguucucugaagugcucugagauuuugcuuccucucacauuaaaguuaucuaccuuaaccccucaaccaauucauccagccagcuaacugcauaacaauuagggggaaugugcuccaauccugcaaccccaaagagucuagcauugcaaauaaccuacgaaaaccgccugggcagacucaggaaaugaggacuggugaugcagaccacgaugaugggaccuacuucaucaaugccuucuuccucaugaaacgugcgagacaggaagaggcaggucauggugucuuccuucuuggugaacaggauaaaauccuucccaaugcgcauugagccccugaaaaggaaacagaaauggguguuauucucccaggagucaaaagcucaucugcaaaagaaaucaauccacucuggacaugauugaaagugccacuggagggcucuccuaaaggcccccccaggucccaggacugugugcugaguuccacagcccucguucccucuccaucccccaacacuccuuccucugcuuuuccacaggccuguaacuccuuagucuuuacuuacaacguucucaaccacaccauacaggguucucucaccacccuucuagggcgggcucacggcagaccaccagccccagguuagucucacuccccccacaacgcugaagaguaacccugcugucuuugagcucuugguucaucccagacgcaugagaggugcugugcccucugacuguaccaccaucagacuuuaguagcugguacccucaacacgucaucuuccaugcugaccacccccaguucccaccguguccuuccucagcugacacaaacuccccuccauugacgaaacggcagcagcacuguuaagugaaaagcccagugccuauacucacaagcccgagaaaacaucaguaugaacccaaggcgcaguaauacagaggggcuaauaaaauauaauucuugaccacaggauucaaggaugccuguaauuagcucauguccaauaacuggagcuaucuccugucccagaaguguuuugccaccucaagcucauuaugacacaggcagcucccugcuuuuggaugcaacugguuucugggaacugugccuugaggcugauuuccaaaaggcaaaagucugaauggauucaacugcuuccuuccucuguuuggccacauuaagcuggcuaagaagcaggcagggacaggccuuuccaggcaacgcagggcagggcagaagugugaagcaccagcagggggaccgcccucugaacaauggggcuguucagcuccuuucuuccagcagcuucuggagcuuuauggcuauuaucucauuagucuuuauaacaccccagggagaugauggagguggaaagccucauuacucucuucuguguaccaauacaaaccagacuggcaugccaagcacacaaaugaaugucaugccccauuuccccaaacacucaggaaaacucccaggacacuauucaaagauacccugggggcugccaaguccucguucuccuccuccaguacccaaagugcuggcaaugcuccuugcccugaaaauuucacacaccaccuccuccuccuucccuaaagcguauggggagcaaguaaggcacguuaucuugccuucugucaaagcaugcccuugcccuaauuuggcaaaaacucucacuuugugccucuaucuuccuucugucuuugauucugacuuuagccuuugaauagcaaaagccccaaauaucacuucucuaacuggcuuccuugcuucucagcccuauucuccccacaaaucaccuucuccugaaacuuauucaacuucugaauugguuucaagaugauuuuacugucuacucugaacacuagauggcuccaucucaaugggaccuucacaaaagucuuccacugaaauacgcuaauaacacucucaacuucuauacgcuuuccuucccagucugcuaaccacuuucagagucacauuucauuugcuucugaaccucacucuauaaaugucagagauuagaaccccauuuucuagaguaagaaacagacauucagggaggugaaauggcuugccugaggccauuaagaaacagacauucagagaggugaaauggcuugcugaggccacagaacugacagaaccagguaggaggaggcugaucuacaaucuagaugaaaagucagggcuuccccugauucuaggagacuucaguuuugggggauuuagauaaccugcauuagaaucauaugauuacaggugauucauuucaucugugaaaaacacauuccuagccccuacccagauccacugaaucaggccagcaaucugccauggaaacaucaaaggaggagaaauaaaggcagaaaccaggcucucacagcaaugauagcauguaauucuuaaccuacuugguaugcauuaucaucucaauuuacaaaggaggaagcugaggcuuagagacguaguagcggaagugagauuugaaccuuagcuugucauuuaagugaaaugcacagcagcuccauuuugcagucagaaagaccugguuccuacccuagcgcucuacacauaggcauuuuuaaugccuuugggaaaguaacuucacccuuauaaaccucaauuucuucaucugaaaauaauaguaccuacaaccucacagggcuaucaugaggauuaaaugagauuauucgugugccuggcacaugguaagugucuguuauuaccauuugguuccugcccugaaagacaaaucacaaaguccggauaccagguccugauuucuucggaaguacucucuuucuucuccauacacccaaagcacaacugcacacaaggcccaacugaugcugcugacugaucaaaccaccacccucccucaaacaaaacaacacauuuccacgacaagacuggaaacgugacucacaauuccauuugcacaaacuccaauuccacuaaaucuuauuccauccaaagguauguacagcuggaagugagcauuucagaaauagaaaccuuucucuuggggcuucacucaaaaccagaacaacacauuccaaacacuaaccaacugggaacuaaggcuaagaaaaagucccaugggauuugaagacauuagguaggucccugcuauaagggccuugcaguacauucagcauccucugggacggagggcucacaucucucuuccuuacccuggauccccagugccuggcacaaagcaugacaugcagcaggugcucagggaacacugcugcacaguaaggugaccccuucaucaucucagauacaucccaacaccacaagagaaucacucacauccuugacuacaggguaaaaauaagaauuuucaacaggagaggugcaguucuagagcacugugccaagagaaacguacagccucuccugcccuguuuuuggauguucauacuuuucaaucuguggaguaaauucagcugggaacagcugguaagcuacuccagaaaccaccacuuucugacuucuuccaguuccagaauuauagucaauagagggacaaggagaaggaaaguuuucauccaagagaagcaggacagcauugcuggauuuuguuugagcccugugacaagcuucuaauauaccuacgauuuuaacccauucccguacugcccaaucugaguagacucagguguucgcuuggccgacuucccaaacuggaucacacuggcagcaucaccugaaagggcagacacaagagaaagugaaaaguuugcauuucuuucccaggguccucaaagucaaaggucugagccuuguuaaauccaagcagggguguguaucugcugaaaaccucucuccaaggaaauucaccaccaugaagcacauggaggcacagcuuugccuggccuguugguaccucuaucacugugaccuauguucuauucccagaaugugguaagacagcuagcagaggcaucuguagguccagcucgagaauguugugcaagcugauaaauacaacgccaagagacagguaaucugauugacuuaagauugccuuucagauccuaucucccauguuaggacaagaccuggcaaauacauuaguagaauuaagccugagauguugcaacagacuucuuacuccccagguggaucuucuagacauaacauuggaggcaacagaaaaacaaguucacacaauaaguauuuuguaaaaaugguuacaucgcacccccccaccccccaaaacaauaaucucaucacuuacuuggauccauuccugcuccaucauccaaaaagcaaagcauaaauccuccucgaagguccucucgucuuucuguaaaagaagcagcugccauuacugggccguuacccaccacaggguggcaacaugccuaugaucagaaggcagaucaaugugaagcuugguccaaaaaggucaggucaagccuaaacuuucuacgcuggugugaauuaaacuucaggguccuugagguugcaaauucccauccaagguucuccaauguuuucuagaucaugacaaagcuugggagaaccuuugaaggcaggaauaucugguccagcaucuaaucauacccacuaccacugaauaugcacauaccucacacauaucucaaucauccuauccuucugcucacuccaccuggauuacuaucacuucugcccuaugccauagaccccaagcacuaaaguacuccaacuaccacacacuguacuuuaucaauacugcucaaacucaacaggaugccuccuuugugaauuaagucugggguauccuucaaagugaugaaaccagacaugguaugggcacagcaguggaagcugcuaucuaaaagaugaaguacugugucuauacaugaccaucccuaggcugacuggcauucugggcuaucugcauuuacugucauauccccugcuagcuaugguccuugaaagggcuccccaucccaacagugagaaggcacaugguacaacguggaggugccuuguuccuagcuggaccugccugaugggaagaaggaaugguccuuugacaauaagaugcacagcagcuguggugggguuuccuggccaacagaaaaggaacacaacaaacuacggcugccauucuagugaaaagaacgucuucucucagcaguugucuucugcagcagaaagugguuaacugaaaguggucuggguccaagcaugucauggucaauggagaagcgauucccaaauauggaaacaggcuauacuagcuuccaaggugccuuuugacccaaugaugaggacuaggugagcaaaagagaaaccagccuuggaaucaaggaaguugguagacacaaagaagagaaggauguaaggcagagguauagggaggagacccacacaagccaagcaagccaacuucccauauagaugcuauucagucuacugacuggcacagggauaaagguagcauuucuaagaggaaagaggucuguguaagguauuacaagggcaagcccaaggcugcucugcagccuggucccugaugauuucggaaucucccccaagcuucaguuaaccaauuuuguacaacuaucuaagcugagaaaucuguuuuaaaugcucuuuguccuuucuucaggcuaaaaauucaagugaguagggacugcccucugucaaauagacuuauuaauguaaauuaaaaugcuauuuuuuuuuuuuuugaaauggagucucacucugucgcccaggcuggagugcaacggcgugaucucggcucacugcaaccucugccucccagguucaagcgauucuccugccucagccuccagaguagcuucuguaaggcuauaaaccacagagauuuucaaguaccacucaguguucaggaagcugaacauuaauuacaagugcuucuugaaaguacaagggugaggaucuuccuggaaguacuauugguuagauaaaaucucuccugguggcagugccucuaaucagagucuggggaauccaaaugagacguggcaaucaagaauaaguacaauaaaaguccaaaaaggcuucaaaauuuccaucuggaggaagccaagugucauaaggagacucaaacugggucagguacagagaaugguaaaagcagcauucuaaaccuagccaagagccauuugcuguacacuacagccgcaaaaugugcaugaagacucugcuuugggaucuagaaauugauucaagccaagcaccucugaaaaguccccaaggacuacuggcauucuuuggacacugccuaagaaguuacuuucuaggcucuuguguuaggauagaacucuuaggcugcuuuagcacacaaucaucacuuaacaguggggcugguauccuuuucuggcucaaggacuucauuucaaagcuuuuucguguaguuuaaaggguaagagaugacacuggggggauccuccuggcuacauaguaacugacagccuauaaauggcuaguagugucuagguccauggccacaugcaauacugccucagggccaagaaagacuaagacagcauugacuucuucaacuuuguaaacagacaguguggucucuucaccuuguucaaaugcuuaugccaaucacuuguuuauuuaaugacuacuuagugaucagcucuucugugccugguuaugaugaggacaagagcagugaacaguacauaugcgaucacugucuucauggagcuuacaucuaauggauucuacugccugcagcagauaagcuaggaaguaaaggacaggaggguuuaagcugaaggaagcuuagaaaaguauuggcuagagcaaaauguaguauggguaagaauuauccaaagagcuugugaaaauagauucugggcucccccuggauagucuggguacgucugagguggggcauucgcauuucuaacaaguuccaagaugauauugacaacaucuguggauggaccaccuuuugagaagcacuaaacuagagcaagcaagaacucgaaggcgucccugcucaaaacuaucuccucauauauuccaccauagagauagauuccuaucaccugauauuuaaucagucaacugagugauaucugaagccuccaaagauaaaggaaggggaauucuggauaaagaagagucuaagcagcuggggguuguauguuccccgccucccaucacacaucuugaaaguaagagaaggcaaagccgaacugccugcuuugcagcugugcuucauauccugggaacagcucuguaagacugucaaagccaaucugaaagucugcacaucucccagaauggccaagucuggcuucugcaagccagacauucuucaucuaacucccacugggaagaauaaagaaagaaagcaggaaaagacaagagaugucaaauggagcuauacauccaaaagucaaaggugauaaaauaaugguguccccaggagaggcugcaauaaaaugacauccaaguucuucaucauacucugcaaucuguuugagcaguauuaauugcaguuucauuugcuccaauuuuccauguguuaaucauugcccuggcaucacgaaaaggaucuuucuuccaaggagguggcacuaccuaccccagaaggucaagaaagucaacaaaaacagucugcuuaugacaggcauauuauggucuauaauaauaauccaacuaauaauaauaugcuuuggguaaaugaacaccucuacacuuugagaggcuggcuccuuuuuugcccuuuuuagguuuaaaaauggucuuuaaaugugacuuuguggugacuucaaacuacaucugauguuuggaaagauuuccaaguccaguuaucaaucaguuucagaaguggagauaagaaaauacuuucccccaugaacuaacaacaagaacuuuauaguauuaagauuauuacuggccaagcgcaucggcucagccuguaagcccagcacuuuggggggccaaggcagucagauuacuugagcucaggaguuugagaccagccugggcaacauggugaaaaaauauauauacaaaaauuaaccagguaugguggugugugccuguagucucagcugcucgggaggcugagguaggaggaucacuugagcccgagagguggagguugcagugagccuagauagcacacugcauuccagccugggugaaaaaaaaagauuccacggacugauuucuccuguugaauguguuaacaaggcccugugguagaaaaguguaggguuaaagaucccuuagccaagaaucccaaucuccugguacuugaaguaaaucaagucuuuuuccaaaaugcuauggugcuuagugcuucuaucacaccauuuaauccuuaacugucuugacuguucccucaagaucuaguuauuguucucuaauuauccauagugcauuaauugucucuccaauuaaagacuaaguucuuaaagcaaagacccccaucuccuccucucuggacauuucccaaagcauaacaggaguuguacugagcacagaauaaagacacacuggguccuuuuucauuuaaauugaaauccaacuucauucugagugucaggaacuaaacuuccuugcugaaauuuacccaccaaauguaguaggagacagcagagaugaucuuuuuuaaaaaacgucuuccaaguagacuugaccauuacgauuuguaccuucaacaucacuuggagaagaggcccauucucugcuuuagcaucugugcauugauuaaauaagcccuauuuuuccagcgguagcuguuaccauuccugagaaagcacacucagauguaagauacaugcuuuggcuuggaaaggcaccuccaucuggccugagcauuuuuuuuuuuuuuuuuuuuuuugagacggagcuucgcucuuguugcccaggcuggagugcaauggugcgaucuuggcucauggcaacuuccaccuccuggguuuaagcgauucuccugcuucagccucccgaguagcugggauuagaggcaugcaccaccacacccggcuaauuuuguauuuuuaguagagacaggguuucuccauguuggucaggcuggucucaaacacccgaccuaaggugguccgccugccucggcuucccaaaguguugggauuacaggugugagccaccacgcccagccuuggccugagcauuuaguaaucaucuucuaacauucuuuuccugugugccccuauuuccuguuacuuucuucuagagagaaaagaagccuuauuuuuaccacuuuggcagagccuuuugaacaaaaggcuuucagaauugaagcaguacagcugacuuuuagcugcucugaggauuuucuuugcuccaaaguauagcagacaugagaaauucaucaaaucuggggcagauucuucauaauuauaugacauuagugguucugagaauuacuacuuaguugugugcuuguucccauucaucaaaaggguccaugaagagggguuauuucauucccauguaaacauacagacuucucagaaccuaguucaugcuacucaaaauaucaccucacacauuucagaggauuucagaaaagucugucagaaaaaaacacaucacacuagucgaauuguauuuaaaagcugucuuccggccaggugugguggcucacgccuguaaucccagcacuuugggaggccgaggcaggcagaucaccugaggucaugaguuugagaccagccuggccgacguggugaaaccccgucgcuacuaaaaauacaaaaaauuagccgggugugguggugggcgccuguaaucccagcuacuugggagucugaggcagaauugcuugaaccugggagauggagguugcagugaggcaagaucgugccacugcacuccagccugggugacaagguaagacuccaucucaaaaaaaaaaaaaaaaaaaagcugucuuccuccauucugcuuucaaauuuuuaguauucaaaugacuaaaaaaggugcuaguacaaauaccaggcagaaagcaaacuauuaaaauuaaugaguuaauuaauuaaaaggccaaugacuguugcacucacucuaggaaaaggagaagaucuuacuacaaaacagcagagccaaauaagcaaaacgaaauaggauguugacagguguaaauuccaagccaagcagccuuccuuccugacaccucugagaacaacucagcaaaccucagagccaauccaguuacugcuauuuuccgcaaccgauaccagcaauucuccaaguugagacuagugcucaccaagaguucaaaacaaaguggccuccaacaagaucucuccuuggcugcagguaccacaaaccucguucaccuauuaacgccuaccaguaaaauaacuuggucauuucacucucuacuguuccacuccaucacuuccauaacucuacuaguagcuauuuacauagauuuggauaccuuguguuaguuucuugaaaccaauauucuugguuucuaugccugaccagagcugaccauaccugacuacggcugccccuuuucuaccuaugaccuggaauaaucaugccaucuucccaggcucccgaauccaguuauuucccacucaauucuucuuaggcacaguaauaaaugcauuaagaugaacuagacauuagaaggacuaaagccugacuuaccugcauaaauaucuauucugguggcaucagcaucucugcaaagugaaaagaaaagaaucaugugaauuaauaugaaauaucaaccaucaaaaugcauagugauuugaguagaaugcagaguauuuugagucuguuuucaggaagccauacagaaauucuauagacauuuagaauuuuuuuuacuuuuauacuugacaacacaauuuucuuuauauaucuguaaaacauuucugaagccccaaauuauugaagaugaucacaugacauggggccuggauauuuuuuuuaaauccugauuuugugguaaaaacaucuauaggauaagcaagaauauuucccuuuauacccuaagaaaugauucaaauauguuuuucucacucauuugauugcaaucauaaaaagauguuccaauaacuuguccacuuuuucuucucgucaauauuuuaagaaaaaaggaagacaauaaucucccacaaaaccugugaaaaaucacuucucgugguauacacacugcagucagcagacugauuccugagcccauaaucuuaaccucccuaaaccugaaaggaaguugggauaccccugccccauuagacuccaaccauuggcugaaaucauacagauucaguuaucaaugaagacuuccauaaaggcucagaaguaauuuaguccaauucugccaacugcaaagaaaaugaaaccguuucacugguuuuacaugcaaaaaauccacacagcucuacauauaccuauucucaaauaucuaaaacauuuucaaauaugagagauacuggcaaaauguauacacaaguaggaauacauacuccuaagaaucucuauuuuaccauaugauacacaaaaaaagcagccugccaccgcacaucauggucucacuaaauuaacaaguggcaaauucaaacacaguuccauuaaccuacaacacuuuuuaauugaauggaaaaaugaugagucaaccaggauugaaacaaaacaggaguuuucugguuaaacaacuagcacacuuccaugagcaguccagcuaauaacaacaacaaaaguaauuagaauaaguuuauuguauacacagagguaaagaggaaauuaucagcgagcacauuaacuggagaucuguuugaaaguacuuccgcugucaauuuucauccuccucuuccuuccuuagucaucaaaaccuagucaguaaaugugucugaauuuuauguuugcauucaggaauaagacuaagacacuauuuuccuaauuauaaacagaaucuugauauggacuuggauuuacaucagaacuaacccaaacuucuauucagucuuacacaguaacauuuacauguuucuaucacuaagaacucaguauaagacagugcugaccaaugauuccuuccaagcacagcugcuaacaaugaaagacacugugaucauuuaguuaucugacaaauauacaauuugagaagacacagaacuuuggcauaguuuuaaagacauuagaugguguacuauccugcuagcacaaauuaaaucagagccugccugucucauuaauaugauuccuaagugucuaucuuaauuccuugcauuuuacuacaauuaucuugcucuaauacacaagggaagugguuuuggaggugauaacucacuauuuuuaggcuagaacacaaagaacaauuagugaauuuaaguaagaaaguggaaguuaucaacuaaugugcuauuaaaaauauuauuuuuaguaagaggcauccuaggaguuacagaaugucuacauucuacagaaaugucuuccucucaagucuucagagagcaaaggucacagcuaccuaaaguguuuccacuucaagcacagauuguaugccugaagacuacauaccuugcauuaucaaccaguucagcaagggcaccaaacaagaauucgugagugguucugaaaugauaaauacuaaaagucagcaaaagaauuauugaaguuauaauuccuaauaaaaagccaugguuauaaaauauuuaaguuuuuugaaaaaaaucuuaaaaccaccauuugcauuguuuuuauacuacucaaggcuuuccagagcuccccaacuccccucaauuguuaaucuuuaacaaguccugccaucuauucagaaaugauuauucuuccuauuuugaguugggaaacccacccugaagcauugaaagaguccuauguguaguaacugcuaaaaguguuuuucacuauucauauccugccuagaaaaaugccuguauauuuuauuuuucauugccuuaaccaguggucaguuucugcauaucucagagcaagaauuuuaaggauauaucuuaugcauaaauauugaacuuuguuuuuuguuuuuucuuugagacagguucucauucuugucacucggacuggaguauaguaaguuuugaauaacaugauaacuguguauuuacucaauccaaacuuugagcagccucccagaggagaugaccacugguuccccuccuugaagggguuaauguuaacaggggcccuaggcaaccacaccaagcaagcucuugucauccuagaaggaauuguuggaaaaggucuucgauuacuuucuuuaauggagggaaaguucugguuuuagccaaaaucugagaaagucauaaaaugaguuauucucuuuaccuucucuuucaaaugggauauuuuugcuuauaaauuacacaaaaguguaugaguuuccuuucuucacugguagaugacgcacaaguauugguaaaacaaaaugcuaacaaguuauacauugagcaugugcaauuuacacuguuuaauuugugcucuuuuccacaauaguccucaugagauaucaaauuaggauguguccacauagaaccaccuaaaaaaaaaacacuugacuucugauuaaauacaauauuaacccacauaauacaugaccaucaauuuuucaaaaauauccauguuacucugacuuuuuugcauagaguuucagccaaaguaaaaaguuucagccaauuuucaguuaaaguaagaauuuuuaaaugaaauauaucaauaguaaauaaccagcaucuaggaucucugaucgcuuaccauauugcaaacaaaauguaaaacauuuauuaaauaaauauccauaacuaaacucuccaggaauauuguuuuuucuuccucaaguaacuccaaauuuuuacaaaugcaauuuuuuuguuuuguuuuguuuuugagacagaguuucgcucuugucgcccaggcuggagugcgauggcacaaucuuggcucacugcaaccuccaccuccuggguucaagugauucuccugccuuggccuccagaauagcugggauuacaggcaugcgccaccacacccggcuaauuuuguauuuuuaguagagaggagguuucaccauguuggccaggcuggucucaaacuccugaccucaggugaucugccugccuuggacucccaaagugcugagauuacagaccugagccaccacacacggccuacaaaugcaaauuuugaauuaaacuaucacuugguggaauuauaggaagaccuuucccccaacaagaucagugaauauaugugcugcuaauccaaaggcagcacgacaaauauguuauaaccaaaagaaauuuuaucaucaauuuaccuaggaaauagaguucaaauucuucuggguaaaaucuaauuaauuauacuacagggaaaagacagauuuauuuauuuauuuauuuauuuugagacggaguuuuuccucuuguugcccaggcuggagugcaauggcgcaaucuccgcucacugcaaccuccgccucccggguucaagcaauucuccugcuucagccuccugaguagcugguauuacaagcauaggccaccaugcccggcuaauuuuuuuguauuuuuaguagagacgggguuucuccauguuggucaggcuggucuugaacucccaaccucaggugauccgcccgccucggccucccaaagugcugggauuacagccauaagccgccacacccggcuggaaaagacagauuucucaaaaaaaaaaaaaaaaaaaguccauaaaacagccauauuuuguuguuguuguuguuauuuuguuuuuuuguuuugagacagagucucacugcgucgcccaggcuggagugcaagcggcgcaaucucggcucacugcaaccucugccuccaggguucaagcaauucuucugccucagccucccgaguagcugggauuacaggcgccugccacuaugcccagcuaauuuuuuaaaauauuuuuaguagagacaggguuucaccaaguuggucaggcugcucuugaacuccugaccucaggugauccagccgccucagccucccaaagugcuggaauuacaggcgugagccaccaugcccggcccauauguuuaauuauuaaaaauaucugucuugugcccccucaguaaaaauuuaaaaaaaaaauuuaaagaacaaaaaauauuugucucuagaauuaucacuuuaaauucuuuaaauuaccaacuaaauaaacaaaaaguauucuguaaacuaccccacuaacuagggagaaauaagcuuaaaaauuaaggugacuugccaaagguaauguugguuaaaagugaaucuaacauuugguuucaaacuuucaaccagucauuuuccuaucaaacauauaagugacuuagaaacuuacaaagugaauucauuuuauauacccuaaauauuuuugaggauuguuauauagaaauauaaaaugaccaauuuuaucccaauucuucucauuucaacaugaguuuguacuuuuaacguaaaucaaggaaucucaaaaauagagcuaccagaaaaaaacaagagcacaaccauaguaaguaugagaccacaucuugcaucagaauguacuaacuucagaauaaauaaugaaguuuccagucuuugguagugagaauggucaaucugaauauucuggaaaacuaauuuugacacccucugccauuaggacaagaaaaccaaaacagaaauuucaacugcuucuuagcaauacauauuuuccgauagcaucccacaagaaugagaaauuuagaaugcaauaagcagaucuccaaagggcaagcacaaagcaccugccacacagugcuuagaaaugugccuuguguggugccucacgccuauaaacccagcacuuugggaggccgagguggguggaucgcuugaacucaggaguuugagaccagccuggccaacauguugaaacccugacucuacuaaaaauacaaaaaaauuagucaggcaugguggcggacaccuguaauccuaacuacuugagaggcugaggcaggagaaucgcuugaacccgggagguagagguugcaugcagugagccgacauugugagaucgcgccacuguacuccagccuggacaagagcaaaacuccaccucaaaaaaaaaaaaagaaagaaagaaagaaagaaaugugccuugcauauuuagaacuuucaaaaaauucuaaaugggcagggugcaguggcucacaccuguaauccuggcacuuugggaagcccaggccagcagaugccuuuagcccaggaauuugaaaucagccugggcaacacggcaaaacccccaucucuacaaaaaguagagaaauaaaaauaaauuauuauuuauaauaaauaaauaagccagguguggugguguacaccuguaguuccagcuacuugaaaggcugaggugggaggauggccugagccuaagaagcgaggguugcagugagccaagacugcgccacggcacaccaaccuggcugaaagagccagacccugucucaaaaaaaaaaaaaaaaacuaauggucuuuguuguuccacacagucucaaugcuguuccaugcauacauacauauuucagauaagcuaacaguagccuuuacaauguagccaaaggguacuuuugugauggcaguacauaucauaaaagaagccuuuugugaccacuguugguaaagucagagauaauacucagaaucucuuccagaccuccaacugauuaaagauagaucuuccagaugcuaaaaucaagaguucuaaauauuucuuaaaaucauaagaaucaaaauuauaccaacugcacaaauucuuuuuuaccaaauaauauuccaagaguacacucauugcuagcuagcauuugggauagaguaaacaucaaaagaaauucuuuuuuuuuuuugagacagagucucgcucugucacccaggcuggagugcaguggugcgaucggcucacugcaagcuccgccucccggguucaggccauucuccugucucagccucccgaguagcuagcugggacuacaggagcccgcagccacgcccagauaauuuuuuuguauuuuuaguacagacgggguuucaccauguuaaccaggauggucucaaucuccugaccucgugauccacccaccucggccucccaaagugcugggauuacaggcgugagccacagcacccggccuagaaauucuuuucuucacagaccuaaacauccuuugcaugugauccaagaaaggugaacuggaaaaagacaaagauuuuuugaaaauucguucacuuucaacugauuauggcuuuuuuuuuuuuugagagauggagucuugcucuguugccccggcuggagugcagcggcaugaucucaacucaucgcaaccucugccucccaguucaagagauucuccugccucagacucccgaguagcugggauuacaggcacaagcuaccaugcccggcuaauuuuuuguauuuuuaauagcgaugggguuucaccguguuggccaggcuggucuggaacuccuggccucaagugaucugcccaccuuggccuuccaaagugcugggauuacaggcaugagccaaccgcgccuggcugaucacggcuuuuauaucauuugugucacaguauaaacaguuugcagcuuagcauuuccagggacaaauucaccuguaaauuagcuuguuauguaaggaaaauggucucccuauuuacauucauccugaauguaaaccaauagaucauccauaggcccaucacacaguauaccuuugcugaguuccuagacgugcugacaauagguaauugccuuaauugcuagaaaauaaagcugagaaauucuagagcaacuauuuuacauugaaauggcuuuaauauauuuaagauaugagccugcucaacagccuuaaaguaauaaguaaucuaagucucugaguugacaggcuccucuacauucacuucacauacccauaaaacucagaaauagggcugggugcaguggcucagaucuguaaucccagcacuuugggaggccgaggcaggcggaugaugaggucaagagaucaagucuauccuggcuaacacggugaaaccccaucucuacuaaaaauacaaaaaauuacccaggcaugguggcaugcgccuguagucccagcuacuuggaaggcugagggaggacaaucacuugaaccugggagguggagguugcagugaggcgagauggugccacugcacuccagccugggugacagagcaagacuccauccaaaaaaaaaccaaaaacaaaacaaaacaaaaaacccagaaauauaugcccaagauguuaagugacuaaaugugccaacaaaaauaaauagcagacaucuuauaucuaagcauccugcucuaucagaccacuuagcaguacugcaaacaaagugacuuaauauacacauuuuaugccaaaggaacaucacuaccaccacuacaucugaaguagaagucacaaaacccacuaccaaagagaaguaacagcaugaaacuccuuuuacuuaaaaacccuaacauuuaucaucucauacuagcaacaucugauguuaaauuaacugaagacuuucagguuaucacgagaauuuauuucccaggccugcuguaaaccuuaaaaagcugaaguaaccaacagaauaaccaucaaaaguuaucaaagaccugauacaaaaaaagacagauguucacugucuccaaaagaugcuccagaauuuccuaagaacugaugugccuaaugacuagcaccaaacaaguugccaccacagugaccaacuucugguuuauauaaacuauuauagaguaacacucaccauucacacaauguuuacuguguaccaccguaugagcuaagaacuuuacaaacaucauuucauauaauccucguaaaaacugucagauuagccccauuuuauaguugaagaaacugagauucaagaacuugaccuguccaaggacacagccaggaaacacucaaguccagguuuggcugguuugcaagcacacggucuuuucacugcaccacacugauuuccacacuucucaucuggucacugcuucuaagucuacauuuaaugagaaguaagcaaaggaccauuuauuuccuaauucgcaauacuguagaugucagacaccaugaaauggucucguguuccuaagauuuuaacagaacaaaggagaagagagacaaaucuucccuucucugaagaugacuuacugaaccacuuuacacacaggugguucaucuuccaucuuuaugagcuacaagucacaucaugugagaauuuuaaaauuuauuuucucuauaaaugaacuuccaaucaggucaccacaauguuuuaaaaaucuucugaaauuagaaauaaaaaacuuaucuuguugguuuaggguuuauacugucuucugguaggacuaauacaucaaaaaggagaacaacuucuaaggucgaauuugugauccagguaagaaauuccagagcuuccaaaaugauacuccaacccucaaauguucaugcaagcaggugguuccaguucaacauggguaagucaaagucccagaaaauuccccaacaaaugacuuaacugguuucuuuccuuuccuuggcagugccaaguaucuaucaauaagcuauaaaauagcaaagggggaaaaagaagggagaaauaucccagaguccuuagagauucauugagauaaacuaaaauugaagacuuuuaaacugugaaguauacccuuugcuuuauagacaagcaaauaggcucuugaagguaaaacugacuacaguaggcacugccuaaugguuaaaagcaccaacuacuguggccagauaaaucccacugucuuaaaucuuggcaccguuuaagucugccacuuggcagcuauauagccauuaccauguaauuuaaucucuuugaaccucaguuuccucaaaugcaaaauaggaauaauccuuaucccaaaggcuuccuguaaagauugcuuuggacaauguuuaaaauagugacugauaugaagcaauuaacuguuguuacuauuauuaucccauaaagucuuuggugaagcuggaacaagaacugaaauucugaaguccaguucauggucuuccaagauuaucauaaaaucuguaauuccagacuuaccaucauuccaaaauucagagcugagauaaccauuuaucaaacacagucauccaugaacauuuaaguggccuucaacugcuuguucuuaauauggcaguucaaacauuaaaaaggacacuaaaguuuuuucccaaggcuaugcuaucaacuagcugaauaaucacuaaucagcaaccucacccaaguguguuucagggucaucauacuuaaguguuagaauucaaccuaggugacugcuacaggccggccaugguggcucaugccuguaaucccagcacuuugggaggccaagguggguggaucaccugaagucaggaguucgggaccagccuggccaacauauagugaaaccccgucucucuaaaaaaauacaaaaauuagcugggcgugguggugcaugccuguagucccagcuacuugggaagcugaggcaggagaaucguuugaaccugggaggugaagguugcagugagccaagauugcgccaccccacucuagccugagcaacagagcaagacuccgucucucaaaaaaauaacaaacuuccuaaaaaaaauaaaaacaggcuuucaccauuugacaguuugcuucacuacuuggcaaaauuuuauucccuuuaaaggaaaaauagaaauauuacagacauuaugauaucacaaacauguugucuucuccaucaaaagcuaaaaaccauuguacuauuacuacauaauggaagucuauacucucgacucugaaguggguucuucagagacuggaccauucauguagcugcucaucuccucuccagguacuagaauguuagaacacuuaccuucaucucaaaaguaacaggugaauguauuaaaacacuaaaguuuugacgcuacuggacagccuccaagagagugggcauauggauuaaaccugaaacauuccagaccauguuggagugauuagauuacuccuucaugaacucaagaaccaugaacacuguauguuucuguggaaauuuuggggaaagacuaucuaaauagagauauaaacaaguugccguuuccuguuuagcauauacaaauaauauuggaugugagcaaucugccaggaagauaaugccaacuucugaaaaaauaaaaauuuucuucuugaaaguugucauuuaaaugucuucuguuuucuuguuagaaaguaaacacuuguuauaaaccuaacuguuuaggacguugucacuacagaggggaaacgguugauacuaaaauaguccaacauuuggcgauccaauagagcaguauuuguuggauuccuauaaacacuugaaugaaacaacucaacauauugacuucaaauaacuaaaguuugcauuuagaaaauuuugauccaauaaacaaaaaucagauucuucuggauuagcaacaaguauuucacugaucucaguucuucaauacagagcucaagauauccagugacacauuucacuccagugggauacaucucaaaaagugaaaaagcaaaauuuucuggggaaacgauuuccauauaauaucaaggaacgaguuacugguuaccucaguggcaccuagaggauacuuacgaauuugugugcagauauucaaagguuagcugagcucgauucagacugcuguaauuugugaaagccaugacugcaauaaggucuccagcccuucacccgcuaacugggaaauauaaccuuauaaugauaucgauuucccaggauucuguccaguaaagcuucaguaagucugugcuccuuaaugacaguuaaaguaaccuaguagcuauccaaaauauaugcagagauguuuaaaacuacaauuucuucaaguguuuuuuuuuaaucuucucaaugauuuaugauguaauauuuuggaaggaacuaugucauaaaucuguagcuuuaaggagcuuuuagcauuaaguugcgauagcucaauucagacaaucugagucucguguggaugguccugaaggagaugguccuugagugggugguuuaugacugcuccaucuucauguucuuccagccuuuuuugguuccccgaaauuuccugucaggaaauuuaccaacgcggaaauuuacccacuucugucagaaaacugaucagccaugucuucgccacacgugaugccaggauucuuaaacaggcccaagaccggagaccaagaugucgacggaguguuauauggcgcaaguugcagcuucaccaccucccaagugaaaaagcuccuaggcacucacgauuucuuuuuucaaagccggaccaaacccaguucagggugguggucagauuaccucacacuuggcccacauaaacaccucacaaaugacccgcccacagcaccucgggcaggccgcgccccgcccccacgucccucagacaacagccucagccucccaggcccuucccgggccucggucccguggccgccuccccacgaagaggagcuacucccggcuuccaaggaccggaucgagggcaguggcgagcgcaccaccugaccgggcacuacccggaucucacaacugccuuugucccuccccgcggaauuggaacccaacagccgcagagcgcucuuggaaccaugugcugcugccgccuccgccgccgccgccgcugccuccgccgccgcccgcgcgccgcccgcgcgccgcgcuaguugagauggugacaggauucagcaacacgaaauucggcguuuagagcugcucugccgccgccgucacagacaccacagccaccgcuuugucuccgauagugcacacagccccggccaccucgcacacu

SEQ ID NO: 16479 - RNA, 22206 nt, Homo sapiens
ucucuugucccugccccugcaccugaggaguaugaggcaccaggccacuguagcagguccacaggccaucaaugcuuuaauuuugucagaggcaggcacugagcagcccugcugaggucuccccagcuacugugccacaaccagcucggagcugccacucuaacagcagaguggagagcuggggucagggccauagcccccgggcugaggaggccuucuugcaggaccccaaccacagaacgaguggucuucacaacaccugcggccugcggacuccguuuuuugccaaggagucugagaugcuucaugcccaucagaccaugggguggccuucaugggagaccugcagggccaggcuggccagacuuggccagaaagacuucccagggaagaugcuuggcucucugcuccaaggugggccaugguauagggcccucgaagggcuuguggcuggggugaucccagggggcauugcucaaagugcacaggagguggcagcagggucaggcgaguuccuguuccagggacaucaggagggaggguagaagccuagggagugugcgaggcugcugggaugagggagcucaggggcuaccagcuaaccagccucagcucaaugguuucuccauccuugggucuguagucagcaauaccugcagaaacagauugagcaaggaggggcgaauugggcagaauaucgcaccccgcaaccucaucuuccagaccccccacccugaggcuagagucuguaagaauccaccuggggcuugguggugggaagcuggaaccucccuaaagccugcucaaagacucugaacucagcuucccacaggguuccugaggccaugaccucaucugguaauaaaaacaccugacaggcagggccacugucuuuguaauacccuagggaccaucaggaagagaaacuugcgcagugcagucuggagagagaaccaggaccacgcagaagucucccaggagucagcuuucacucacuacacagaauccaggcucuaggaggacgccuggauucaagccccagcucugucauucauuacugcugugacucuggacaaguuauuuaaccucugagugagugucgcugcucuuguuggugaugugggaaugcagccugcaggggaacugaaagggcccuuugagauagccaggugucagaaauguuuccuuucaauggaggugcuauggucuaaaaugucuguguccccccaaaauguauauguuaaaaccuaaccccaaaggugaugguaucaggaggccuuagggccuuugggagaugauuaggucaugagaguagagccucaucaaugggauaggaaagugccauuauaggccgagcaggguggcucauaccuagaaucccagcacuuugggaggccaaggcaggcagaucacuugaguucagaaguucgagaccagccuaugcaacauggugaaaccacauuucuacuaaaaauacaaaaaauuagcugggcuuugugccaugggccuauggucacacguacucaggaggcugaggugggaggaucgcuuaagccagggaggcagagguugcagugagcugagauugugauacugcacucagcgugggugacagagugagacccccaucucaaaaaaaaaaauuuuuaaguaccauuauaaaagagguuccuucagcaggcaagggccaggaaaauauuuuuuuuuuuuaaauuaaaaaacaaggccccagaaaguugccauguuccuuccaccaugugagaacacagccagcagguaacaccagaaagugggcccccaucagacacugaaucugucaguguccugaucugggacugcccacccaaccuccagaacuguuaagaaauacauuucuguuauuuuauuucauuuugagauggaguuucacucuuguugcccaggcugaaaugcaauggcgugaucucagcucacggcaaccuccgccuccuggguucaagcgauucuccugccucagccuccugaguagcugggauuacaggugcccgccaccacccccagcuaauuuuuuguauuuuuaguagagacaggguuucaccauguuggucaggcuagucuugaacuacugaucucaggugauccaccugccuuggccucccaaagugcuggaauuauaggcaugagccaccgcacccggccucauuucugcuguuuauaagccacccaguuuaugguauuuuguaauagcagcuucaauggacuaagacaaaagagaacucaaauuauaacucccauccacuuuccaccccaaggaagauagaggagugauuuaugcaacugguugauuugggaagaauaaacuaggcauguguagccugggcgcuauuuuucuccugggagcgggcuuccuucuagacucaagggcagagggggaaggagauagaggcuacaacugcccaggucugcuuccuggcuggguccaccuagcucucacccuccugucuuuaucaguaauagaacuggccagacuuggggucuccaucuguagcuccuauuuuuuauuccucaauuuauucagaaugagggcaagaaaagaaugcuuuuuugugggcucccucagaaagucccaccuucucuauaagcacucgccacaaugcuugacacaugguaagugccccauaaaaguucuucagggguggaguaucaaagcaacuuaaauaacaagaguaggaacagaugacuuuuaagggucuguuugcaggccaggcgugguggcucacgccuguaaucccagcacuuugggaggcugaggcaggcagaucacuugaggucaggaguuugagaccagccuggccaacauggugaaaccccgucucuacuaaaaauacaaaaauaacugggcaugguggcacacaccuguaaucccagcuacuugggaggcugaggcaggagaauugcuugagcucagaaggcagaggcugcagugagcugagaccucgccauuguacuccggccugggcaacagagcaagacuccaucucaaaaaaaaaaaauauauauauauauauauauguguguguguguguguguauauauguauacauauauauguguguauauauguauacauauauauguguguauauauguauacauauauauguguguguauauauguauacauauguguguguguauauauguauacauauauauguguguauauauauguauacauauauauguguguauauauguguguauauauguguguauguauguguauguauguguguguauauguguguguauguguguguauauauguguauguguguauauauguauacauauauauguguguauauauauauacauauauauguguguauauauauguauacauauauaugugugucuguauauauauauauuucauauauauguauacacauauaugaaauuuuuaaguuauacaugugggcaacauuaaauuuccacuggauagcauggcuccauuuuuuaugaaaaacuuacugccauauuuuuaaaaaguaucuagaagaaaaguuaaguaauuuuggcugggugcgguggcucaugccuguaaucccagaacuuugggaggcagaggcaggcagaccacuugggcucuaggaaggcugagguggaagaaucacaugaacccaggaggcggagguugcagcgagccgagaucauaccgcugcacuccagccugggcaacaagagcgaaacuccaucucaaaauaaaagacguuauuccuagguaguauauccuaggugauguuaauuuucuucuaguuuuuuuuuuuuuuuguaaucugucugguuuccuagaauuuccacaguaacuugcauaaaaauucuaaggcuucaguucaauauauuauauccaacuuugagcaucagugauuuugugaagguguggcccaggagggugcuagggaaagcuggggugaguugaugaagccucuuggcugaguaagcuugggguaggggacacauccagagugucaggccaugacucaccuugcaacagugggguguuggggucucggagaagcugccagaacucccuuucuccggccgcuuuccccaucacggagguuaaguaggggccugacaaggaggccuguguuucauaucuacagaagggaaaggcaaauggggagagaagagguggcuguugucccuaaggggagaggcagugcucacccacagcagcaaaaucccuuccaagcucuuugggccgacacucgucaaacccuucccaggccaccuggccacaggucugugaucucaacuuccaccuccuuccccuccagacccccgauccugccugcucaggcuucauccucuccacgcugaccaugaccauggccuccaggaaaggggcaucuauuauguuaucagcucagcaguuguccccucucuggggggcugauguuaugggggaugagaaucagaagcugcuggugucaccuagaauguguacaauguacaacgagagagggugaagccugcauacagagacaggcagggucaugggaaguggaggcagagacaccuggcaguggcacugggucucuguggcucaguggcauuccccucuucucggggcugcauggcucagccuccucucugauucuacaugcucuacacccgcuguuguggagaggcuuggaguucgguuucuggcccuggcagccaagagacuccucaacucacacucccccuucccugagcuucuggccuucaacuuugaguuucugcacuccgucuggaugccacugccacaggaagccucuuaaaacuccgugggccugggccaggcacaguggcucaacccuguaaucccaguacuuugggaggccaaggcaggcagaucaccugagguugggaguucgagaccagccugaccaacaugaagaaaccccaucucuacuaaaaacacaaaauuagccagguguggugguucaugccaguaaucccagcuacuggggaggcuaaggcaggagaaccgcuugaacccgggacguagagguugcagugagcugagaucguaccauuguaccccagccugggcaacaugagcaaaacuccaucucaaaacaaaacaaaacaaacuccgugggccacguccuucaucccucccacaggagaaagcagcaugaucagggcuuccccuggaagaagggcuucaagagaugagugggauuugccagaggagaagggaggagagcggggcagagcugagaggaggcagagagaagaaaggcacacaggugcacagaauuugggggaauggucuuucaaaagagcagggucaggccaggcacuguggcucaugcuuguaaucccagcacuuugggaggccaaagcggguggaucacuugaggucaggaguucaugaccagccuggacaacauggugaaaccccaucucuacuaauaauacaaaaauuaggcugggcaugguggugcacaccuguaaucccagcuauucaggagacugaggcaggagaaucacuugaaccuaguaggcggagguugcagugaccugaggucgcaccacugcacuccagccuggguaacagagcaagacugcuucucaaaaacaaaaccaagcaaacaaacaaaaaacaacaaaugagcagguucugggagaaugcaaaugacugaaaaggaggugagaccgucaaaguaacagggaagugaugugaacaaacgcaucuucuacaaagugcucucugggguaauacagcccuaaguuaucgaugguugcagucuuagagggauuuuuuugguuuuaagaaacacagguggggcgcggugggucacaucuguaaucccagcacuugaggaggcggagguggguggaucaccugagguugggaguuugacaccagccuggcucacauggugaaacccuauuucuacuaaaaauacaaaaacuagccaggugugauggugggccccuguaaucccagcugcucaggaggcugaggcaggagaaucgcuugaacccaggagguggagguugcagugagccgagaucgugccacugcacuccagccugggcgacugaaugcaacuccgucucaaaacaacaacaacaaccaccacccuauuuggggugacuuuagcgaagggaaacuacuguucuaaggaaugucacagaguagcccuuuucccauuccuuaacucugcagggccauguggcugcacagggcuaccucucuccacaucugucuaucugugucugcaguugagcuuucucugcugugcauucaggggccucaaacauagucuucaugccugaacccaguugaggcauccaugcacacuaacaagagaaccauuucucagacuggaguccacagugucuucccagagauccccgagcucugaauaaaaacguuaaauucuaauugucuuucauuuugaugacaauauucaaacaugaauaccagcugguucuggguaaucucagucugugggucugagcccucccaagggcacucagccuaugcguggccaucagugacugcgcuggugcccagcagcauugcguuaugugccauaggccacaggaaggaaacggagguggcccucauagugaaugaaguggcugagccaggccaggagugcccaggcuucacugcagcuugaauacagggaggugcuaaagugcaggccagcaccuccgcagagcauccuuauuugaaugguauugguuuuuauacuuuucuauuuaauuuauaaaguuguuggggauuuauagcugucuagagcuagaaagagaaaggacuuuuuuugugugugguagagacgggcuuucgccacguuggcccggcugguuuugaacuccuggccucaaguaaucugcccaccuuggccucccaaagugcugggauuacagguguuagccaucacacucagcccuuugucuuuuaaaaaaaaaaaaaaaguuuugucauccaggcuacaggacagugacgucaucauagcuugcugccgccuugaacuccugggcucaagcaguccucccaccucagccuucuggguagcuaggauuauaggugcacaccaucaugcccagcuaauuaaaaaaauuuuuuugaagagauggcagucucacuauguugcccaggcuggucucaaacuccuaggcucaagugauccuccugccucagccucccaaaucacuggaauuacaggagugagccaccagcucuggccaaagacuuuauauuuaauaaaauuaucaguacacaucuaagugauauuauagaagaaauaacuuaaccuggggucugggagaauguuuguacuucagaggagucuuugcauuucuccggucugagauucucuagccuagaggacccgaaggaaccaacugugggcccucccuggaugcaggaugcuguuuuccaggaacucccacuggggacagagauaggcccaugauucuaggggagaagucuguggugugcgugaccugguggaaggcauucaacuucucugggcuggacuccccacugauaacaugagaauuacauucaucuuauuucaucauggacaggaccugucaaacaacaguccagacaugcucauucucaaacuauucuaagcucagggugagaagcaaguguaaggacauuguccaaccucuuugagguaauuaauaacaggauagggccaaacuuauuucauaauaaaaguucuuauucuggccagccacggcggcucacgccuguuaucucagcacuuugggaggccaagguggguagaucgcuugaguccaggaguuugagaccagucugggcaacaugaagcaaucccaugucuacaaaaaauuuuaaaaaaauauuugccaagcgugguggcgcaugccuguuguucccagcuaccugggaggcuaaggugggaggaucagagcccggaagauugaggcuacagugagcugugauugugccacugcacucuagccuaggugacagaguaagacccugucucaaauaaaauaaaaguucuuauucugggccaggcauaguggcucaugccuguaaucccggcacuuugggaggcugaggcagacauaucacuugaggucaagagcucaagaccagccuggccaaaauggcaaaauuccaucucuacucaaaauauaaacauuagccagguaugguggugcaugcccauagucccagcuacucgggagacugaggaaggagaaucgcuugaaccugggagguagaugcugccaugagcugaaauugugccacugcaacccagucugggcgacagagggagacuccaucucaaaaaaaaguagaugggugugguggugcaugccuguagucccuguuacuuggauaauuugaggcugcagugagcuaugaaugugccacugcacuucagccuggauaacagagagagaccuugccuaaauaaauacauggccgggcacggaggcccaugccuguaaucccagcacuuugggaggccgaggcaggcagaucacccgaguucaggaguuagaaaccagcuggccaacauaguaaaacccugucucuacuaaaaauacaaaaauuagcugggcaugguggcacgcgccuguagcgccagcuacucaggaggcugaggcaggacaaucacuugaacccaggagacggagguugcagugagccgagauugcgccacugcacuccagccuaggugaaagagagaggcucugucucgaaauaaauaaauaaauaaaaauaaacaaauacacaaacacgaguugggccuccagagccuggguaauagagugagacucugucucaaaaaaaaaaacaaaaaaaaccaguuauuauucuggcugagcaugauggcucgcaccuauaaucccaauauuuugagcgccucaggugugaggaugguuugaggccaggaauuugagaccagccugggcaacagacagagacccuaucucaaaaaaaaaaaaaaaaaaaauuacccaggguuguguggcacgugccuauagucucagcuauuugggaggcugaggcaggacaguaggguugcuucauccccagaguucgagacugcagugagacgugauugcacaauuacacuccagccugggugauaagauugagacccugucucuuaaaaacaaacaaacaaacaaacaaaaaacaguucuuacucugaugaaagcaacgcuguguugagcgcuugcuaugugcuggaccuugcacauauaaaaagcacaugccacuaucucuauguguacuaacuccuggacucuucacacuggcccugcagggaaggggcacaacuguucuccucggugaauugugggugccuaccuggaaccuagcugguuagaguugggauuccaacuggggggcucugccuccaaagccugcucucucagugacaaugcuggccuauggcucccuguuuccauaacaccgugggcaagaaaggagcugagcagguagaagcagaagcagggccagugucucucccgagggaacccucuccucuguuccccgucucuucugugacccuguuaucaggcaugugagguuggguggggugaggacugggaggugggagucucacgugaauccuccuaacucaugggccuucuucaggacaucuuccacgguggacccggccagaacagagauggacugucuguacggcggcaagagacuaagcaccugcagcgugacacugaugaucucuugggucugaggaauggucucagcagcugguuccaacaugacugugccaggaagaaaggggcgggcagcuggugugaggacagagagccuggauuauuugucuucuugucuucccucaaggacaccuggacuuuguccuuccccauguccucaucuccaucaaugccaccgccaccugcucagcugaaaccuggcuuccaucccggccuccccugucccucauuccccaccaccuggcuuccaucccggccuccccugucccucauuccccaccacccaagaucaggccccucacugguuucucugcuuccaguauccuuccucccaccucucuggcaccuagcacuccagagggcucuuccuagaacaugcauuuguucacaacgcaucucuguuacccugaugcgcucaccuucucuucauucaucugcuuuccacucccacucauucucccagaucccacucuuuugcaagaccauuccucaaaauucccccaaacucugugcaccucugugucuuuguucuuccugccucuucuuggcuccacucuauccauucuuguuuuuucuggagacagagucucacacugucgcccaggcugaagugcaauggcgcgaucucggcucacugcaaccucugucucccagguucaagugauucuuguggcucagccucccuaguagcugggauuauaggugucuaccaccaugccuggcuaaucuuucguauuuuaguaaagacaggguuucaccauguugcccaggcuggucucaaacuccugggcucaggcaauccaucugccucagcuucccagagugcuaggauuauaagcacgagccaccauguccagcuuccuucuucuccauuuuuuuuuuuuuuuuuugagacauagucuuacucugucacccagacuggagugcaguggcaugaucuuggcucacugcaaccuccaccucugagguucaagugauucucuugccucagccuccugaguagcuuagcugggguuacaggcacucgccaccacacccagcuacuuuuuuguauuuuuaauagauggaguuucgccauguuagccaggcuggucucgaacuccugaccucaggugagccacccgccucggccucccaaaguguugggauuacaggcaugagucacugcaccuggccucuuucuccauucuuaauuggcaaaucccagucacguccucagacccucucucagagaaagccuggaucaugcugcuacuggggcuuaucauguuguauuagaguuaaccaaaaugugucucuccucauccauccauccauccauccauccauccauccauccauccauccauccaaacauuucuguacuggguaucacacaagcgauaugcccagggaucuccauuuacugucuuccuccccacacugugagcuucuagaagcuaugaccacauuuuggcugcugugucccaugcacacccacaaucuugugcugacucagcaaaucaggaugaagcaaccuccccucacugggacgucaaugggugcgcagcagauuguaaagggcugugcuuccacaaaaaguugggcuaccucguggugccagacagucugggaagaucagaucaauguaggucuugugguucagaacgggcagcagcugggaaaucaugagagcauucuggaaggcuccauccugcagacuggccagcaaagcaacccucgccuugagacaugcuguucccaguucugccccacgcaugggggaagucaugaggaacuggugauagagugaggaagagagagaggaagucagccggcagggaggggcuagguguuccagcaccugaccacuccaccccugacuguuccccaggguggccauggcuccagggucucuuucccaccuguaaugccaauggggugcuguagacauucccaaaguggcccucgggggucugggccuucaagaucuccucucgcacuguucugauggccauggugauccguugucuccgaccaggguugaaguuugagcgcuucagacaggugaaugccaagccugccauggcugcugugucuugaagugggggacagaacaugcaaugagcuggagagccaaaggggccaggacaggcaggggcuugagggucaggcccuuguagcuauggacaaccacaggagggcuuggagaagaagggcaacauggucagaucagcuaagggcaccaacucaaccuggucugcccaagacuuuccuugucuggacucugaaaauccugugucccaggaaacugcucauuucugggcaaacugguuuggcugaucacucugcaacuugagggcuagagguuagggagaaggacuggaggagggaggcccaagaggacuugaccccauaccaccuauuuccaaacuuagcugcacauuggaaucacuaggggaguuuuauuuuauuuuuuauuuuuugagacagagucucacucacucuguugcccaggcuggagggcaguggugcgaucuccacucacugcagccuccgccucccagguucaagugauucuccugccucagccucccgaguagcugggacuacaggcaugugccaccaugcccggcuaacuuuuuuauuuuuaguagagaugggguuucaccacguugucuugaacuccuggccucaagagauccaccuaccagcuccaaagcuggcucacagcugaagcaucacccaugagcccucgccaauucgucccuaaaggacuugauucggaggagccccaaggaaaggugagugugggggccaggguauggaggucaucagugcagaccuggggacugagggagugccagccuggccuuggcacggucugaccuacucacccacagaaugguggcccugguggaaagguuccacagcauacagaaguuuguccaccacgcugucauggacccgcuucugguggagacacagggccagaaugcccaggccauacugguaguagcuaguguggggguggcccuugugaucaugcccugagagggaaaaaaacagagggguugccucucugcccccacccagcagccagccccgccagcaccugggacccuggccugcacuuuccaacacgcucuuuugggucaugggauccuucauuccuucauugccucagcccauacgugcugaggucucacugugugucaggcacugugcuuagaggaagcaggagacccauggcagacaggcacugcgcaguucgggccucaaccacagcaauugcucaugcgacugcaauugcaacgagaaugcagaccaaguagugauauuuggguggcugggaagucaaggcaggauucuccaaggagguaaugcuggagacggcugaggauggguggaggcagagccaaagguagagcaggagugaacugcacgcagggaagccaguccagauggagggagccuguaugaaaaaacuggcuuaugaguugagagaugguauggcuggagcccacagagggcaggugugugggaggcagagaauggaugagcacagccugggcagaagguaaggguagacaggcugggccauggagcagugcgaggccccugcaggguuuaagcagugccagcaagaucagguuuauauugaaaaggcuggcucuggcuguuguaugcugggucaagucagggcaggagagcuaguagagacagacuauggcguaagucauaagcaggcuguccaguugucccgaagguggauaaucaagucaaucuugguggcuagccaauacaaggcuugucagugggccuaacgcaguggcucaugccuguaaucccagcacuuucggaggcuaaggcaagcggaucaccugaggucaggaguucgagaccagccugaccaacauggagaaaccccacgucuacuaaaaauacaaaauuagcugggugugguggcgcaugccuguaaucccagcuacucaggaggcugaggcaggagaauugcuugaacccaggaggcagagauugcggugagcugagauugcgccauuguacuccagccugggcagcaagagcaaaccuccaacucaaaacaaacaaacaaacaaaaaacaaaaaaccacgaaacacaccugucaauaguaugugugcagcgcgggaaaagcugggucaaggauggcuauggggacagguucgagccucuacguaggcagugagaugggcagaauggauggugggaaagacgccuggggagaaaacccaaaguucugauucucauuggagaauaucaucugaugagcccucccagcugcuccccacccccagcggauggugucugcucaccaauggcucucuucucauccuccaggaaccauuugagcugugagaccagccugucccccuuguggccccugacaaacucacaguuggcucugagagcgagcagguagagggccagcuggcccauggaaggcuugcccuggcagucaccgucauccucgcugaaggcagaccuaggacaaggccaguuaaugccuuugugagaaacugccaccccguaagccugcuuacagcacccaccccacccgcaucacaaagcgggaaaaaaucuuaacagugggaaacuuugauaaaagcuccaaaaggagguguguuggcuauguuguugugagguguaugccacaaauauuuaauaaagaugaacaguuagauucaagaauaaacuccaagggcuccuguguccagaucaucugugccugccccacuauuuuguccauacuucacccauaugcccccuccuuuuuuauuuuuuuauuuuauuuauuuauuuucuuugagacagaguuucgcucuuguugcccaggcuggagugcaguggcauguucucagcucacugcaaccuccgccucccgaguucaagcgauucuucugccucggccucccaaguagcugggauuacaguugcccaccaccacccuuggcuaauuuuuuguauuuucaguagagacaggguuucacuauguuggccagacugguuucgaacuccuaaccucaugugaucuaccuaccuuggccucccaaagugcugggauuacaggcgugagccaccacacccagccauauuuuuauuuuuuuuuuuuacugagauagggucucucugucucccaggcuggagugcaguggugccaccauggcucacuguagccucgauuucucagccucaaaagauccucccaccuuugccuccggagaaguggggaccacaggcaugagucacuacaccuggcucauuuuuuuucuuuuucuuuuuuuuaagagauguggucucacuauguugccuaggcuggucucaaacuccugagcucaagcaaucuuccugccucagccucccaaaauguugggauuacagguaugagccacuaugccuagucuucuuuucucuccaccccugcauccacuucucaagagggagucugagaaagaggcacuccauggcugauucuucgccucucauucaaaccccaaaacaggccucucugugaugccucuugaaaagggagcacaaagaugcugcuuuuggauuggugcaguggcucaugccuauaaucccaacacuuugggaagccaagacaggcggaucaccugaggucaggaguucaagaccagccuggccaacauggugaaacccuaucucuaccaaaaauacaaaaaucagcugggcaugguggcacacgccuguaaucccagcuauucagguggcugaggcacgagaaucacuugaacccgggaauuggagguuggggcaagccaagauugugccacugcacucuagccugggcaacagagugagaggaaagaaaagaaaagaugcugcuucugggcucaguaugaaagaaugcggucauggauuacugaugucugccucaugcaugggaggggagcauacagagucagaugcugcuucuaagcucaauguagaagacugcagucaucgauuagugauaucugccucaggcacacuaagggagcauagagucagaugcugcuccugggcucaucaucaaagaguauagucacggauuaguuaugucugccucagacacaugauggacaguaguagcaaaaggagccuugcauuagcaucucugaucuaauccaaccaaccccuucauucuauagauggacaaagguccuccauucuauagauggagaaaauuugccuaaggucugcccacaaaguggugacaggcccaaacuaguacccaaguuucccaucucuuaguauguggagcaagacauggaaaaagagaguguggcaauacccuaggaggcacugcugguaaccaagcuugaggcugugcagguagaggucuuccuuggucccagccugcagacuggagaggcguaggcccacauagaugcugggguucaagugcuccagggaaagccgguccauccaagguaagaggugcuggcccaacuucucuaccagauggcuguccaucucugguauuucuuagaaaagaaaaugguacaaaugaggucacagggccaggccaccagcaaagaagugcuuugacguuaccagggccuucuccagagaauacauguccucacccccaccuccacccagcacacaccaacuugcagggggaaaugcagccauacugaaaggcagugggaggagaaaagaggggaagcguguaucucuaaagagcaguuggagugagccagcaagagagguggugggcugaagauagaggaugcuacugccaggcaaccacucugcccaucagcagugacagugagacuggugugcccgggcaccuugcccaaucucacuugguccucaugccaguccugugauguagauacugucaucauugcuuugcacagaagaggaaacagaaguucaaagucgugucaugucuuacacaaggcugcagagccaaggauggaccuaacugcaaagcccccgcucuuuggugcccugcugaaugugugugcuacccguuuacaaaaacaucagcccacaugcagaacguguuacacaucaaauuuccaaacaacgcaaacuuccagcuggugaauugaggcugccuggugaacuuccuccaugcagaucucaaaauaacgccuuuccugccaucucuguuuaaaugaagaggaccugagauugugagaugagcucuuagaaaacagucacagcuugcagccguuuaccuguugcugugggauuuauucgaagcugugcaacgaaaauacucaaacacucuggaagcggaagccuuagggauaguuccaagggacuugagcucagcacaggguagcuuagaguaguuugccucggagguaaccuugcacuuucggucccuguuuacugccucccaguugcugcugggcuccagcugccugaugguggccuucacugugccauaucccaggggaccagaacgaggaccagagcuccuagaacagcuccaucucugugggucugggucccacaaccucgugucuguuuucccgacagccccagauaccuguugcuauaaggugaccauccaccagcaugaaacccuacauaauccuuugcugugugggcccagaccaaagcacauggcugguuucucaccagauguuaagagagacugggggguugcuuuuuucccuuucugucacugagaaccauuuuuuggugccuaucuccauuucuccgucucugucacucaaugugugaggcucucugggucugucucagucucucucagccugugucucucuggucaucugccccccuccucaccucucuuuccuuuucccuuuucuugaaacgcgcaagggaguucccugaccucaccccgggcucucacuuccagcacgaugagucagcacaggguuagaaacugaaagaucaggauccagcuguaaagggagagacugacaaccacagagcaaccuccuuagaaggaaggggccaggcagauucacgcaggguaauaaaagcagccuugggugagcucucgcccuaccaacccagcccugccagcuaagggcugauugcuguugacauucacaagcacaggagccagacagaguggcucacgccuguaauaccagcaguuugggaggccaaggugggaggaucgcuugacccuaggaguuugaaaccaacccugggcaauauagugagaccucaucucuagaagaaaauuaaaaaaaaaaaaaagaagaagaaagagaaaaggaagcacaggagcccacuuugcauuagcguuugugcagcgaucccugucaauuucacaacauacauauagagcuuuaaacugggagagcaggugucaugggauccuuccuuguacuacaccgaggaggaaggcaggggagcauucuuagcccacuuuacagauaaaggaaugaggcugggugcaauuaagugacucagugcagauauuugcaccccaaaccccaguucaagauuccccagaccccaagggauuggggcuccuguggggucagguuaauggacuaacuguccaaggcugaggaccagaucagccaggaggaagagcucuugcugguugaacccagaacuccccuggggacuguccggacaugaaccaagagcugggguuccugggcccagaccugaggugucugauugcauuuauggaacacagaugagaggcuuggaguucuggccgggcacgguggcucacgccuguaaucucagcaauuugggaggccgacgcaagaguuucacuugagcccaggaguucgagaccagccugggcaacauggcgaaacccugucucuacaaaaaaauacaaaaauuagccaagcaugguaguaugcacaugcagucuccagcuacuugggaggcugaggugggggaaucacuugaacccacaaggcagaggcugcagugagccaagaucgugccacugcacuccagccugggcaacagagggagaaccucucucaacaaaaaacaaaacgaaaacaaacgaggcuucaaguucuaaaaacuaaguucagcaaagcucuggaaaagguggagcacccugagugggucacucagccccuccaacccucgacuucuucacuugacaccuggacaugacugcacccaccucucaggguuuccccagggucucaagagaccaugggggugaaaguguauugcucaacguaauccuaggugcagaggaggagaaaaggcgcgugggcggcccaaaguucccaaagccugccuucugccuccugucugaaggagcagcccugagccucuaagcucagacucauagacaggucccaggagacugugcuccaagagaccccuuggggcacagagcuggagcaggcaggaccuccgaaggcucacuuccugcugccuagaaugugugucccccacuccuuuccugccagcuccuuuucuuccuucgaguuucagcucccauguguccucuuggucuucagaaagucuuccccaugcccagcuauuuuuuaauuuuuuuuauuuuuuguagagauggggucucccuauguugcccaggcugaccuugaacuguugagcucaagcgauccuccccucccgccucagccuuccaaaaugcugagauuucaggugggagcaccuaaccauuucuuuugucugucccccuucccuagaacauaagcucuaggauggcagggauuagacuugucucaugcuuugcacguuccccaaaggcuaacacugggccugacacagaaaaggcucaguaugcgcugaaugaaugugugaacgaaugacugaauuaacggagaucuugucuggugaggagucaaacauauaaucaaucacaauaggauguguuaaaugcugagguccagcuaagcccaaacugcuaugggagcuuagaagggcagguaaguucccucauccuaugcccuagccaccccacuaaggacccaggaggaaagaggcacaggauagaggcgaguuacucaccacacaucucagugagggcccccaggacccccagaaggaagaggaaggccccaaggugccucauggcagcagcaggugggugagcagugagcaagaaucgggaaagacuccuggggcuggcccugcugaggcucuccugaccacagcuggucaccgcuccgagagacgcagcuuccugucacugauuaauccuccaugccugcaaugcacggcuaagucugcagagggguggggcgggggaaggucugugguggcggggaacauaaggccaaagaacagaggaaggaagggcagagcagcccuccuggagguagggaacaaagggaggaggagggcuagugggaccaugugagacaucuugaggccauucacguuccugcuuaaagagcccgggaccagcgcagagggccugaugccugaucugucaagucuguccgaccgugccugucugcuguccccccagcuguuccagugguggauuggcaggaccgggugccuacccgguacuccuuaccaaaggagccccugguagugcccaccuagcccaggacaaggaguggaacgggagcugcagcugcaguggucacgugagcagcauugcuggagucagcuguuuuucagcaccgccucccucaguuguggcgggaggggauugugggggugggggaguugggcaguuggggagggggaguugggcaguucgguggggggggggaguugggcaauugaggggagggugggugccgcuggccccagaccagccaggccacuuuucucaaccaauccgaaagggcugggagccuccuggagaggacaaaacaaaacaaguuaaagaaugggauuaaguccgggcacgguggcucacaccuguaauccuagcacuuugaaaggcugaggcgggcagaucacuugagcucaggaguuggagaccagccugggcaacauggggaaacacugucucuacaaaaacacaaaaaacacauacaaaaaaccauaaauuagccuggcgugguggcagacgucuguaaucccagcuacuuggggggcugaggcaggaggaucgcuugaacccaagagguggaggcuacagugagccaagauuacaccacugcacuccagcuugggugacaaagugagacccugucucaaaaauaaaauaaaauaaaaagaaugagauugaaucgagacacaaagcuaccagaagcagggguacuugccagaacucggaaaguaaccucaaaaaaaaucucugcaaacagggaagagaacaaaagauuccucaucugcccagccccacaggagaaucaauguauacgaguuaacuagugguggcugugugacuuuggccaggucacuuaaccucucgaguuuaaaauaguucuuccugugugagaagagaggguuaggcaagaucauccuaacaguucccuuucagcucaauuugugaagacacuaugaccuuaaaauaucuccaaucauuuccaugcacaaucugcauugcaauuauuuuaugguaaauugccaagguucacucuuuuaagacaaucuuuuugagccugauuuaucacaaaccaagcccuugacauaaauaaauacagcaacgugugucuguuuacggaacuacuugaaaauuuuaaaugauagguuguccagucagaaaggcuggauguggccacuaggaggagcaccccuggagguucugaggaaggagggaggccaguggggagcccaacuuccgcagaaccgcacguuuggaccuucaggggagucauggugaagugugugcaauggagccaccuugguccugggugggacugccuuggcucccccaacccucugccuguuuccaguaacaacuauuaugauuccuauuuccaggaaggcagccuggaggagguggccauggaggauagccuucguuaucgucagccucuggugagaagcagcagcauccuuccagagagucacuucugauccccaagguaguuagggugucgaaguaaaggagggagacaccccccugccuaccuaccuggacucagugcuagagggugggggaguaggaauaggaagacagcauauuucccauacauauuagaaauacugguggcucaugccuguaaucccagcacuuugggaagccaaggcaggaggauugcuugagcccacaaguuugagaccagucuaggcaagauggugagacccugauucuaaaaaacaaacaaaaccaaaaaaugccagggaugguggugugugccuguaagucucagcuaaucuagaggcuacaagugggaggaucacuugagcccaggaggcugagguugcagugagcugagaucagaccacugcacuccagucugggcgacagaaggagacccuguccuaaaaauaaaguaaaauuaaaaaaagaaauagagugacuggucagggguagugcuauuucaggucauguggucagggaaugugaaaaacaaaaaugauuacaucau

SEQ ID NO: 16480 - RNA, 22206 nt, Homo sapiens
augauguaaucauuuuuguuuuucacauucccugaccacaugaccugaaauagcacuaccccugaccagucacucuauuucuuuuuuuaauuuuacuuuauuuuuaggacagggucuccuucugucgcccagacuggagugcaguggucugaucucagcucacugcaaccucagccuccugggcucaagugauccucccacuuguagccucuagauuagcugagacuuacaggcacacaccaccaucccuggcauuuuuugguuuuguuuguuuuuuagaaucagggucucaccaucuugccuagacuggucucaaacuugugggcucaagcaauccuccugccuuggcuucccaaagugcugggauuacaggcaugagccaccaguauuucuaauauguaugggaaauaugcugucuuccuauuccuacucccccacccucuagcacugaguccagguagguaggcaggggggugucucccuccuuuacuucgacacccuaacuaccuuggggaucagaagugacucucuggaaggaugcugcugcuucucaccagaggcugacgauaacgaaggcuauccuccauggccaccuccuccaggcugccuuccuggaaauaggaaucauaauaguuguuacuggaaacaggcagaggguugggggagccaaggcagucccacccaggaccaagguggcuccauugcacacacuucaccaugacuccccugaagguccaaacgugcgguucugcggaaguugggcuccccacuggccucccuccuuccucagaaccuccaggggugcuccuccuaguggccacauccagccuuucugacuggacaaccuaucauuuaaaauuuucaaguaguuccguaaacagacacacguugcuguauuuauuuaugucaagggcuugguuugugauaaaucaggcucaaaaagauugucuuaaaagagugaaccuuggcaauuuaccauaaaauaauugcaaugcagauugugcauggaaaugauuggagauauuuuaaggucauagugucuucacaaauugagcugaaagggaacuguuaggaugaucuugccuaacccucucuucucacacaggaagaacuauuuuaaacucgagagguuaagugaccuggccaaagucacacagccaccacuaguuaacucguauacauugauucuccuguggggcugggcagaugaggaaucuuuuguucucuucccuguuugcagagauuuuuuuugagguuacuuuccgaguucuggcaaguaccccugcuucugguagcuuugugucucgauucaaucucauucuuuuuauuuuauuuuauuuuugagacagggucucacuuugucacccaagcuggagugcagugguguaaucuuggcucacuguagccuccaccucuuggguucaagcgauccuccugccucagccccccaaguagcugggauuacagacgucugccaccacgccaggcuaauuuaugguuuuuuguauguguuuuuuguguuuuuguagagacaguguuuccccauguugcccaggcuggucuccaacuccugagcucaagugaucugcccgccucagccuuucaaagugcuaggauuacaggugugagccaccgugcccggacuuaaucccauucuuuaacuuguuuuguuuuguccucuccaggaggcucccagcccuuucggauugguugagaaaaguggccuggcuggucuggggccagcggcacccacccuccccucaauugcccaacuccccccccccaccgaacugcccaacucccccuccccaacugcccaacucccccacccccacaauccccucccgccacaacugagggaggcggugcugaaaaacagcugacuccagcaaugcugcucacgugaccacugcagcugcagcucccguuccacuccuuguccugggcuaggugggcacuaccaggggcuccuuugguaaggaguaccggguaggcacccgguccugccaauccaccacuggaacagcuggggggacagcagacaggcacggucggacagacuugacagaucaggcaucaggcccucugcgcuggucccgggcucuuuaagcaggaacgugaauggccucaagaugucucacauggucccacuagcccuccuccucccuuuguucccuaccuccaggagggcugcucugcccuuccuuccucuguucuuuggccuuauguuccccgccaccacagaccuucccccgccccaccccucugcagacuuagccgugcauugcaggcauggaggauuaaucagugacaggaagcugcgucucucggagcggugaccagcuguggucaggagagccucagcagggccagccccaggagucuuucccgauucuugcucacugcucacccaccugcugcugccaugaggcaccuuggggccuuccucuuccuucuggggguccugggggcccucacugagauguguggugaguaacucgccucuauccugugccucuuuccuccuggguccuuagugggguggcuagggcauaggaugagggaacuuaccugcccuucuaagcucccauagcaguuugggcuuagcuggaccucagcauuuaacacauccuauugugauugauuauauguuugacuccucaccagacaagaucuccguuaauucagucauucguucacacauucauucagcgcauacugagccuuuucugugucaggcccaguguuagccuuuggggaacgugcaaagcaugagacaagucuaaucccugccauccuagagcuuauguucuagggaagggggacagacaaaagaaaugguuaggugcucccaccugaaaucucagcauuuuggaaggcugaggcgggaggggaggaucgcuugagcucaacaguucaaggucagccugggcaacauagggagaccccaucucuacaaaaaauaaaaaaaauuaaaaaauagcugggcauggggaagacuuucugaagaccaagaggacacaugggagcugaaacucgaaggaagaaaaggagcuggcaggaaaggagugggggacacacauucuaggcagcaggaagugagccuucggagguccugccugcuccagcucugugccccaaggggucucuuggagcacagucuccugggaccugucuaugagucugagcuuagaggcucagggcugcuccuucagacaggaggcagaaggcaggcuuugggaacuuugggccgcccacgcgccuuuucuccuccucugcaccuaggauuacguugagcaauacacuuucacccccauggucucuugagacccuggggaaacccugagaggugggugcagucauguccaggugucaagugaagaagucgaggguuggaggggcugagugacccacucagggugcuccaccuuuuccagagcuuugcugaacuuaguuuuuagaacuugaagccucguuuguuuucguuuuguuuuuuguugagagagguucucccucuguugcccaggcuggagugcaguggcacgaucuuggcucacugcagccucugccuuguggguucaagugauucccccaccucagccucccaaguagcuggagacugcaugugcauacuaccaugcuuggcuaauuuuuguauuuuuuuguagagacaggguuucgccauguugcccaggcuggucucgaacuccugggcucaagugaaacucuugcgucggccucccaaauugcugagauuacaggcgugagccaccgugcccggccagaacuccaagccucucaucuguguuccauaaaugcaaucagacaccucaggucugggcccaggaaccccagcucuugguucauguccggacaguccccaggggaguucuggguucaaccagcaagagcucuuccuccuggcugaucugguccucagccuuggacaguuaguccauuaaccugaccccacaggagccccaaucccuuggggucuggggaaucuugaacugggguuuggggugcaaauaucugcacugagucacuuaauugcacccagccucauuccuuuaucuguaaagugggcuaagaaugcuccccugccuuccuccucgguguaguacaaggaaggaucccaugacaccugcucucccaguuuaaagcucuauauguauguugugaaauugacagggaucgcugcacaaacgcuaaugcaaagugggcuccugugcuuccuuuucucuuucuucuucuuuuuuuuuuuuuuaauuuucuucuagagaugaggucucacuauauugcccaggguugguuucaaacuccuagggucaagcgauccucccaccuuggccucccaaacugcugguauuacaggcgugagccacucugucuggcuccugugcuugugaaugucaacagcaaucagcccuuagcuggcagggcuggguugguagggcgagagcucacccaaggcugcuuuuauuacccugcgugaaucugccuggccccuuccuucuaaggagguugcucugugguugucagucucucccuuuacagcuggauccugaucuuucaguuucuaacccugugcugacucaucgugcuggaagugagagcccggggugaggucagggaacucccuugcgcguuucaagaaaagggaaaaggaaagagaggugaggaggggggcagaugaccagagagacacaggcugagagagacugagacagacccagagagccucacacauugagugacagagacggagaaauggagauaggcaccaaaaaaugguucucagugacagaaagggaaaaaagcaaccccccagucucucuuaacaucuggugagaaaccagccaugugcuuuggucugggcccacacagcaaaggauuauguaggguuucaugcugguggauggucaccuuauagcaacagguaucuggggcugucgggaaaacagacacgagguugugggacccagacccacagagauggagcuguucuaggagcucugguccucguucugguccccugggauauggcacagugaaggccaccaucaggcagcuggagcccagcagcaacugggaggcaguaaacagggaccgaaagugcaagguuaccuccgaggcaaacuacucuaagcuacccugugcugagcucaagucccuuggaacuaucccuaaggcuuccgcuuccagaguguuugaguauuuucguugcacagcuucgaauaaaucccacagcaacagguaaacggcugcaagcugugacuguuuucuaagagcucaucucacaaucucagguccucuucauuuaaacagagauggcaggaaaggcguuauuuugagaucugcauggaggaaguucaccaggcagccucaauucaccagcuggaaguuugcguuguuuggaaauuugauguguaacacguucugcaugugggcugauguuuuuguaaacggguagcacacacauucagcagggcaccaaagagcgggggcuuugcaguuagguccauccuuggcucugcagccuuguguaagacaugacacgacuuugaacuucuguuuccucuucugugcaaagcaaugaugacaguaucuacaucacaggacuggcaugaggaccaagugagauugggcaaggugcccgggcacaccagucucacugucacugcugaugggcagagugguugccuggcaguagcauccucuaucuucagcccaccaccucucuugcuggcucacuccaacugcucuuuagagauacacgcuuccccucuuuucuccucccacugccuuucaguauggcugcauuucccccugcaaguuggugugugcuggguggaggugggggugaggacauguauucucuggagaaggcccugguaacgucaaagcacuucuuugcugguggccuggcccugugaccucauuuguaccauuuucuuuucuaagaaauaccagagauggacagccaucugguagagaaguugggccagcaccucuuaccuuggauggaccggcuuucccuggagcacuugaaccccagcaucuaugugggccuacgccucuccagucugcaggcugggaccaaggaagaccucuaccugcacagccucaagcuugguuaccagcagugccuccuaggguauugccacacucucuuuuuccaugucuugcuccacauacuaagagaugggaaacuuggguacuaguuugggccugucaccacuuugugggcagaccuuaggcaaauuuucuccaucuauagaauggaggaccuuuguccaucuauagaaugaagggguugguuggauuagaucagagaugcuaaugcaaggcuccuuuugcuacuacuguccaucaugugucugaggcagacauaacuaauccgugacuauacucuuugaugaugagcccaggagcagcaucugacucuaugcucccuuagugugccugaggcagauaucacuaaucgaugacugcagucuucuacauugagcuuagaagcagcaucugacucuguaugcuccccucccaugcaugaggcagacaucaguaauccaugaccgcauucuuucauacugagcccagaagcagcaucuuuucuuuucuuuccucucacucuguugcccaggcuagagugcaguggcacaaucuuggcuugccccaaccuccaauucccggguucaagugauucucgugccucagccaccugaauagcugggauuacaggcgugugccaccaugcccagcugauuuuuguauuuuugguagagauaggguuucaccauguuggccaggcuggucuugaacuccugaccucaggugauccgccugucuuggcuucccaaaguguugggauuauaggcaugagccacugcaccaauccaaaagcagcaucuuugugcucccuuuucaagaggcaucacagagaggccuguuuugggguuugaaugagaggcgaagaaucagccauggagugccucuuucucagacucccucuugagaaguggaugcagggguggagagaaaagaagacuaggcauaguggcucauaccuguaaucccaacauuuugggaggcugaggcaggaagauugcuugagcucaggaguuugagaccagccuaggcaacauagugagaccacaucucuuaaaaaaaagaaaaagaaaaaaaaugagccagguguagugacucaugccugugguccccacuucuccggaggcaaaggugggaggaucuuuugaggcugagaaaucgaggcuacagugagccaugguggcaccacugcacuccagccugggagacagagagacccuaucucaguaaaaaaaaaaaauaaaaauauggcugggugugguggcucacgccuguaaucccagcacuuugggaggccaagguagguagaucacaugagguuaggaguucgaaaccagucuggccaacauagugaaacccugucucuacugaaaauacaaaaaauuagccaagggugguggugggcaacuguaaucccagcuacuugggaggccgaggcagaagaaucgcuugaacucgggaggcggagguugcagugagcugagaacaugccacugcacuccagccugggcaacaagagcgaaacucugucucaaagaaaauaaauaaauaaaauaaaaaaauaaaaaaggagggggcauaugggugaaguauggacaaaauaguggggcaggcacagaugaucuggacacaggagcccuuggaguuuauucuugaaucuaacuguucaucuuuauuaaauauuuguggcauacaccucacaacaacauagccaacacaccuccuuuuggagcuuuuaucaaaguuucccacuguuaagauuuuuucccgcuuugugaugcggguggggugggugcuguaagcaggcuuacgggguggcaguuucucacaaaggcauuaacuggccuuguccuaggucugccuucagcgaggaugacggugacugccagggcaagccuuccaugggccagcuggcccucuaccugcucgcucucagagccaacugugaguuugucaggggccacaagggggacaggcuggucucacagcucaaaugguuccuggaggaugagaagagagccauuggugagcagacaccauccgcuggggguggggagcagcugggagggcucaucagaugauauucuccaaugagaaucagaacuuuggguuuucuccccaggcgucuuucccaccauccauucugcccaucucacugccuacguagaggcucgaaccuguccccauagccauccuugacccagcuuuucccgcgcugcacacauacuauugacagguguguuucgugguuuuuuguuuuuuguuuguuuguuuguuuugaguuggagguuugcucuugcugcccaggcuggaguacaauggcgcaaucucagcucaccgcaaucucugccuccuggguucaagcaauucuccugccucagccuccugaguagcugggauuacaggcaugcgccaccacacccagcuaauuuuguauuuuuaguagacgugggguuucuccauguuggucaggcuggucucgaacuccugaccucaggugauccgcuugccuuagccuccgaaagugcugggauuacaggcaugagccacugcguuaggcccacugacaagccuuguauuggcuagccaccaagauugacuugauuauccaccuucgggacaacuggacagccugcuuaugacuuacgccauagucugucucuacuagcucuccugcccugacuugacccagcauacaacagccagagccagccuuuucaauauaaaccugaucuugcuggcacugcuuaaacccugcaggggccucgcacugcuccauggcccagccugucuacccuuaccuucugcccaggcugugcucauccauucucugccucccacacaccugcccucugugggcuccagccauaccaucucucaacucauaagccaguuuuuucauacaggcucccuccaucuggacuggcuucccugcgugcaguucacuccugcucuaccuuuggcucugccuccacccauccucagccgucuccagcauuaccuccuuggagaauccugccuugacuucccagccacccaaauaucacuacuuggucugcauucucguugcaauugcagucgcaugagcaauugcugugguugaggcccgaacugcgcagugccugucugccaugggucuccugcuuccucuaagcacagugccugacacacagugagaccucagcacguaugggcugaggcaaugaaggaaugaaggaucccaugacccaaaagagcguguuggaaagugcaggccagggucccaggugcuggcggggcuggcugcugggugggggcagagaggcaaccccucuguuuuuuucccucucagggcaugaucacaagggccacccccacacuagcuacuaccaguauggccugggcauucuggcccugugucuccaccagaagcggguccaugacagcgugguggacaaacuucuguaugcuguggaaccuuuccaccagggccaccauucugugggugaguaggucagaccgugccaaggccaggcuggcacucccucaguccccaggucugcacugaugaccuccauacccuggcccccacacucaccuuuccuuggggcuccuccgaaucaaguccuuuagggacgaauuggcgagggcucaugggugaugcuucagcugugagccagcuuuggagcugguagguggaucucuugaggccaggaguucaagacaacguggugaaaccccaucucuacuaaaaauaaaaaaguuagccgggcaugguggcacaugccuguagucccagcuacucgggaggcugaggcaggagaaucacuugaaccugggaggcggaggcugcagugaguggagaucgcaccacugcccuccagccugggcaacagagugagugagacucugucucaaaaaauaaaaaauaaaauaaaacuccccuagugauuccaaugugcagcuaaguuuggaaauaggugguauggggucaaguccucuugggccucccuccuccaguccuucucccuaaccucuagcccucaaguugcagagugaucagccaaaccaguuugcccagaaaugagcaguuuccugggacacaggauuuucagaguccagacaaggaaagucuugggcagaccagguugaguuggugcccuuagcugaucugaccauguugcccuucuucuccaagcccuccugugguuguccauagcuacaagggccugacccucaagccccugccuguccuggccccuuuggcucuccagcucauugcauguucugucccccacuucaagacacagcagccauggcaggcuuggcauucaccugucugaagcgcucaaacuucaacccuggucggagacaacggaucaccauggccaucagaacagugcgagaggagaucuugaaggcccagacccccgagggccacuuugggaaugucuacagcaccccauuggcauuacaggugggaaagagacccuggagccauggccacccuggggaacagucagggguggaguggucaggugcuggaacaccuagccccucccugccggcugacuuccucucucucuuccucacucuaucaccaguuccucaugacuucccccaugcguggggcagaacugggaacagcaugucucaaggcgaggguugcuuugcuggccagucugcaggauggagccuuccagaaugcucucaugauuucccagcugcugcccguucugaaccacaagaccuacauugaucugaucuucccagacugucuggcaccacgagguagcccaacuuuuuguggaagcacagcccuuuacaaucugcugcgcacccauugacgucccagugaggggagguugcuucauccugauuugcugagucagcacaagauugugggugugcaugggacacagcagccaaaauguggucauagcuucuagaagcucacaguguggggaggaagacaguaaauggagaucccugggcauaucgcuugugugauacccaguacagaaauguuuggauggauggauggauggauggauggauggauggauggauggauggaugaggagagacacauuuugguuaacucuaauacaacaugauaagccccaguagcagcaugauccaggcuuucucugagagagggucugaggacgugacugggauuugccaauuaagaauggagaaagaggccaggugcagugacucaugccuguaaucccaacacuuugggaggccgaggcggguggcucaccugaggucaggaguucgagaccagccuggcuaacauggcgaaacuccaucuauuaaaaauacaaaaaaguagcugggugugguggcgagugccuguaaccccagcuaagcuacucaggaggcugaggcaagagaaucacuugaaccucagagguggagguugcagugagccaagaucaugccacugcacuccagucugggugacagaguaagacuaugucucaaaaaaaaaaaaaaaaaauggagaagaaggaagcuggacaugguggcucgugcuuauaauccuagcacucugggaagcugaggcagauggauugccugagcccaggaguuugagaccagccugggcaacauggugaaacccugucuuuacuaaaauacgaaagauuagccaggcauggugguagacaccuauaaucccagcuacuagggaggcugagccacaagaaucacuugaaccugggagacagagguugcagugagccgagaucgcgccauugcacuucagccugggcgacagugugagacucugucuccagaaaaaacaagaauggauagaguggagccaagaagaggcaggaagaacaaagacacagaggugcacagaguuugggggaauuuugaggaauggucuugcaaaagagugggaucugggagaaugagugggaguggaaagcagaugaaugaagagaaggugagcgcaucaggguaacagagaugcguugugaacaaaugcauguucuaggaagagcccucuggagugcuaggugccagagaggugggaggaaggauacuggaagcagagaaaccagugaggggccugaucuugggugguggggaaugagggacaggggaggccgggauggaagccaggugguggggaaugagggacaggggaggccgggauggaagccagguuucagcugagcagguggcgguggcauugauggagaugaggacauggggaaggacaaaguccagguguccuugagggaagacaagaagacaaauaauccaggcucucuguccucacaccagcugcccgccccuuucuuccuggcacagucauguuggaaccagcugcugagaccauuccucagacccaagagaucaucagugucacgcugcaggugcuuagucucuugccgccguacagacaguccaucucuguucuggccggguccaccguggaagauguccugaagaaggcccaugaguuaggaggauucacgugagacucccaccucccaguccucaccccacccaaccucacaugccugauaacagggucacagaagagacggggaacagaggagaggguucccucgggagagacacuggcccugcuucugcuucuaccugcucagcuccuuucuugcccacgguguuauggaaacagggagccauaggccagcauugucacugagagagcaggcuuuggaggcagagccccccaguuggaaucccaacucuaaccagcuagguuccagguaggcacccacaauucaccgaggagaacaguugugccccuucccugcagggccagugugaagaguccaggaguuaguacacauagagauaguggcaugugcuuuuuauaugugcaagguccagcacauagcaagcgcucaacacagcguugcuuucaucagaguaagaacuguuuuuuguuuguuuguuuguuuguuuuuaagagacagggucucaaucuuaucacccaggcuggaguguaauugugcaaucacgucucacugcagucucgaacucuggggaugaagcaacccuacuguccugccucagccucccaaauagcugagacuauaggcacgugccacacaacccuggguaauuuuuuuuuuuuuuuuuuuugagauagggucucugucuguugcccaggcuggucucaaauuccuggccucaaaccauccucacaccugaggcgcucaaaauauugggauuauaggugcgagccaucaugcucagccagaauaauaacugguuuuuuuuguuuuuuuuuuugagacagagucucacucuauuacccaggcucuggaggcccaacucguguuuguguauuuguuuauuuuuauuuauuuauuuauuucgagacagagccucucucuuucaccuaggcuggagugcaguggcgcaaucucggcucacugcaaccuccgucuccuggguucaagugauuguccugccucagccuccugaguagcuggcgcuacaggcgcgugccaccaugcccagcuaauuuuuguauuuuuaguagagacaggguuuuacuauguuggccagcugguuucuaacuccugaacucgggugaucugccugccucggccucccaaagugcugggauuacaggcaugggccuccgugcccggccauguauuuauuuaggcaaggucucucucuguuauccaggcugaagugcaguggcacauucauagcucacugcagccucaaauuauccaaguaacagggacuacaggcaugcaccaccacacccaucuacuuuuuuuugagauggagucucccucugucgcccagacuggguugcaguggcacaauuucagcucauggcagcaucuaccucccagguucaagcgauucuccuuccucagucucccgaguagcugggacuaugggcaugcaccaccauaccuggcuaauguuuauauuuugaguagagauggaauuuugccauuuuggccaggcuggucuugagcucuugaccucaagugauaugucugccucagccucccaaagugccgggauuacaggcaugagccacuaugccuggcccagaauaagaacuuuuauuuuauuugagacagggucuuacucugucaccuaggcuagagugcaguggcacaaucacagcucacuguagccucaaucuuccgggcucugauccucccaccuuagccucccagguagcugggaacaacaggcaugcgccaccacgcuuggcaaauauuuuuuuaaaauuuuuuguagacaugggauugcuucauguugcccagacuggucucaaacuccuggacucaagcgaucuacccaccuuggccucccaaagugcugagauaacaggcgugagccgccguggcuggccagaauaagaacuuuuauuaugaaauaaguuuggcccuauccuguuauuaauuaccucaaagagguuggacaauguccuuacacuugcuucucacccugagcuuagaauaguuugagaaugagcaugucuggacuguuguuugacagguccuguccaugaugaaauaagaugaauguaauucucauguuaucaguggggaguccagcccagagaaguugaaugccuuccaccaggucacgcacaccacagacuucuccccuagaaucaugggccuaucucuguccccagugggaguuccuggaaaacagcauccugcauccagggagggcccacaguugguuccuucggguccucuaggcuagagaaucucagaccggagaaaugcaaagacuccucugaaguacaaacauucucccagaccccagguuaaguuauuucuucuauaauaucacuuagauguguacugauaauuuuauuaaauauaaagucuuuggccagagcugguggcucacuccuguaauuccagugauuugggaggcugaggcaggaggaucacuugagccuaggaguuugagaccagccugggcaacauagugagacugccaucucuucaaaaaaauuuuuuuaauuagcugggcaugauggugugcaccuauaauccuagcuacccagaaggcugaggugggaggacugcuugagcccaggaguucaaggcggcagcaagcuaugaugacgucacuguccuguagccuggaugacaaaacuuuuuuuuuuuuuuuaaaagacaaagggcugagugugauggcuaacaccuguaaucccagcacuuugggaggccaaggugggcagauuacuugaggccaggaguucaaaaccagccgggccaacguggcgaaagcccgucucuaccacacacaaaaaaaguccuuucucuuucuagcucuagacagcuauaaauccccaacaacuuuauaaauuaaauagaaaaguauaaaaaccaauaccauucaaauaaggaugcucugcggaggugcuggccugcacuuuagcaccucccuguauucaagcugcagugaagccugggcacuccuggccuggcucagccacuucauucacuaugagggccaccuccguuuccuuccuguggccuauggcacauaacgcaaugcugcugggcaccagcgcagucacugauggccacgcauaggcugagugcccuugggagggcucagacccacagacugagauuacccagaaccagcugguauucauguuugaauauugucaucaaaaugaaagacaauuagaauuuaacguuuuuauucagagcucggggaucucugggaagacacuguggacuccagucugagaaaugguucucuuguuagugugcauggaugccucaacuggguucaggcaugaagacuauguuugaggccccugaaugcacagcagagaaagcucaacugcagacacagauagacagauguggagagagguagcccugugcagccacauggcccugcagaguuaaggaaugggaaaagggcuacucugugacauuccuuagaacaguaguuucccuucgcuaaagucaccccaaauaggguggugguuguuguuguuguuuugagacggaguugcauucagucgcccaggcuggagugcaguggcacgaucucggcucacugcaaccuccaccuccuggguucaagcgauucuccugccucagccuccugagcagcugggauuacaggggcccaccaucacaccuggcuaguuuuuguauuuuuaguagaaauaggguuucaccaugugagccaggcuggugucaaacucccaaccucaggugauccacccaccuccgccuccucaagugcugggauuacagaugugacccaccgcgccccaccuguguuucuuaaaaccaaaaaaaucccucuaagacugcaaccaucgauaacuuagggcuguauuaccccagagagcacuuuguagaagaugcguuuguucacaucacuucccuguuacuuugacggucucaccuccuuuucagucauuugcauucucccagaaccugcucauuuguuguuuuuuguuuguuugcuugguuuuguuuuugagaagcagucuugcucuguuacccaggcuggagugcaguggugcgaccucaggucacugcaaccuccgccuacuagguucaagugauucuccugccucagucuccugaauagcugggauuacaggugugcaccaccaugcccagccuaauuuuuguauuauuaguagagaugggguuucaccauguuguccaggcuggucaugaacuccugaccucaagugauccacccgcuuuggccucccaaagugcugggauuacaagcaugagccacagugccuggccugacccugcucuuuugaaagaccauucccccaaauucugugcaccugugugccuuucuucucucugccuccucucagcucugccccgcucuccucccuucuccucuggcaaaucccacucaucucuugaagcccuucuuccaggggaagcccugaucaugcugcuuucuccugugggagggaugaaggacguggcccacggaguuuguuuuguuuuguuuugagauggaguuuugcucauguugcccaggcugggguacaaugguacgaucucagcucacugcaaccucuacgucccggguucaagcgguucuccugccuuagccuccccaguagcugggauuacuggcaugaaccaccacaccuggcuaauuuuguguuuuuaguagagaugggguuucuucauguuggucaggcuggucucgaacucccaaccucaggugaucugccugccuuggccucccaaaguacugggauuacaggguugagccacugugccuggcccaggcccacggaguuuuaagaggcuuccuguggcaguggcauccagacggagugcagaaacucaaaguugaaggccagaagcucagggaagggggagugugaguugaggagucucuuggcugccagggccagaaaccgaacuccaagccucuccacaacagcggguguagagcauguagaaucagagaggaggcugagccaugcagccccgagaagaggggaaugccacugagccacagagacccagugccacugccaggugucucugccuccacuucccaugacccugccugucucuguaugcaggcuucacccucucucguuguacauuguacacauucuaggugacaccagcagcuucugauucucaucccccauaacaucagccccccagagaggggacaacugcugagcugauaacauaauagaugccccuuuccuggaggccauggucauggucagcguggagaggaugaagccugagcaggcaggaucgggggucuggaggggaaggagguggaaguugagaucacagaccuguggccagguggccugggaaggguuugacgagugucggcccaaagagcuuggaagggauuuugcugcugugggugagcacugccucuccccuuagggacaacagccaccucuucucuccccauuugccuuucccuucuguagauaugaaacacaggccuccuugucaggccccuacuuaaccuccgugauggggaaagcggccggagaaagggaguucuggcagcuucuccgagaccccaacaccccacuguugcaaggugagucauggccugacacucuggauguguccccuaccccaagcuuacucagccaagaggcuucaucaacucaccccagcuuucccuagcacccuccugggccacaccuucacaaaaucacugaugcucaaaguuggauauaauauauugaacugaagccuuagaauuuuuaugcaaguuacuguggaaauucuaggaaaccagacagauuacaaaaaaaaaaaaaaacuagaagaaaauuaacaucaccuaggauauacuaccuaggaauaacgucuuuuauuuugagauggaguuucgcucuuguugcccaggcuggagugcagcgguaugaucucggcucgcugcaaccuccgccuccuggguucaugugauucuuccaccucagccuuccuagagcccaaguggucugccugccucugccucccaaaguucugggauuacaggcaugagccaccgcacccagccaaaauuacuuaacuuuucuucuagauacuuuuuaaaaauauggcaguaaguuuuucauaaaaaauggagccaugcuauccaguggaaauuuaauguugcccacauguauaacuuaaaaauuucauauauguguauacauauauaugaaauauauauauauacagacacacauauauauguauacauauauauacacacauauauauguauauauauauacacacauauauauguauacauauauacacacauacacauauauacacacacauacacacacauauacacacacauacauacacauacauacacacauauauacacacauauauacacacauauauauguauacauauauauacacacauauauauguauacauauauacacacacacauauguauacauauauacacacacauauauauguauacauauauacacacauauauauguauacauauauacacacauauauauguauacauauauacacacacacacacacacauauauauauauauauauauuuuuuuuuuuugagauggagucuugcucuguugcccaggccggaguacaauggcgaggucucagcucacugcagccucugccuucugagcucaagcaauucuccugccucagccucccaaguagcugggauuacaggugugugccaccaugcccaguuauuuuuguauuuuuaguagagacgggguuucaccauguuggccaggcuggucucaaacuccugaccucaagugaucugccugccucagccucccaaagugcugggauuacaggcgugagccaccacgccuggccugcaaacagacccuuaaaagucaucuguuccuacucuuguuauuuaaguugcuuugauacuccaccccugaagaacuuuuauggggcacuuaccaugugucaagcauuguggcgagugcuuauagagaaggugggacuuucugagggagcccacaaaaaagcauucuuuucuugcccucauucugaauaaauugaggaauaaaaaauaggagcuacagauggagaccccaagucuggccaguucuauuacugauaaagacaggagggugagagcuagguggacccagccaggaagcagaccugggcaguuguagccucuaucuccuucccccucugcccuugagucuagaaggaagcccgcucccaggagaaaaauagcgcccaggcuacacaugccuaguuuauucuucccaaaucaaccaguugcauaaaucacuccucuaucuuccuugggguggaaaguggaugggaguuauaauuugaguucucuuuugucuuaguccauugaagcugcuauuacaaaauaccauaaacuggguggcuuauaaacagcagaaaugaggccgggugcgguggcucaugccuauaauuccagcacuuugggaggccaaggcagguggaucaccugagaucaguaguucaagacuagccugaccaacauggugaaacccugucucuacuaaaaauacaaaaaauuagcugggggugguggcgggcaccuguaaucccagcuacucaggaggcugaggcaggagaaucgcuugaacccaggaggcggagguugccgugagcugagaucacgccauugcauuucagccugggcaacaagagugaaacuccaucucaaaaugaaauaaaauaacagaaauguauuucuuaacaguucuggagguugggugggcagucccagaucaggacacugacagauucagugucugaugggggcccacuuucugguguuaccugcuggcuguguucucacaugguggaaggaacauggcaacuuucuggggccuuguuuuuuaauuuaaaaaaaaaaaauauuuuccuggcccuugccugcugaaggaaccucuuuuauaaugguacuuaaaaauuuuuuuuuuugagaugggggucucacucugucacccacgcugagugcaguaucacaaucucagcucacugcaaccucugccucccuggcuuaagcgauccucccaccucagccuccugaguacgugugaccauaggcccauggcacaaagcccagcuaauuuuuuguauuuuuaguagaaaugugguuucaccauguugcauaggcuggucucgaacuucugaacucaagugaucugccugccuuggccucccaaagugcugggauucuagguaugagccacccugcucggccuauaauggcacuuuccuaucccauugaugaggcucuacucucaugaccuaaucaucucccaaaggcccuaaggccuccugauaccaucaccuuugggguuagguuuuaacauauacauuuuggggggacacagacauuuuagaccauagcaccuccauugaaaggaaacauuucugacaccuggcuaucucaaagggcccuuucaguuccccugcaggcugcauucccacaucaccaacaagagcagcgacacucacucagagguuaaauaacuuguccagagucacagcaguaaugaaugacagagcuggggcuugaauccaggcguccuccuagagccuggauucuguguagugagugaaagcugacuccugggagacuucugcgugguccugguucucucuccagacugcacugcgcaaguuucucuuccugauggucccuaggguauuacaaagacaguggcccugccugucagguguuuuuauuaccagaugaggucauggccucaggaacccugugggaagcugaguucagagucuuugagcaggcuuuagggagguuccagcuucccaccaccaagccccagguggauucuuacagacucuagccucaggguggggggucuggaagaugagguugcggggugcgauauucugcccaauucgccccuccuugcucaaucuguuucugcagguauugcugacuacagacccaaggauggagaaaccauugagcugaggcugguuagcugguagccccugagcucccucaucccagcagccucgcacacucccuaggcuucuacccucccuccugaugucccuggaacaggaacucgccugacccugcugccaccuccugugcacuuugagcaaugcccccugggaucaccccagccacaagcccuucgagggcccuauaccauggcccaccuuggagcagagagccaagcaucuucccugggaagucuuucuggccaagucuggccagccuggcccugcaggucucccaugaaggccaccccauggucugaugggcaugaagcaucucagacuccuuggcaaaaaacggaguccgcaggccgcagguguugugaagaccacucguucugugguugggguccugcaagaaggccuccucagcccgggggcuauggcccugaccccagcucuccacucugcuguuagaguggcagcuccgagcugguuguggcacaguagcuggggagaccucagcagggcugcucagugccugccucugacaaaauuaaagcauugauggccuguggaccugcuacaguggccuggugccucauacuccucaggugcaggggcagggacaagaga

SEQ ID NO: 16481 - RNA, 3471 nt, Homo sapiens
ggucacaagcuuugcaguguagcaucccccaacuugauccccugucucuuuggcuccaaaaccuacacucaguccugggagcgauuagcgccaacagcucagagaaaacgugacgaaaaccagucuguaaaacccgagccugggagaggggcuucggugcgcggggggaauuugcagacgcucccugcuggcggagauuuccugaccuguccuucggcgcgggacuuucggcgggucccggccgggcagacccaagugccggcggcggagacugcaguggagccaguaccggcuguaguggccggggccguggcgggagagucaugucagagccgcagccgcggggcgcagagcgcgaucucuaccgggacacgugggugcgauaccugggugagcgcggggcgacgggcgcggcgaccccaccaccacugggcuggagaagcaggggucgccggacgcccgcccggggccuggaggaggcgggaugaucuuaguucucauucugcuuuugggccggagacugggcucagacagggcuagggacuugcccaaggucacacuacccuggugggucgcccagggcggaagcucccauggggugagcgggcugcccgcucuggcaugcgcucuggcuggcuguggagucgggaucuccacucccauuucgguccugacacgcacuggcucugucugaaccucaguuuccuccucggcaaaaaaacaaaaacaaaacaaaaaacaaacgagauacacacgagggccucucucauuggguggugguugcgaggguggaaugggauaaagcgcagaaagcccuggcacuuggcgagcgucuggucaguggcgcugcccucgaucacucugccccucugggugccugucaccucauuagugcaguuacuccugggaccaagaccaggaaaucuaaccaauaagcaaugguaacagugacucagugcucaguccgcccucaguggcccgaguccgaggugggcaucauggcaccaguuuacaucucggaaagggaggcucagagaggucaagucacuugccuaaggucacccagggacugcuuagcuggcuaggaugagaaccagccugcuccaacgcccccucguggaacaguugcgagccuaggaauuaaauguucccucccccaggcuaugccaaugaggugggcgaggcuuuccgcucucuugugccagcggcggugguguggcugagcuauggcguggccagcuccuacgugcuggcggaugccauugacaaaggcaagaaggcuggagaggugaguguuagccuauuuuccaacccccaacccuagcucucuucuugugugguucaguccacagccuugcaugugauaaagucccuguggacacuccagucccuacaaccuugccuagugcaguccauagacaguccuguuuguaggacaguguaccccugcccccacacucccacuccccgaacuggauguggcagacuguaccccacuccugggugcggacaaguccacuggccacuugccccucccggucuagccucgugccccuugucgcaggauuuucugccucugccccagcuggauuaagugucucugcgcccaccaggugcccagcccugaagcaggccgcagcgccagggugacuguggcugugguggacaccuuuguauggcaggcucuagccucuguggccauuccgggcuucaccaucaaccgcgugugugcugccucucucuauguccugggcacugccacccgcuggccccuggcuguccgcaaguggaccaccaccgcgcuugggcuguugaccauccccaucauuauccaccccauugacagguggguaccuucuuggccucagggaucauccacucuccagugaugagaguggaucauccagucuccagguagagcuagacucugugaagugugggguaugcccacuuugcuggagcaauagcagggacaaggcuggcacuuggcuccuggguuagaaaggacagccuguacccuugucauaugguauggcaggcacuuuagcaauaaaagaagaggggugcguugaggguaugggacacaggacaaguaaauucccagaaagaaagucuaguguuacaaaacaaccagagagaagcaggagcaggugcacccuagaggggaugcauuuugggagguauuggugacagaagccuaacucaaacugaauauuugaauaaaauggaguaaaaguccagggcuguguugcauucaggcauggcuagaucuagguacccaaauuaugucauuaggggucugggucuccccauccugcugccuuucuccccaccccacccuauuucuugcuggcuucaccugcuuucuccuugugggaguagaaauggcccuagcagcucccaaguucuaucccaccagcuuagccucccccagcagaagcuuuuaaacaguaacaacaaaaaucccaaggaagggugucauugguccauucuggacugcaugcccacccuaugagccaguuucccuuugcugauuggccaggcuugggucacgugcuuggucuuagaacuagauaugggcucaacccaaccagaccaauguaagagugagaggagcagucuuucuccaggagaagauagcugacccugaggcccugagcaagucuuuuacccaguaccucaguuuccuccugaauaaagaagaggauggcuucuauucugggaguuugauucuagcuuccccagguagcccaagguggaaggaucaggauaagggugggucucuggcuggauggcauuuguauccugcaucuaagcgccccuuucccuaacccuggccuucugccuucuguucccucaugaacacccuuggucaccugcucaccacccuuccacucccuacaggucgguggauuuccuccuggacuccagccugcgcaagcucuacccaacaguggggaagcccagcuccuccugaucauacucugguaccuggccugugcaucggccuccugcuucaugucaaccuccuacuccugccagggaauguggacaccuggcucccugguguccaaagacccuggcaccuggguggguuugagcuggacagaagcuuagagacaaaggcuucaagaagcaguggcugcagggagucacagaagggcaggaccugaacgcugucugcuucccuggaauccaagaugcugaguggaaguggacccugggugggcccggcccugucuuuuucaggaaaauuacauccucccauggaggaugagagacugaggcucagggagggcaaggaauaggcccaagaucacuuggcaagcugggcacccaggacccccaggugcuugacagagucaccccauggugguauggcugaacaaggagcggcagacaacucagggagaaacucaggagugcaguaccagggacaccucaggacagauucucuggccaggcccuucc

SEQ ID NO: 16482 - RNA, 9512 nt, Homo sapiens
cggccccgccccucccggcgccccgccccguccggcagcggccucgcucccuccgaucccccccgcgcccgggaccccuggccccacuguugggccagcucgccggguccggccaugggccccgccgcucgccccgcgcugagaucgccgccgccgccuccgccgccgccuccgucuccgcugcugcugcugcugccccugcugccgcuguggcugggccuggcggggcccggggccgcggcggacggcagcgagccggcggccggggcggggcggggcggagcccgcgccgugcggguggacgugagacugccgcgccaggacgcucugguccuggagggcgucaggaucggcuccgaagccgacccggcgccccugcugggcggucgucugcugcuggugagcgcugcugagccaucuggccgcaucacuaaaccccucucucaacccucccuagagaccccgcacccugaaccgacguucauccuccaccaagccuugagaguccagcgccccuccccaggcuccccaggcccccagcauuccggcuucccaaaccagagagccagaugcucugggaacucuggccuuggcauccacugugaugaccccggcucccucccccaccacacccuaccucccucugcucauggccccuugccacacagauggacaucguggaugccgagcaggaggcaccaguggaaggcuggauugcaguggcauacgugggcaaggagcaggcggcccaguuccaccaggagaauaagggcaguggcccgcaggccuaucccaaggcccugguccagcaggugcaggggaugucuaugggggagggggcuggaggaaaggauuccaaggcaucugcuagagccaggcccuccuuagaugggcccuuaagagcuugcagagaagcccuaggccuggugggucagggcaccccaguuugaagaauggagucaguauggcuucgaagcagggaggugagaggaggccagagagagguugagaagcuugaccaggcucugagaguaugggaugggggagcugcugcugacgaccacugcugggacugcccugauaggaccggggaaggcacagcgcaucuggaagggaggcaggaggaagaaagcaguuuccaccuuugaccucaaggagcuuauggcagucuguccagaguuuugcucacugcagggccaggagcuaagagcagcuagggcugcagguggugagacaggugugcaggcaggguauaugcuagccucucgccuucuaucccucugcagaugcggcgggcccucuuccugggugccucugcccugcuucuucucauccugaaccacaacgugguccgagagguaaaucggaccaggccgugaggguaagcaagcuggggaaagggggacccaggccugcugaccuccuugucucccugcagcuggacauaucccagcuucugcucaggccagugaucguccuccauuauuccuccaaugucaccaagcuguuggaugcauugcugcagugaguugguauuuagacuucaaaggacugacccuggguacagagagccccugguucucccauggacugagggggcuugggaccagggccuuaccuguuagccuuuuuuuuuuuuuuugagauggaguaucacucguguugcccaggcuggagugcaguggcgcaaucucggcucacuggaaccucugccuuccagguucaagugauucuccugccucagucucccaaguagcuaggaucacagucaugugccaccacacccagcuaauuuuuuguauuuuuaguagagacaggguuucaccauguuggccaggcuggucuugaacaccugaccucaguuccaccugccucggccucccaaagugcugggauuacaggcaggagcccccguugccacugcugcugcugcugccccugcugccacuguggcugggccuggcagggcccggccuaacuguuaacuuuuuuuuuuuuuuuuuuuugagauggaguuucgcucugucacccaggcuggagugcaguggcgcgaucucggcucucugcaagcucugccucccggguucaugccauucucccaccucagccucccaaguagcugggacuacaggugcccaccaccaugcccggcuaauuuuuuuguauuuuuaguagagacgggguuucaccauguuagccaggauggucucgaucugcugaccuugugaucuacucgucucggccucccaaagugcugggauuacaggugugagccaccguacccagccaacuguuagcuuuaagacugcccucucggcugggaaugguggcucaugccuguaaucccagcacuuugguaagccaaagaaggaguaucacuugaguccaggaguuugagaccagccugggcaacauggcaagacucagucucuacaaaaaaauacaaaaauuagcugggcaugguggcacaugccuguagucccagcuaaucaggaggcugaagugggaagaucacuugagccccggggguagaggcugcagugagcugugacugugccacugcacuccagucugggugacaaagggagacccugucucaaaaaaaaaaaaaagaaagacuguccugucccaggcugaaaaaugggugaggggaugggaaggaggugccagagccuggagcuuggagcaaggaaguggcucugugggcagagaggacuggccccagcaaggaggaagauggacuugcaggcuucccuggccuggcuggugugaaaauuggaaaaaccaauagagggaaaaggccuggggcaaaguguaaggccagcaggggcgacagucguagguauccuuuuccugcagagcuggggugggugggucugggccucccuucccaagaguccuuccaucuggccccggugacuuccccucccaggaggacccaggccacggcugagaucaccagcggagagucccugucugccaauaucgaguggaaguugaccuuguggaccaccuguggccucuccaaggauggcuauggaggauggcaggacuuggucugccuuggaggcagucgugcccaggagcaggugggugcuagcagauuacauggggccuagggaaaggaggcucguggggccauauacauggcuuuguauugaaaauccuguggcuucuccccaccuuagugacaaggacggccuuucccaccccacaggagugcugugaguguucagagacaugguguaggugggcgcucaguuggggcgccugggccaggucacauguagucaguguuagcugccguccucauguucugcaggcauugggaagccuuauuccacugccuguaaaauucagaccccucugcguggcuuucccagcucucugcaucacucacucacucuauuuuucuaguccuuuuuccuaugcucuggccacccuguaccaaugacugcauaugcccaggccuucugccacugggccuugucuacaccuggcuguagacguggacaccuuuucuguguccacacguccuagucuagcuagaaccuucacaacucauccugccacguuucuuuggaaagccucccucccaccccagcuugaaguccccucccucucucucucuuuuguaucacaacaaggcguggucaggccguccaugggcuucuugggacagcccauccugcaugugaugaggcgcgucacuuugucuccugacagccaggacuguguuuuaucgucucuggauuuccagcgcuuggcaucagggcauucaaggguauucuguccacaagcauuucuugagucccuacucugcugggcagucacgucccggucuccugguguacagccuccagcagguguuggccaccgugggcugugcagggcagcuucaaguggggcaaucuugggaucaaauccuggcuuggaaaccuuagcuggcuggucucagcugggaguuucaccucucuggccucauguuccucauuugcaaacagggacgguacucuguguaucccugucauggguggcccacacaggccucuggacagggcaggcauuggugagaggcuugggguggggcugagcgcagucugcaggugggucuggcugcucaagagggcagaccugagcagccuuggccaggcugcaggcuggggucaagguggucccaacccaaguauuggguggccauggccacuaaagugucugaaggguggcuggaggaggcaucucaguggcuggccugaugggcaucgggcucucaguccugaccccagggcccagucacugugccuccagccucugggaguccagagcagcaacacucauguaucaggaaggucugaugaacagcaguggcacgaucuuggcucacugcagccucgaccuccugggcucaagugacccugccaccucagucccccaaguagcugggacuacaggcacgugccaccaugucuagcuaauuuuuguauuuuuuguagagaugggguuucacuauguugcccaggcuggucucgaacuccugagcuuaggcauucggcccaccucggccucccaaagugcugggauuacaggcgugaugaaccaccaugcccagcuaaugaacaguccuuacugcucugauggcaagcucccauccugcccuccauccucaccuggggcucugcaagguguguuccccaagaugcacugaaccuggggcacauagggcuccccaggaugcagugagccuggggaggcugggucuuuggccugcagcggagcuucaggccggccacacuuucagcccacccagcuggcugcucugaggcauggagcucuacagcaggcucugcccuggagagcuuaugccauaauggccacuuaguccuggcauggggcucaggggagugucacuuugucuccugacagccagggcuguguuuuaucaucucuggauuuccaauacccaacacuuggcaucaagggcauucaaggguauucuguccacaagcuuuuuuuuuuuuuuuuugagacagaguuucgcucuuguugcccaggcuggagugcaauggcgcaaucucggcucaccacagccuccgccucccagguucaagcgauucuccuaccucagccucccuaguaagcgggacuacaggcaugcaccaccacacacaggcuaauuuuuuguauuuuuaguugagacgggguuucuccauguuggucaggcuagucucgaacucccaaccucaggugauccgcccaccucggccucccaaagugcugggauuauaggcaugaaccaccgcggcuggcccccaagcauuucuugaguuacuucucugccaggcagugaugccccggucuccugguguacagcccccagcacguguuggccaacgugggcugcuccagcccugggcucaugggggcccagucuggagagcagauaggccagagacaugcugucacucugcugggguaagcacagagcuggugguggccccggcacccucuagggcaugauaaaggcacucagccuggagcuuggggacagcuuccuagaacagguggcacugcccagcugcagcuggaggagagaagagagcaggauggagaggggagcuggggcucacagacacuucccagugagggcccccagagcaccuccacugugagcagagcaauggcuuguggcacuagcagcaccaggcuugucuagagcgguggccucuucauaucagaucauuucucagccccucuuccccacaugacgguagaugagcuucagcaucggucggggaagaacacgauggcagagcaguacucagcugcagagagcuuugaagugaaugcacguguuaguccuaacacauccacagacccugugcagaggcgcaccuggagggagcgugcuguguuuugcuuacuccgcugcgccaucuccugagccagcuguugaguagucagagcgcagcagccacaccgcaucuggggcaaguugagucaagaucauugugguucccucagucacucugaggcugcccaggggcccggggcccccaggcuuuaaaguguucucucagucauguuuccuuuccaaauucacucauuccacaaagauggugggagguacuggguuagaguggugaccacaucagcuaugguuaccucccaccgaugggagcgcacagacccccaagggcagcugcaagggaacgcuggguagagcgggugugaggagggcggggcagcgggagguuaggggggcgcauucacccagccauaagaggucagggagcuucuagagcaagaugugguggaggcaguagccgaggaaagggauaagguggaagaggguucccaagacagggaacaguguggaaaggcacagacacugagaggaggcaaguggcacugcagggaaggagcucaggcaggggagcugcagggccuggugugcaggggagaacccucugaccgugggugggaaguggguggcaaggagggcaugagacccacccccacccaggagaacgaagcaacaggccuugggggcuggcucccucccguacaggggggugcgaacauucaggcuggaugggugaguggcugauggcagggccugagaaagccgaccaggaggaagugcaggaggaugggggugggagagugagcaggucccaggcugggugcuggguugcugggugcuggguuggggagucucugaggcuaccagauagaagcuucuguguaugcaaaacaucagguuuguugcccagagagcccugggcugggaauggauguggcucuccuuggagcuggaugggaagacguguagggcagagugagugauccugagaagcacacaauggaagagacggagccuucagaagaggaagcuggggacugcagggacacagaggccgucagcauaccucaccugccugcucccuggcguuccuggggguagauguuccuaagggaggcguguggggguggccccaugucccugaugacugcuucccuccccagaaaccccugcagcagcuguggaacgccauccugcugguggccaugcuccugugcacaggccucgugguccaggcccagcggcaggcgucgcggcagagccagcgggagcucggaggccaggugggagccagccccagggagccccagcacccucagcccuuggaccugcaagacugugcccguccucuccccacagguggaccuguuuaagcgccgcguggugcggagacuggcaucccucaagacacggcgcugccggcugagcagggcagcgcagggccucccagauccgggugcugagaccugugcggugugccuggacuacuucugcaacaaacaggcuagugccccggguagagaccagccaucagcucaccugugaugccucccaccuuacuccugggaccuuggaaccaccaccaccaggcccuucuccuucagcccccagggccacagagcagaauuucaggggggugggggaagccgugagguuucaguuccccagcugaggcgaggggcaugggaccaggcacccccacguggaguccugcuucggugaccugagcccuuccucccccaccccuguaguggcuccgggugcugcccuguaagcacgaguuucaccgagacuguguggaccccuggcugaugcuccagcagaccugcccacugugcaaauucaacguccugggugagcaccagggguggggucccucggccuacucugccugcuccucaccugaugccucucucccuguucuucuuccccuccccugcagggaaccgcuacuccgaugauuagcugcccagcuggacucugcacauggggauggacccuuccugccugcaccccgguccucagccugggcucccaggacaggacaggaugggacagcaggauagacaggacagcaagcccagugggugggaggaaggaugagggccccaccauguccacacugggaaggagggccccacagcuucagacugaggaucuagggcugggaccugucagucaaggaagagaggucacuuugggaccuucucugcaauccugugacgugagucugcccuccuuacaggcagcucccaggucaauaaggaaagagaauauggggccaguguagcugucgccaggguucugggagcucccuguggccugucugggaauuccugggggcugagacuacaguggccagguuuugugcuuauuuauugggggguggguugagggaagagcuaucuggccuugggguacccuggccugaccgucuuucaggauacuucuugucaaggcugucugccuguugccuuugguccucaagcacugggagccaugggucccacugccuguccagccuggcucccuuccugggccuggcuaggaccagaggucuuagaaaccguccuguucuggaauccuuggcugcggcuuuguguugcugaccgggauacucgaagccacaggaucaauguggugccucauccaggggcauccuuuuuuuuuuuuuuuuuuuuuuuuaaagaguuggaguagggaagguuuaauaguaaaauaaacguggcuauauuuuaacauaagauguaaaauguguauagguguuuuaagauuuuaaaaaguuaccuuagguucuacugccugugguagauggaauucuaagauggcccccaaggucucccacuaccaccugccgugaacaugccuugcauuaauauaauuucuggaacugggacucagagggauuuuauuuauuuauuuuauuuuuauuucuugagauggaguuucacucuuguugcccaggcuggagugcaauggcgugaucucgccucacugcaaccuccgccucccggguucaagcaauucuccugucucagccucccaaguagcugggauuacagacaugcgccaccacgcccggcuaauuuuguauuuuuaguagagacgggguuucuccauguuggucaggcuggucucgaacucccgaucucaggugauccgccugccucggccucccaaagugcugggauuacagacgugagccacugcgccuggcuucucaaagggauuuuaugcccaugguuggguucugucuuauagcaagcugaccugaagauagggaaaguauuugagugugagccuugcccuaaccacaugagccuauucaaaguaguuuucugcugguagaagaggaggaagucagggauuugaagcaugugggggauucagcacaugagaaauccucuguuguugacuugaagauggagggagccccauggcaaggaagguggacggccucuaggagccgugagaggaccuggcuuacagccagccagcgaggacauggggaccucagucccacagccgcaaggaucggaauucugccaacaaguggagcuuggaagccaauucuuccccagaaccggcagaaaggaacgcaaccugguagaugccucaauuucagcccucugggacccggagcaaaaaa

SEQ ID NO: 16483 - RNA, 4560 nt, Homo sapiens
gucagccucgcagcgggcggcguggacgcggcagcgcagcggcuccuuuaaggcucgggcaccacccccgccgccccgccucccgugcggccugggucuaguuggcggcggggucggguccgcgcgagccgcgauggagcugcacauccuagaacaccgggugcgggugcugagcgucgcccgucccggucucuggcucuacacccacccgcucaucaagcugcucuuccugccccgccgcagccggugcgcgcccggguucgggagcgcagauaggggcugggggcucugcucucgcuccgggccagggucggaggauuaggaucgccguaaggcaggcaggcaggcgggcgggagcggguggggaggacucuccccguccggccgccauccggccugggggaccgccgccuauccggccccgugaggcccccucccaggggcaaagcgcaaacagccugggaugggcaaugcuuaacucaguagugucaaaugggggcauuccuaccuggucacugcggggagcuccuuccaggacgccucccuucaugucagaggggcuggacuaggggguccaagguccgacgccccuggggcugucgccgcgggugugaaccucuccucccuccaggaguggagggguggaggguuccuggagaggucgggaggccggaaaguagcccccaacccccgagauggggcuaacaucccauuggccuggaaauuaaaggccgagagggcaagaaggcgcccggcccagggucgcgggggugucucggggcagauggagagaaauccacucccgaccccuaguucuccacaccaagcugaagaugcuccccacccccaaccaggugcaaguucuucagccugacggagaccccugaggauuacacgcuuaugguggacgaggagggcuuuaaagguggggguuggucuggggaacgggaguacgggaggggcuugucgugcuccccuucuguaggguucucaccaguugcugggauccgucccaagagcuuaagccuuaaaagcagaugggucgggguucgaauccuacuccaccacucccuggcugugugcccuugagcaaaucacuuucccucucugagcuguuuucucuuauguaaaauggguauaguuaugguucugauacauagggucccaugaggccuuuauaaacuuaaaaccgcugaggggcacucagcagucuuaggccugcagaagggccucuguuaugauuccagucaagugcugcuguuagaaaucccuggguauuauuuccuccuggucuuacucucugguuugggucaccuccuccccugcuggucuggaaacuccaggagucugagggaaggaaugcaggagcaggcagccaucucaggggaggguccuggaggccuccuggcugugcuggggugaauagcagccacccaggcccuggccccagcucaggacuggacgccagccugggcccucccuggggccuggagcugacgccuagcuccuccuccugcugcuggcccugcccauccucacaggcuuggagucucaggccagcuagcuggagcuuagccuguccccaugcuccacugcaggccuuaguuucccuguuuuuacuucagaagucugggucugcaaaaggggaaggcaaucccccagccaaccugaucugcgaaugcccccugguggugccaugugguacaaagcuucugcuaacccacagaagacaccguagugagguagauauugucgucccauuuuacagaugaggaaacugagacucaaaucacccaccccaggucauaagacaaauuaacaaagcugggauuugaacccaggucugucugaaucuggaccucugaucuuaagugggaaguuucaaugccaccaggccagcacuugaagccuuucucagucuuugcacacauagggacuucaggagccccagccuccagaccugcccuuaccuugauggagcccuccaaggcacagaaagggaaacugaggcucagagaggggcaggggccagccuuguagacccugaccugacauguccccugcccacagagcugcccccaucugaguuccugcaaguagcugaggccacauggcuggugcugaacgugucgucucacagcggugcggcagugcaggcugcuggggucaccaagaucgcccguucggucaucgcgccacuggccgagcaccacgugucugugcugaugcuguccacuuaccagacggacuucauccuggugaguuuccugcuggugcugaugcagagcaggguggauauagguaccugggagcccaugugaugugccaucugcuguggcccaggugcgggagcaggaccuguccguggugauccacacgcuggcccaggaguucgacauuuaccgcgaggugggcggagagccugugccugugacgagggaugauuccagcaauggcuuuccccgcacucagcauggugagggccgcccccugacacuuggacuugggcagggccuccucuucccacugggucccuucccuuuugggccccaguggggcaggaggaccccggccaguuccuggauagcaagaccugccccuggcccacgccucucccugacuagccaccagggggcgccccagcccacggacaccuuuucaccugcugcuguccuccagcagggcccagccccacggugcaucccauccagagcccacagaaccgcuucuguguccucacacuggacccugagacgcuuccagccaucgccaccacccucauagauguccucuucuacucgcacagguggaccuuggaacuucgucuuuguccucacagcacuguucccuacacucugucccaccacuuuccgcccaucuaucaguuuugcaccucuugcuuguccucucuugggguuccuggcagcccaugaugcucacuugugcuucacugauguucggggaagguucuugccccaaagcuggaucccuuuccaguggggucgucugagccaugcccuggucuggcccucucaccguggaauccuuuguuuuuggcacaggcuggguucauuguccucccccauccccacccacaccuuccagagggcuggacccuugggcggguagcagauauggcagagccugcccaggccaccauaccagcuccuucccaggguucuggaggcugaucgggagcaggggcaguaggcugggugccugguagagccccuaaaccucccaucccuccccagcacccccaaggaggcagccucuagcaguccugaacccagcuccaucacguucuuugccuucucccucaucgaggguuauaucuccauugucauggaugcugaaacacagaaaaaguaggugaccccugaccccgggugggccccaggccccagccagucccaggcagggaggagguggggcaucagacucugaggucagcagguguaccugucccagagcucacggucaggcagggguggaugggggugcccugcccaucacccaucucccuccccagguuccccagugaccuccugcugaccagcuccucgggggagcuguggaggauggugcgcaucgguggacagccccugggcuuuggugagggcuguucccgguguuggggggcuggggagugucuggggagcaaccggcaugugccacauguggccuuccuccaccacccucagaugaauguggcaucguggcacagauugcagguccccuggcugccgcugacaucucugccuacuacaucagcaccuucaacuucgaccacgcccuggugagcaccaagggcuggggcagaggggagagugaggcccagaaaugugggcggcaggagguagucucagcugggccaggaagucagggguggcccuggccagcuuccgccuugacccuucccuccugcccaccugcccucaggugcccgaggacgguaucggcagcgucaucgagguccuccagcggcggcaggaaggccuggcuuccugaggcccaugggcaacagagcagccucccugcucuccccucgacccaggcuuccaaagacuucucuaagcuauuuccuuaagcucuggaacgagcccccuguucugcuggggacccucguuccgcucucuguauguaagcugcgugcaggcaccggcuuuuacgcggacaccuguguacacucacagguggagugggcaggugcuagccugacugcgugucugcccaugcaggggaacacggugcucggggcuuaagcccccaacccaucacucccugcgcagccucggcguuugcacagucccugccugaggccugagccauuccccaaaggcuuccugggccagcugccccgcugaccuccguucugccucuggugggguugccuucccuggccaggugaguccugacagugccucucccuccuggggccuccaaggaaaguauuuugacaucucucucucuucuguuuuuauugacuuguuaauaaaggacuuuguagugacuggguugggcuacgguccuuggggguccucugggucugagucucag

SEQ ID NO: 16484 - RNA, 17195 nt, Homo sapiens
ccggcccugcuucuccccuuggcucccaagacccugccccaaccugugucaggcacagacugggugggaacccagggcccucugcaccuacugcccccagcccuucaacuggaggugggggguggaaguggggguagcgucagggccacccagcucuggacgggaagucaaguugggggcggggugaggagccgacuccagagaagauccagcaggagagggaagcagagggggccuggcccggaagacgauggugucccacugaagaccuggcaaaccuuccagauccggagcggcgugugcaggcacagaccacgguaggcuucucccaggggcagggccggggguagaggccagccuccaaauuuauccuccaccaaagcaaauaucacucacucccuugugggucagggggagaucugguggcccacacacgcuccaggccucaguuuccccuucuaugcaauggacauggugagauaagccccgaacaucucucugaggauguugaggcuaagcaggagagaacggaugcgaaagugucauguggacaugugaggguuuaaagagcaucaaaggguuaaagggcagaggagagagcucuggacaugguggcuggaaggaggccuggauuugaauccuggcuguuugggacccuggaggggucagucaucugggaguuuugaguccuggauucccaagggacccucaaguucucuuuuccccagagcaguacaggggacccagcccaugaagaccucgguuuccuucugauggagaggugguuccuguauaggaggcuccagcguguguggucagucaaguucaaggccccugugcuuuuggccuugggccagugcaggacuugacugcacugugccucacucacuguguaaaauggaucuaauuaugggaucacuguggcgagaaaggaaaaauauagguaaaauccuugcacagagccuggcaugagagggaaaggggcucgaccccaaucuugcuaucagcaacucccgagaccuggggagaggcuuccgaggggauagggaaacugucuccggggugggccaguccugggucuggaugcugggguucccuggcacgcuggggcaggguggggaccugggcucugccccacgugucccugguuuacuugguuuacuuuaccucugugggucuuaauugucuccucuguaaaacggugauuguaauucccauuuggaagaauugucaugaggaccuguaaaugggggcuggggagagaggacguccuggaagucugagggaagugggacgcggcagcagggccaggagagaaauucuucucccccuuccuccucuuccuccucccagaggcuccgccaggcagaggcacgugguccuggcacccccuuguggccgguccucagggcuuccccaggaggugcuggacauggcauaggcuccuccaagacccccucaguggugcccccuucuccagccuuggccuguaucugcccacucuccauucugagucucaggcaucccggcucacuuccucaaauccccaaaugccaucccgccuagcucuaggggaggccccggcugcaggcuggccuggggcuggcggggccguggccgcagggccugcugcccgcugggcaguggggggcgcugcagcccgugguuuggagccgggcuaggugauugggugucuuucauaugcuggucugggagcccuggaccuggacucuccccuagcccugggcccagcuuuccuggggaccugggucucucucucuaucccccaccacugcuccccacaagccacucuucagauaaccuuuucuuuuucucuuuucuuucuuucuuuuuuuucccucuuuuuuuuuuuuuuuuuuugagacggagugcaauggugugaucucagcucaccgcaaccuccaccuccuggguucaagcgauucuccugccucagccucccgaguagcugagauuacaggcauguaccaccaugcccagcuaauuuuguauuuuuaguagagaugggguuucuccauguuggucaggcuggucucgaacucccaaccucaggugaucugcccaccucggcuucccaaagugcugggauuacaggcgugagccaccgugcccggccccaaagaaccuuuucuagacacuuugggacucauggacuuaucuagaaagggaaacugagacucugagaagcuuccuucuggaauucucacaagcaaaucaggacugaaacccaggguuccuagcucucugucugggaguucaagagaggccacuaguccacauacuacugggaaugugccacuaauuugcuguguggccuuggaaaagcgacuuccccucucugggccccacagcuaagauaauaucaauaacacagccuggugcaguggcucaugccuguaaucccagcacuuugggaggcugaggcaggaggauugcuugagcgggggugauugaggcugcagugagcuaugguggcacuacugcacuccagccugggcaacagaaugagacccugucucaaacaauagcaauaucaauaaccaagccauguuuuccaugcuggccagccuuugcagaggacauugcugaccucacagguugacaacacuguuaccccauuuuguggacguuggaacugaggccugagcgaugaggccaccugcccgaggcugcacaguucguaaguggccaaggugggccuggaccuggggucuggcugauuccagagcccacuuagccuccuccccuccacggcgcagccucaucucuucuccgagcuuuuccuuuaccaaguggggaugcugaggccagcaggggccaagaugggcccuaagucccccacccccacccggcagguggggguggcacaggccacuguccucccucugcaggggucuccugcugccagcccucuggcuaggguggacuuuggggagaccucaacagcugagagguucacagagaagcuggcucucuggacagcccaccaugaaugacaccaggccggggcguuggucccacccagaaagggaggagauggaaacaggguccagggguggggugggggcagaggcucggcugggcagaagaucagagcgggauugugucaugcaguccuguggcuuaucagccacugggcggccugguccaggcaggaggggcugccuggggagugacucuguggggacccccccugggccuggcugcucagaccacaccugggccucccggguccuguuuuagggaggcuggggguagggggcugggguggagaccuggcuccauuacacacugugugaccugggacaaaucauuccacucugugagccucaguuuccgagucugucaaaugaaguuuaaaaugccucccucagagaaugcggguuaggguuugagcccauagcggguucuggugagcacuugguaaugcuugguuuuguggggagggggugggagagaggcuuaugaaagccuugggggccugugccccaagaagggcacuacuccgggcugggaggguccuggaggucuagggggacccaagggugcaggacuggugggggacagguauuacgaccccguugcaagacacagagggaagccuggccccuccaaucccagguuccaccagcggcucccccacccggccccaucccuccccucaccccaggaagcucacucuuccuucucuucccagggaagaggauaguccaaccucagccaggucucaccccuccauccuccccacccagugggaugggaccacuuuauucuuuccaugucaucacugucgccagaccggaggcucccaucacccucccacccacaauccucagaacaauccucaggcuccccugggugcugggucgggucaggguggccccagugagcuuggcugggggaggggaaggagaggaggccaggcccacaccucugcacggccaguuucaggcugaauagguccucgggcugcuuccuguucuguuuauggccucugaguccaggaaaucauugagugacacgucccuccuuuaccccccagccccaugauuauuuaauaggggccgcuguggucucucucuuuuggaaaauccagugggagaagaaagcugucagcucgccucugacaucagcuuugucccugugccaagagucaggguggccagggcguuguggagcggggggcuggggcgggguagggaggaagccagcugcugguggccccugugacgugaggcugccacaugguucccaggggcgggggcuggagggugaggagcagggauuguuggagacacacgccggggcacacgcaggccuggaggcucagaaacgcaugcgugcacgcccaggguuaggccuccccccucuccgagccgucgugcccagggauccacaguccuacacaaacucaugcagacacaaggccagacacacagucgcacuggcuucaugcccaugggcacacgcgcacgcgugcgcacacacacagacucacacaaccacacggagaacucacaauagcagccagagaugugcaccgucuagcucgcugucacacaaagcaaacaguacaagcagauccacacacaugcacacacaugcauacaccacacaugcacacacgggaccagacacaggcaugcacagacacagaggcacucacuacacacacaugcucaggcaaaugcccacucagacucagacaaagagacucagccaugucccagggccacagggagcccaagugugcacccucuacugcaggcuguggcucuuggccucaggcugcccugggaagguggcuguggccacuuccucuucccgcacccuguggugaggaugaaagacucccugguggaguacgaaagaaaggccugugacuguccugggcuccacccaggugggacggggcagggcagagagcccagggguccgaggcugcggaagggaguggacagugagagguugggcucuggaaggccuuugucacggcauggcacagggugccgccagguuccccacguugagcaccugcucagccccaccccgcccuacccugcggcaccucuggcccauuccugagcuggaagggaagucaggagccccgugagacacugcugagugaccuugggcaagucacuccucagccccucugggccugcuuucaacaucgauaccaguggcuugcaaauguuuuugacugccacccacaguaagaaauacauugcaccuugcaaccagaugaggaugcagauacugacauacagacaaccggaaaaaaaguuucauggagcaauccucgcccuggcucugggcgaugccaggugauuucgcuauuccuuuuugaaaguguugguggcaacccucuaauugaauucaugacccacgaagaggcagaggccugcagugugaaaacacugcucucucuauaucugccugcaguggucucaggcuaguucgagauucagggagagccugggggagguaaaagugcuugcagagucucaaaggccaugcucacuaaaugcugauggcugggguagacagcaacccauucuacagagcccugggggggaccggccccacgcaacgccacggccaggccucuggcuggcccugccaaugaucaggggcugcugcuucccuugcaauuucuaucagaaaugaagaaaaaaaaugcagucacucugauucaucuccaggggguugauuccugacacagucggucgggaaaugucgggugaugaugggagcaguuggcagaaguccaggguggcuucuggcuucuccuuggcccugaggggauacugcuggucgcugccagagacuggauccgguaagggugagaaggggcaggagauagguccagcgucuggaccucaagagcccccagaagacagcugggcucuccagggcccagagaugggggaaguacugcuuauguccccccacaagguucugagaugcuacccacucucccaaaacccacaccaggcuccaugaacuaagcggacccaggagccaccuccugcccugacucucggacuccagugugcugaccaugggacccagcccuaacccaagccccugacucggucuggaguuugagcuccuucugcggccacaaccagaucuuauuagaagggcugccauguguuagacguuuauccgcauuucccaagaaacauccccaugauggccccacgaggcuguuaugacagcauccucauuugcagaggggaaaccgaggguaugagaaaggaagcccguugucccgggccacauagcugguuguuggggcaggagggauuugaacccacaccacuggggugagaacaguggaggcacgguccgcugguggcaucacacucucacuccucaagcauugaagagugcggugcucuugccuuuuuggccaggaugcccaauuggcugggcugugcccggcauuccugagcuucaccaucuccucuggccacuccucaccagcccugagccugggacccacccucuggccccccgcuuccuuccuaggcccaccugagggcucugcucauuuuccagguaccagggccagaggggauggggaaggaaggagggaggccagccugggcagccgggggugcccggagcgcuguuucugggucgcuggucuuggggaauuccccaaugcccggagagcugcuuaccuggugaguaacugcugcuggcugcccacacagaaugccugacugugaagggaccucccaucucaccccugcccaugccacugacaugcugcccucucuccugagagccccaggguccaggaaagagacagacaggcagggggcuggcccccacccccgcaucccccccccaaccccggggcuuugcagggggcggcuggugauucaagccccucagagcugaguuugucuccuuccuucucacauggggccugggggugaaucagcuucugggggcgguaaggccaggucagcugcuguccucagaucaggcuugggguggggguggugaggggccaggaagggggcucugggggagugagcacacugcccugccagcccccucccacaaccugucugauuuaucuggggcacccuugaagcuggaggcuacguggguaucuugccucaauuuaccaucagcagaggcuugagaggucuugcuccugcccagccuuccccgcucagcacccuggcauggacccaaguuuccccaucugucaaaugaaccccugcuucacagggaggucagcacaaugggugaugauaugcagacagguggcuugcugggugcccagaaccaugcugagcccugagcccucacagcagacccacaaaggcgguaccauuauucccauuuuauaguugaagaaacugaggccaggaggugguagucccuuccccaaagucacucagcucauaacuggcagagccaaaccuccaaccugguugugaaugaggccagaguccauucuucaaaccuucaggccucuccaucuccuuuccacaagagaguuggcacugacaguuuuuggaaacuauaaaaugcuuucucaaaaaauacuuaaccucuauucaugucagaguauagcccugagccaggugcugucuagagcacaagugagucucagaccccauucaaacucucaaagguugaggaauaagacucauccccacuugaaacacgagcaggcaggacauggccgaugugagcuggucggggccaugggaggcaggggaggcuuccuggaggaaggcgacccgagcacuccugccaugcccuucgcccucucagagcaagaggugcugcagggauuguuguggccugcaagacagaagccccgguuccagaccuggcucuguuauuaacucuuuaugugagccccacauaguuaucuucaccucucugagccucaauuuccccaucuggaaaauaagcagcugugauaucccaggagagacuuguggaugggggguaacaaucagcagaagacgagcagcuggguagcugcacgugcuagagggugcacucccuuccuggagagcagugauggguuggauggcacagccaccuggagacagcacuccuggguucuggccuaguaaccucugcucaaugucagggggucccauguggccgggacugucccgcucacccugagaccggucaaauccccagcaggccccaucugcaggagcaggacaggcuguggaugaagucacagcuggaaggggccaagccggggcugccacuccaggguggggccuggggucgugacccugggagccggcagccaagaagggagggugccuuccaugagggagccggccgggggcggggaacacacacacacagcauagagagggagggaagaaaacaaacucccagagaccaaagugggccuggagcguagccugggcggcugauuccugggggccgcagccacguugcaggcggcacacggacuugcggcuccgagacccugcccagccuucccuccagaggcccagagcagguggugccuggacauggacaggagggggaggcugggccuggggcgccgaggggcccagagcacuuggggagcacaaaccaagucagguaccgugagaggaggggaaacugaggcacuggaggggccagucagggcugggguuaaggggccuuagugucagugucuucuagacccuguccucacuuccuguuuccugugggguggggcugagauuaaacagcgauuggggguggauuauagggcugauguggggucuggcuugccagaaggcaugcaagggccuggggguccgcuuggaaggaugcaggggagacugggcagaaugguagauguaggggcagcugcagaacucuugagccuaaugagagacucaggccgggcgacggggguuugauggguggaggccacagugagccccuggucacauggauuugggguccaugucaggagagccaggcugagucagguggcaggggucugggugaugugggaugggacuggggacugguccagagcucacgugcucugaguggucagguccuugugcaggagaugcugggggagguguaagaagaaggguugagcugggguguccugggaugugggguuaccugagccaggccagggcaggugagucuccuaguaguguacgcugaccccagagcaaguguauaggagcaguaagugccaaguggggcccuccauggucccucaaagaagagacaagguguggggugagaggcaggaaggaggaaggagagccaguucgggaagugccagcugggaugggcaguuuuaucaccucacauccgaggcccugcugggagagaauggggggcaagagcguagauaaagcagggugugugugugguggggaacggcagcaggcaccagggcucguccuggcacgaugaaggaggaacccguggcugggcaggucugggauguggcaagaggcaggaacugggggcauggaggaugggcgagggggcggugggggcccgggcgaggcugcaagagcucccuggccuuggaaaaccaacucacacaccuugaucucaggucagggucaggcggaagggcugggaaggggccacaggggacuaaaucaucuccugguacuggggguccccuggcagcuuuagggacggcauggccccagacgcguggccaugcugucuggccggcauucccgcaucucauaggguguauuuauuuucacuuuucuguugcauuucuuggaggugucccugugcucauuuugcccggcuccccacugcuccuuucugcccuuccucauucacaaaucgccuggccucagaagacgccagaacaugugacacugccuuagagccucuagaagcacuuuuuggggaccuccaucauucucugaggcugggcucaaaggggcuuccaaggcaggucuggaagggaccagccacuucucaguuuccccaaccaucaaucagcacccggaggaggaaacugggguacgauuucgccaagccucucucaguccugcuucagaauggaaaugcuggaccgccuucccagaagcaccuucccagagugucccgacagaacugagucagucaccccuacccccaugucuuccuagccccuuccccagccucacagguacaguggucagcagggcgagugcacugguggugucuggaggccugacccucuggggcccugggcaacguguuccccucggagccccuuggggcccaguggcaaugugcagauuggaggaggcuaccucugggguggcuuccagcgcccauguucaguuccacuuuaugaccgucuaaaguccacgccggccccggccccuccuccuggagccuccuucucagccaagcccuagcccuccuccucccacugccccccuaaagccccccaaccagggggcacaggggccagucuccaucugcuaguccagacucgcuaccuccccaaacccaggugagucagggccgucuggggcgcccacugcugggaccccugcugacucggccaggggcccccuccuggcgaugcccaucuucagacaacucccgggacaagccaggcaggaaaaccacagggcguuuugucgaaggcuucauuauaauuuuaucaaucaaauucuuagaagagggaaaaagucuguucuccccacccuccccccucacucguccccccccuucacucucacuuucuuccauucauaauuuccuaugaugcaccucaaacaacuuccuggacuggggaucccggcuaaauauagcuguuucugucuuacaacacaggcuccaguauauaaaucaggcaaauuccccauuugagcaugaaccucugaaaacugccggcaucugagguuuccuccaaggcccucugaagugcagcccauaaugaaggucuuggcggcagguaaauacacccgccccgcgccggcuucgcguccccgcugcggggcgcggcggcaacuuggggcgcuuggcagcgcgagccggacgcccacccgccgcagacacacgaacacuuggggcgcccgcgcagccaccggaggcgcuggguggcggcccggagcgagcgcgggcacauggucccaagcaccgcacgccccgcggcagguuggcggcgagggagggggcgccgagccuuccuccuccuccucuucuucccccucuccuucuccuccuccuccuccucgcuccggacacucgcuggcugcucuucccucugcgcuuucucccagauucacucucccucucucuuuuucuuuucuuucuuucuuuccgcuuucuccuuuccaaccgcggucccgggcugcucccagggaggggcgcgggcggcgagcagcuugcaaacuccggccugggacgggagcaggugccgccuccaucugcuggugucuggaagcguguggucugcgcuaggugagauauagggguguggccccccucccgcagccaccccggggccucagcacugccuugggaugcugggacgaacaggggacccaggagaagugaacuugaggaggccccuguccccgcuguuccagcaugggggauccgggggaggucuccagccucacucgcccgcugaccccggcccccaccaucuucaggugcccuucugcagagcccuggaaaagcgucuaagggggccuggggggagucgggagaacaggccccccugggggaggggcaaaccaggacaugucgggacagcucccagcucuccugucaccuuucacuuuccuuccuccccgcccacccgacugccuaugaccuuuugccuuuucucucuccuggugcaccauuuccucucccucccugagccgguguguguguguuaggagggaggggaaccccugggacaagggacagcggaugagucgggagaaggcauggagucaggggcuguccggagcugggggaacagagaguuuugaaugaugauuuggggauggagaguggggacagccaggcagaaauggggugagcuugagugagauaggggacacuagggaaggaagagauagaggaugaugggggcgggggcagaauugggggcaauuggcccagggagccagaaucaaguggcagguuugggagggagaugagggucaaccgaggacuccuccccacucccccaugccccguggcccccaugggugccuggcuucggagauuugggcugcaaugggccagugagugggaagcgcugcugaggaaccugggccaccacgggaggugggaagagaggggucuccuuucuccuggugccugcugggccuggggccuggugccuuccagccagagggccagggggccuuaggaccuuugccuuccugagggaaagggugggauggcugggagucucuccuggacccugcacccuuuggguggaaauggcuugugucuugcccucaucuuuacgucaucccagaagagagcagggagaacuaagguagagaaagggagacagagaaacacacgcagugacagagugaagacuaggccccaggaagacagcugcagguggugagggggaaccaggaguccucucccaugcggccauuguuggacccccauccggugugccaugaccccaggccacccuuuccugccuuucuacucauggcuucuuccugacuguccccaggaguugugccccugcuguugguucugcacuggaaacauggggcggggagcccccuccccaucaccccugucaacgccaccugugccauacgccacccaugucacaacaaccucaugaaccagaucaggagccaacuggcacagcucaauggcagugccaaugcccucuuuauucucuauguaaguuaccccugggauacugacaggagauggcagggagggggcuuguaaauaucauuaggggcuguccugaucuggguugaggggaccuuuuggggcuggaaggagagaauggggagagggcuugauuaaaccacccccagacucccgccacuuccugcccaagcuuccccagggaagcuuccccagggugcccaguuagcaaggggagaacugagugcaaagguggggaccuggcacuucuuaucuugugauuguccugcugcagggagcgagggauggaggggaaaugggcgugaggcaccagggagaugcgguugagaggcagugggcugugggugcugggcauggaggggcgucccggaacauugugagugcagggauggaaguacuuguguguggugccccagcuagggcuagacaccgaguuuucccuucuguccccuuaggguggugaugaugaugaugaugauaaugaugacugcgugcauggcucagucuuugaucuuuagcaagggcacucacauuacaauuaguuuuggcucucaugacaauuccagaugcuuacagggcaaggaguuggguccucaugcgcuagauggggaaacagacgcaagagcuugcccaaaggguuggcggcagggcugggacacugaccccugacucccacgucaccucccuucugccccucaguacacagcccagggggagccguuccccaacaaccuggacaagcuauguggccccaacgugacggacuucccgcccuuccacgccaacggcacggagaaggccaagcugguggagcuguaccgcauagucguguaccuuggcaccucccugggcaacaucacccgggaccagaagauccucaaccccagugcccucagccuccacagcaagcucaacgccaccgccgacauccugcgaggccuccuuagcaacgugcugugccgccugugcagcaaguaccacgugggccauguggacgugaccuacggcccugacaccucggguaaggaugucuuccagaagaagaagcugggcugucaacuccuggggaaguauaagcagaucaucgccguguuggcccaggccuucuagcaggaggucuugaagugugcugugaaccgagggaucucaggaguuggguccagaugugggggccuguccaaggguggcuggggcccagggcaucgcuaaacccaaaugggggcugcuggcagaccccgagggugccuggccaguccacuccacucugggcugggcugugaugaagcugagcagaguggaaacuuccauagggagggagcuagaagaaggugccccuuccucugggagauuguggacuggggagcgugggcuggacuucugccucuacuugucccuuuggccccuugcucacuuugugcagugaacaaacuacacaagucaucuacaagagcccugaccacagggugagacagcagggcccaggggaguggaccagcccccagcaaauuaucaccaucugugccuuugcugccccuuagguugggacuuaggugggccagaggggcuaggaucccaaaggacuccuuguccccuagaaguuugaugaguggaagauagagaggggccucugggauggaaggcugucuucuuuugaggaugaucagagaacuugggcauaggaacaaucuggcagaaguuuccagaaggaggucacuuggcauucaggcucuuggggaggcagagaagccaccuucaggccugggaaggaagacacugggaggaggagaggccuggaaagcuuugguagguucuucguucucuuccccgugaucuucccugcagccugggauggccagggucugauggcuggaccugcagcagggguuuguggagguggguagggcaggggcagguugcuaagucaggugcagagguucugagggacccaggcucuuccucuggguaaaggucuguaagaaggggcugggguagcucagaguagcagcucacaucugaggcccugggaggccuugugaggucacacagagguacuugagggggacuggaggccgucucugguccccagggcaagggaacagcagaacuuagggucagggucucagggaacccugagcuccaagcgugcugugcgucugaccuggcaugauuucuauuuauuaugauauccuauuuauauuaacuuauuggugcuuucaguggccaaguuaauuccccuuucccuggucccuacucaacaaaauaugaugauggcucccgacacaagcgccagggccagggcuuagcagggccuggucuggaagucgacaauguuacaaguggaauaagccuuacgggugaagcucagagaagggucggaucugagagaauggggaggccugagugggaguggggggccuugcuccacccccccccauccccuacugugacuugcuuuagggugucaggguccaggcugcaggggcugggccaauuuguggagaggccgggugccuuucugucuugauuccagggggcugguucacacuguucuugggcgccccagcauuguguugugaggcgcacuguuccuggcagauauugugcccccuggagcagugggcaagacaguccuuguggcccacccuguccuuguuucuguguccccaugcugccucugaaauagcgcccuggaacaacccugccccugcacccagcaugcuccgacacagcagggaagcuccuccuguggcccggacacccauagacggugcggggggccuggcugggccagaccccaggaaggugggguagacuggggggaucagcugcccauugcucccaagaggaggagagggaggcugcagaugccugggacucagaccaggaagcugugggcccuccugcuccacccccaucccacucccacccaugucugggcucccaggcagggaacccgaucucuuccuuugugcuggggccaggcgaguggagaaacgcccuccagucugagagcaggggagggaaggaggcagcagaguuggggcagcugcucagagcaguguucuggcuucuucucaaacccugagcgggcugccggccuccaaguuccuccgacaagaugaugguacuaauuaugguacuuuucacucacuuugcaccuuucccugucgcucucuaagcacuuuaccuggauggcgcgugggcagugugcaggcagguccugaggccugggguugggguggagggugcggcccggaguuguccaucuguccaucccaacagcaagacgaggauguggcuguugagaugugggccacacucacccuuguccaggaugcagggacugccuucuccuuccugcuucauccggcuuagcuuggggcuggcugcauucccccaggaugggcuucgagaaagacaaacuugucuggaaaccagaguugcugauuccacccggggggcccggcugacucgcccaucaccucaucucccuguggacuugggagcucugugccaggcccaccuugcggcccuggcucugagucgcucucccacccagccuggacuuggccccaugggacccauccucagugcucccuccagaucccguccggcagcuuggcguccacccugcacagcaucacugaaucacagagccuuugcgugaaacagcucugccaggccgggagcuggguuucucuucccuuuuuaucugcugguguggaccacaccugggccuggccggaggaagagagaguuuaccaagagagaugucuccgggcccuuauuuauuauuuaaacauuuuuuuaaaaagcacugcuaguuuacuugucucuccuccccaucguccccaucguccuccuugucccugacuuggggcacuuccacccugacccagccaguccagcucugccuugccggcucuccagaguagacauagugugugggguuggagcucuggcacccggggagguagcauuucccugcagaugguacagauguuccugccuuagagucaucucuaguuccccaccucaaucccggcauccagccuucagucccgcccacgugcuagcuccgugggcccaccgugcggccuuagagguuucccuccuuccuuuccacugaaaagcacauggccuugggugacaaauuccucuuugaugaauguacccuguggggauguuucauacugacagauuauuuuuauuuauucaaugucauauuuaaaauauuuauuuuuuauaccaaaugaauacuuuuuuuuuuaagaaaaaaaagagaaaugaauaaagaaucuacucuuggcugg

SEQ ID NO: 16485 - RNA, 17195 nt, Homo sapiens
ccagccaagaguagauucuuuauucauuucucuuuuuuuucuuaaaaaaaaaaguauucauuugguauaaaaaauaaauauuuuaaauaugacauugaauaaauaaaaauaaucugucaguaugaaacauccccacaggguacauucaucaaagaggaauuugucacccaaggccaugugcuuuucaguggaaaggaaggagggaaaccucuaaggccgcacggugggcccacggagcuagcacgugggcgggacugaaggcuggaugccgggauugagguggggaacuagagaugacucuaaggcaggaacaucuguaccaucugcagggaaaugcuaccuccccgggugccagagcuccaaccccacacacuaugucuacucuggagagccggcaaggcagagcuggacuggcugggucaggguggaagugccccaagucagggacaaggaggacgauggggacgauggggaggagagacaaguaaacuagcagugcuuuuuaaaaaaauguuuaaauaauaaauaagggcccggagacaucucucuugguaaacucucucuuccuccggccaggcccaggugugguccacaccagcagauaaaaagggaagagaaacccagcucccggccuggcagagcuguuucacgcaaaggcucugugauucagugaugcugugcaggguggacgccaagcugccggacgggaucuggagggagcacugaggaugggucccauggggccaaguccaggcugggugggagagcgacucagagccagggccgcaaggugggccuggcacagagcucccaaguccacagggagaugaggugaugggcgagucagccgggccccccggguggaaucagcaacucugguuuccagacaaguuugucuuucucgaagcccauccugggggaaugcagccagccccaagcuaagccggaugaagcaggaaggagaaggcagucccugcauccuggacaagggugaguguggcccacaucucaacagccacauccucgucuugcuguugggauggacagauggacaacuccgggccgcacccuccaccccaaccccaggccucaggaccugccugcacacugcccacgcgccauccagguaaagugcuuagagagcgacagggaaaggugcaaagugagugaaaaguaccauaauuaguaccaucaucuugucggaggaacuuggaggccggcagcccgcucaggguuugagaagaagccagaacacugcucugagcagcugccccaacucugcugccuccuucccuccccugcucucagacuggagggcguuucuccacucgccuggccccagcacaaaggaagagaucggguucccugccugggagcccagacaugggugggagugggauggggguggagcaggagggcccacagcuuccuggucugagucccaggcaucugcagccucccucuccuccucuugggagcaaugggcagcugauccccccagucuaccccaccuuccuggggucuggcccagccaggccccccgcaccgucuauggguguccgggccacaggaggagcuucccugcugugucggagcaugcugggugcaggggcaggguuguuccagggcgcuauuucagaggcagcauggggacacagaaacaaggacagggugggccacaaggacugucuugcccacugcuccagggggcacaauaucugccaggaacagugcgccucacaacacaaugcuggggcgcccaagaacagugugaaccagcccccuggaaucaagacagaaaggcacccggccucuccacaaauuggcccagccccugcagccuggacccugacacccuaaagcaagucacaguaggggauggggggggguggagcaaggccccccacucccacucaggccuccccauucucucagauccgacccuucucugagcuucacccguaaggcuuauuccacuuguaacauugucgacuuccagaccaggcccugcuaagcccuggcccuggcgcuugugucgggagccaucaucauauuuuguugaguagggaccagggaaaggggaauuaacuuggccacugaaagcaccaauaaguuaauauaaauaggauaucauaauaaauagaaaucaugccaggucagacgcacagcacgcuuggagcucaggguucccugagacccugacccuaaguucugcuguucccuugcccuggggaccagagacggccuccagucccccucaaguaccucugugugaccucacaaggccucccagggccucagaugugagcugcuacucugagcuaccccagccccuucuuacagaccuuuacccagaggaagagccugggucccucagaaccucugcaccugacuuagcaaccugccccugcccuacccaccuccacaaaccccugcugcagguccagccaucagacccuggccaucccaggcugcagggaagaucacggggaagagaacgaagaaccuaccaaagcuuuccaggccucuccuccucccagugucuuccuucccaggccugaagguggcuucucugccuccccaagagccugaaugccaagugaccuccuucuggaaacuucugccagauuguuccuaugcccaaguucucugaucauccucaaaagaagacagccuuccaucccagaggccccucucuaucuuccacucaucaaacuucuaggggacaaggaguccuuugggauccuagccccucuggcccaccuaagucccaaccuaaggggcagcaaaggcacagauggugauaauuugcugggggcugguccacuccccugggcccugcugucucacccuguggucagggcucuuguagaugacuuguguaguuuguucacugcacaaagugagcaaggggccaaagggacaaguagaggcagaaguccagcccacgcuccccaguccacaaucucccagaggaaggggcaccuucuucuagcucccucccuauggaaguuuccacucugcucagcuucaucacagcccagcccagaguggaguggacuggccaggcacccucggggucugccagcagcccccauuuggguuuagcgaugcccugggccccagccacccuuggacaggcccccacaucuggacccaacuccugagaucccucgguucacagcacacuucaagaccuccugcuagaaggccugggccaacacggcgaugaucugcuuauacuuccccaggaguugacagcccagcuucuucuucuggaagacauccuuacccgaggugucagggccguaggucacguccacauggcccacgugguacuugcugcacaggcggcacagcacguugcuaaggaggccucgcaggaugucggcgguggcguugagcuugcuguggaggcugagggcacugggguugaggaucuucuggucccgggugauguugcccagggaggugccaagguacacgacuaugcgguacagcuccaccagcuuggccuucuccgugccguuggcguggaagggcgggaaguccgucacguuggggccacauagcuuguccagguuguuggggaacggcucccccugggcuguguacugaggggcagaagggaggugacgugggagucaggggucagugucccagcccugccgccaacccuuugggcaagcucuugcgucuguuuccccaucuagcgcaugaggacccaacuccuugcccuguaagcaucuggaauugucaugagagccaaaacuaauuguaaugugagugcccuugcuaaagaucaaagacugagccaugcacgcagucaucauuaucaucaucaucaucaucaccacccuaaggggacagaagggaaaacucggugucuagcccuagcuggggcaccacacacaaguacuuccaucccugcacucacaauguuccgggacgccccuccaugcccagcacccacagcccacugccucucaaccgcaucucccuggugccucacgcccauuuccccuccaucccucgcucccugcagcaggacaaucacaagauaagaagugccagguccccaccuuugcacucaguucuccccuugcuaacugggcacccuggggaagcuucccuggggaagcuugggcaggaaguggcgggagucugggggugguuuaaucaagcccucuccccauucucuccuuccagccccaaaagguccccucaacccagaucaggacagccccuaaugauauuuacaagcccccucccugccaucuccugucaguaucccagggguaacuuacauagagaauaaagagggcauuggcacugccauugagcugugccaguuggcuccugaucugguucaugagguuguugugacauggguggcguauggcacagguggcguugacaggggugauggggagggggcuccccgccccauguuuccagugcagaaccaacagcaggggcacaacuccuggggacagucaggaagaagccaugaguagaaaggcaggaaaggguggccuggggucauggcacaccggauggggguccaacaauggccgcaugggagaggacuccugguucccccucaccaccugcagcugucuuccuggggccuagucuucacucugucacugcguguguuucucugucucccuuucucuaccuuaguucucccugcucucuucugggaugacguaaagaugagggcaagacacaagccauuuccacccaaagggugcaggguccaggagagacucccagccaucccacccuuucccucaggaaggcaaagguccuaaggcccccuggcccucuggcuggaaggcaccaggccccaggcccagcaggcaccaggagaaaggagaccccucucuucccaccucccgugguggcccagguuccucagcagcgcuucccacucacuggcccauugcagcccaaaucuccgaagccaggcacccaugggggccacggggcaugggggaguggggaggaguccucgguugacccucaucucccucccaaaccugccacuugauucuggcucccugggccaauugcccccaauucugcccccgcccccaucauccucuaucucuuccuucccuaguguccccuaucucacucaagcucaccccauuucugccuggcuguccccacucuccauccccaaaucaucauucaaaacucucuguucccccagcuccggacagccccugacuccaugccuucucccgacucauccgcugucccuugucccagggguuccccucccuccuaacacacacacaccggcucagggagggagaggaaauggugcaccaggagagagaaaaggcaaaaggucauaggcagucgggugggcggggaggaaggaaagugaaaggugacaggagagcugggagcugucccgacauguccugguuugccccucccccaggggggccuguucucccgacuccccccaggcccccuuagacgcuuuuccagggcucugcagaagggcaccugaagauggugggggccggggucagcgggcgagugaggcuggagaccucccccggaucccccaugcuggaacagcggggacaggggccuccucaaguucacuucuccuggguccccuguucgucccagcaucccaaggcagugcugaggccccgggguggcugcgggaggggggccacaccccuauaucucaccuagcgcagaccacacgcuuccagacaccagcagauggaggcggcaccugcucccgucccaggccggaguuugcaagcugcucgccgcccgcgccccucccugggagcagcccgggaccgcgguuggaaaggagaaagcggaaagaaagaaagaaaagaaaaagagagagggagagugaaucugggagaaagcgcagagggaagagcagccagcgaguguccggagcgaggaggaggaggaggagaaggagagggggaagaagaggaggaggaggaaggcucggcgcccccucccucgccgccaaccugccgcggggcgugcggugcuugggaccaugugcccgcgcucgcuccgggccgccacccagcgccuccgguggcugcgcgggcgccccaaguguucgugugucugcggcgggugggcguccggcucgcgcugccaagcgccccaaguugccgccgcgccccgcagcggggacgcgaagccggcgcggggcggguguauuuaccugccgccaagaccuucauuaugggcugcacuucagagggccuuggaggaaaccucagaugccggcaguuuucagagguucaugcucaaauggggaauuugccugauuuauauacuggagccuguguuguaagacagaaacagcuauauuuagccgggauccccaguccaggaaguuguuugaggugcaucauaggaaauuaugaauggaagaaagugagagugaaggggggggacgagugaggggggaggguggggagaacagacuuuuucccucuucuaagaauuugauugauaaaauuauaaugaagccuucgacaaaacgcccugugguuuuccugccuggcuugucccgggaguugucugaagaugggcaucgccaggagggggccccuggccgagucagcaggggucccagcagugggcgccccagacggcccugacucaccuggguuuggggagguagcgagucuggacuagcagauggagacuggccccugugcccccugguuggggggcuuuaggggggcagugggaggaggagggcuagggcuuggcugagaaggaggcuccaggaggaggggccggggccggcguggacuuuagacggucauaaaguggaacugaacaugggcgcuggaagccaccccagagguagccuccuccaaucugcacauugccacugggccccaaggggcuccgaggggaacacguugcccagggccccagagggucaggccuccagacaccaccagugcacucgcccugcugaccacuguaccugugaggcuggggaaggggcuaggaagacauggggguaggggugacugacucaguucugucgggacacucugggaaggugcuucugggaaggcgguccagcauuuccauucugaagcaggacugagagaggcuuggcgaaaucguaccccaguuuccuccuccgggugcugauugaugguuggggaaacugagaaguggcuggucccuuccagaccugccuuggaagccccuuugagcccagccucagagaaugauggagguccccaaaaagugcuucuagaggcucuaaggcagugucacauguucuggcgucuucugaggccaggcgauuugugaaugaggaagggcagaaaggagcaguggggagccgggcaaaaugagcacagggacaccuccaagaaaugcaacagaaaagugaaaauaaauacacccuaugagaugcgggaaugccggccagacagcauggccacgcgucuggggccaugccgucccuaaagcugccaggggacccccaguaccaggagaugauuuaguccccuguggccccuucccagcccuuccgccugacccugaccugagaucaaggugugugaguugguuuuccaaggccagggagcucuugcagccucgcccgggcccccaccgcccccucgcccauccuccaugcccccaguuccugccucuugccacaucccagaccugcccagccacggguuccuccuucaucgugccaggacgagcccuggugccugcugccguuccccaccacacacacacccugcuuuaucuacgcucuugccccccauucucucccagcagggccucggaugugaggugauaaaacugcccaucccagcuggcacuucccgaacuggcucuccuuccuccuuccugccucucaccccacaccuugucucuucuuugagggaccauggagggccccacuuggcacuuacugcuccuauacacuugcucuggggucagcguacacuacuaggagacucaccugcccuggccuggcucagguaaccccacaucccaggacaccccagcucaacccuucuucuuacaccucccccagcaucuccugcacaaggaccugaccacucagagcacgugagcucuggaccaguccccagucccaucccacaucacccagaccccugccaccugacucagccuggcucuccugacauggaccccaaauccaugugaccaggggcucacuguggccuccacccaucaaacccccgucgcccggccugagucucucauuaggcucaagaguucugcagcugccccuacaucuaccauucugcccagucuccccugcauccuuccaagcggacccccaggcccuugcaugccuucuggcaagccagaccccacaucagcccuauaauccacccccaaucgcuguuuaaucucagccccaccccacaggaaacaggaagugaggacagggucuagaagacacugacacuaaggccccuuaaccccagcccugacuggccccuccagugccucaguuuccccuccucucacgguaccugacuugguuugugcuccccaagugcucugggccccucggcgccccaggcccagccucccccuccuguccauguccaggcaccaccugcucugggccucuggagggaaggcugggcagggucucggagccgcaaguccgugugccgccugcaacguggcugcggcccccaggaaucagccgcccaggcuacgcuccaggcccacuuuggucucugggaguuuguuuucuucccucccucucuaugcuguguguguguguuccccgcccccggccggcucccucauggaaggcacccucccuucuuggcugccggcucccagggucacgaccccaggccccacccuggaguggcagccccggcuuggccccuuccagcugugacuucauccacagccuguccugcuccugcagauggggccugcuggggauuugaccggucucagggugagcgggacagucccggccacaugggacccccugacauugagcagagguuacuaggccagaacccaggagugcugucuccagguggcugugccauccaacccaucacugcucuccaggaagggagugcacccucuagcacgugcagcuacccagcugcucgucuucugcugauuguuaccccccauccacaagucucuccugggauaucacagcugcuuauuuuccagauggggaaauugaggcucagagaggugaagauaacuauguggggcucacauaaagaguuaauaacagagccaggucuggaaccggggcuucugucuugcaggccacaacaaucccugcagcaccucuugcucugagagggcgaagggcauggcaggagugcucgggucgccuuccuccaggaagccuccccugccucccauggccccgaccagcucacaucggccauguccugccugcucguguuucaaguggggaugagucuuauuccucaaccuuugagaguuugaauggggucugagacucacuugugcucuagacagcaccuggcucagggcuauacucugacaugaauagagguuaaguauuuuuugagaaagcauuuuauaguuuccaaaaacugucagugccaacucucuuguggaaaggagauggagaggccugaagguuugaagaauggacucuggccucauucacaaccagguuggagguuuggcucugccaguuaugagcugagugacuuuggggaagggacuaccaccuccuggccucaguuucuucaacuauaaaaugggaauaaugguaccgccuuugugggucugcugugagggcucagggcucagcaugguucugggcacccagcaagccaccugucugcauaucaucacccauugugcugaccucccugugaagcagggguucauuugacagauggggaaacuuggguccaugccagggugcugagcggggaaggcugggcaggagcaagaccucucaagccucugcugaugguaaauugaggcaagauacccacguagccuccagcuucaagggugccccagauaaaucagacagguugugggagggggcuggcagggcagugugcucacucccccagagcccccuuccuggccccucaccacccccaccccaagccugaucugaggacagcagcugaccuggccuuaccgcccccagaagcugauucacccccaggccccaugugagaaggaaggagacaaacucagcucugaggggcuugaaucaccagccgcccccugcaaagccccgggguugggggggggaugcgggggugggggccagcccccugccugucugucucuuuccuggacccuggggcucucaggagagagggcagcaugucaguggcaugggcaggggugagaugggaggucccuucacagucaggcauucugugugggcagccagcagcaguuacucaccagguaagcagcucuccgggcauuggggaauuccccaagaccagcgacccagaaacagcgcuccgggcacccccggcugcccaggcuggccucccuccuuccuuccccauccccucuggcccugguaccuggaaaaugagcagagcccucaggugggccuaggaaggaagcggggggccagagggugggucccaggcucagggcuggugaggaguggccagaggagauggugaagcucaggaaugccgggcacagcccagccaauugggcauccuggccaaaaaggcaagagcaccgcacucuucaaugcuugaggagugagagugugaugccaccagcggaccgugccuccacuguucucaccccagugguguggguucaaaucccuccugccccaacaaccagcuauguggcccgggacaacgggcuuccuuucucauacccucgguuuccccucugcaaaugaggaugcugucauaacagccucguggggccaucauggggauguuucuugggaaaugcggauaaacgucuaacacauggcagcccuucuaauaagaucugguuguggccgcagaaggagcucaaacuccagaccgagucaggggcuuggguuagggcugggucccauggucagcacacuggaguccgagagucagggcaggagguggcuccuggguccgcuuaguucauggagccugguguggguuuugggagaguggguagcaucucagaaccuuguggggggacauaagcaguacuucccccaucucugggcccuggagagcccagcugucuucugggggcucuugagguccagacgcuggaccuaucuccugccccuucucacccuuaccggauccagucucuggcagcgaccagcaguauccccucagggccaaggagaagccagaagccacccuggacuucugccaacugcucccaucaucacccgacauuucccgaccgacugugucaggaaucaacccccuggagaugaaucagagugacugcauuuuuuuucuucauuucugauagaaauugcaagggaagcagcagccccugaucauuggcagggccagccagaggccuggccguggcguugcguggggccggucccccccagggcucuguagaauggguugcugucuaccccagccaucagcauuuagugagcauggccuuugagacucugcaagcacuuuuaccucccccaggcucucccugaaucucgaacuagccugagaccacugcaggcagauauagagagagcaguguuuucacacugcaggccucugccucuucgugggucaugaauucaauuagaggguugccaccaacacuuucaaaaaggaauagcgaaaucaccuggcaucgcccagagccagggcgaggauugcuccaugaaacuuuuuuuccgguugucuguaugucaguaucugcauccucaucugguugcaaggugcaauguauuucuuacuguggguggcagucaaaaacauuugcaagccacugguaucgauguugaaagcaggcccagaggggcugaggagugacuugcccaaggucacucagcagugucucacggggcuccugacuucccuuccagcucaggaaugggccagaggugccgcaggguagggcgggguggggcugagcaggugcucaacguggggaaccuggcggcacccugugccaugccgugacaaaggccuuccagagcccaaccucucacuguccacucccuuccgcagccucggaccccugggcucucugcccugccccgucccaccuggguggagcccaggacagucacaggccuuucuuucguacuccaccagggagucuuucauccucaccacagggugcgggaagaggaaguggccacagccaccuucccagggcagccugaggccaagagccacagccugcaguagagggugcacacuugggcucccuguggcccugggacauggcugagucucuuugucugagucugagugggcauuugccugagcauguguguguagugagugccucugugucugugcaugccugugucuggucccgugugugcaugugugguguaugcaugugugugcauguguguggaucugcuuguacuguuugcuuugugugacagcgagcuagacggugcacaucucuggcugcuauugugaguucuccgugugguugugugagucugugugugugcgcacgcgugcgcgugugcccaugggcaugaagccagugcgacugugugucuggccuugugucugcaugaguuuguguaggacuguggaucccugggcacgacggcucggagaggggggaggccuaacccugggcgugcacgcaugcguuucugagccuccaggccugcgugugccccggcgugugucuccaacaaucccugcuccucacccuccagcccccgccccugggaaccauguggcagccucacgucacaggggccaccagcagcuggcuuccucccuaccccgccccagccccccgcuccacaacgcccuggccacccugacucuuggcacagggacaaagcugaugucagaggcgagcugacagcuuucuucucccacuggauuuuccaaaagagagagaccacagcggccccuauuaaauaaucauggggcugggggguaaaggagggacgugucacucaaugauuuccuggacucagaggccauaaacagaacaggaagcagcccgaggaccuauucagccugaaacuggccgugcagaggugugggccuggccuccucuccuuccccucccccagccaagcucacuggggccacccugacccgacccagcacccaggggagccugaggauuguucugaggauugugggugggagggugaugggagccuccggucuggcgacagugaugacauggaaagaauaaaguggucccaucccacuggguggggaggauggaggggugagaccuggcugagguuggacuauccucuucccugggaagagaaggaagagugagcuuccuggggugaggggagggauggggccgggugggggagccgcugguggaaccugggauuggaggggccaggcuucccucugugucuugcaacggggucguaauaccugucccccaccaguccugcacccuugggucccccuagaccuccaggacccucccagcccggaguagugcccuucuuggggcacaggcccccaaggcuuucauaagccucucucccacccccuccccacaaaaccaagcauuaccaagugcucaccagaacccgcuaugggcucaaacccuaacccgcauucucugagggaggcauuuuaaacuucauuugacagacucggaaacugaggcucacagaguggaaugauuugucccaggucacacaguguguaauggagccaggucuccaccccagcccccuacccccagccucccuaaaacaggacccgggaggcccagguguggucugagcagccaggcccaggggggguccccacagagucacuccccaggcagccccuccugccuggaccaggccgcccaguggcugauaagccacaggacugcaugacacaaucccgcucugaucuucugcccagccgagccucugcccccaccccaccccuggacccuguuuccaucuccucccuuucugggugggaccaacgccccggccuggugucauucauggugggcuguccagagagccagcuucucugugaaccucucagcuguugaggucuccccaaaguccacccuagccagagggcuggcagcaggagaccccugcagagggaggacaguggccugugccacccccaccugccgggugggggugggggacuuagggcccaucuuggccccugcuggccucagcauccccacuugguaaaggaaaagcucggagaagagaugaggcugcgccguggaggggaggaggcuaagugggcucuggaaucagccagaccccagguccaggcccaccuuggccacuuacgaacugugcagccucgggcagguggccucaucgcucaggccucaguuccaacguccacaaaaugggguaacaguguugucaaccugugaggucagcaauguccucugcaaaggcuggccagcauggaaaacauggcuugguuauugauauugcuauuguuugagacagggucucauucuguugcccaggcuggagugcaguagugccaccauagcucacugcagccucaaucacccccgcucaagcaauccuccugccucagccucccaaagugcugggauuacaggcaugagccacugcaccaggcuguguuauugauauuaucuuagcuguggggcccagagaggggaagucgcuuuuccaaggccacacagcaaauuaguggcacauucccaguaguauguggacuaguggccucucuugaacucccagacagagagcuaggaacccuggguuucaguccugauuugcuugugagaauuccagaaggaagcuucucagagucucaguuucccuuucuagauaaguccaugagucccaaagugucuagaaaagguucuuuggggccgggcacgguggcucacgccuguaaucccagcacuuugggaagccgaggugggcagaucaccugagguugggaguucgagaccagccugaccaacauggagaaaccccaucucuacuaaaaauacaaaauuagcugggcauggugguacaugccuguaaucucagcuacucgggaggcugaggcaggagaaucgcuugaacccaggagguggagguugcggugagcugagaucacaccauugcacuccgucucaaaaaaaaaaaaaaaaaaagagggaaaaaaaagaaagaaagaaaagagaaaaagaaaagguuaucugaagaguggcuuguggggagcaguggugggggauagagagagagacccagguccccaggaaagcugggcccagggcuaggggagaguccagguccagggcucccagaccagcauaugaaagacacccaaucaccuagcccggcuccaaaccacgggcugcagcgccccccacugcccagcgggcagcaggcccugcggccacggccccgccagccccaggccagccugcagccggggccuccccuagagcuaggcgggauggcauuuggggauuugaggaagugagccgggaugccugagacucagaauggagagugggcagauacaggccaaggcuggagaagggggcaccacugagggggucuuggaggagccuaugccauguccagcaccuccuggggaagcccugaggaccggccacaagggggugccaggaccacgugccucugccuggcggagccucugggaggaggaagaggaggaagggggagaagaauuucucuccuggcccugcugccgcgucccacuucccucagacuuccaggacguccucucuccccagcccccauuuacagguccucaugacaauucuuccaaaugggaauuacaaucaccguuuuacagaggagacaauuaagacccacagagguaaaguaaaccaaguaaaccagggacacguggggcagagcccagguccccacccugccccagcgugccagggaaccccagcauccagacccaggacuggcccaccccggagacaguuucccuauccccucggaagccucuccccaggucucgggaguugcugauagcaagauuggggucgagccccuuucccucucaugccaggcucugugcaaggauuuuaccuauauuuuuccuuucucgccacagugaucccauaauuagauccauuuuacacagugagugaggcacagugcagucaaguccugcacuggcccaaggccaaaagcacaggggccuugaacuugacugaccacacacgcuggagccuccuauacaggaaccaccucuccaucagaaggaaaccgaggucuucaugggcuggguccccuguacugcucuggggaaaagagaacuugagggucccuugggaauccaggacucaaaacucccagaugacugaccccuccagggucccaaacagccaggauucaaauccaggccuccuuccagccaccauguccagagcucucuccucugcccuuuaacccuuugaugcucuuuaaacccucacauguccacaugacacuuucgcauccguucucuccugcuuagccucaacauccucagagagauguucggggcuuaucucaccauguccauugcauagaaggggaaacugaggccuggagcgugugugggccaccagaucucccccugacccacaagggagugagugauauuugcuuugguggaggauaaauuuggaggcuggccucuacccccggcccugccccugggagaagccuaccguggucugugccugcacacgccgcuccggaucuggaagguuugccaggucuucagugggacaccaucgucuuccgggccaggcccccucugcuucccucuccugcuggaucuucucuggagucggcuccucaccccgcccccaacuugacuucccguccagagcuggguggcccugacgcuacccccacuuccaccccccaccuccaguugaagggcugggggcaguaggugcagagggcccuggguucccacccagucugugccugacacagguuggggcagggucuugggagccaaggggagaagcagggccgg

SEQ ID NO: 16486 - RNA, 7443 nt, Homo sapiens
uguuccaauaaagcuuuguuuacaaaaacaggcagcuggauggauuuagcaaaucaaaauucaggacauccaguuaaacuugaacuuuaguguccuguauuuuaucugcaaccauagccugguggguagcggugugcagaucccuaggcauaacuggauuggugugaaccucgcaguaacaggaaagaaagcugccauuuuggaaugcuccacaguacgggaacaccgggcagagugucuuccuuauauuagcccaucugucuucccagcagcccugugagaugagacacaggguccacacuuugcauacgaggaaauggggacacagagaagaaaaaucaggaguccugguucccauagccggucagggacagaaccaggacccacacccagggcagucuggcucuaaagccugaauccucuuacaccagcuucacuucacgaaaaccaaggcucagagaggugaagggaugcguccagagagcacagcaagggggaggcugccugagaccaggaggaaaggccuccuagcuuccugcccacugagcuuuccaggggcugcccaaggcuucugugugugaacuugcaguucucauuggccucuugggcugucccgcgagugugugcaaguguguuugcacacauauaugcacacaaacaggaucggaguccgaggagccccacagucaguuucaagggagauggcucuuguucuugucuucuucuucuucuuuuuuuuuuuuuuuugagacggagucucccucuguugcuaggcuggagugcacuggcaugaucucaacucacugcaacccccgccucccggguucaagcgauucuccugucucagccugccgaguagcugggacuacagguacgcgccaccacacccagcuaauuuuuguauuuuuacuagagaugggguuucaccauguuggccaggauggucucaaucucuugaccucgugacccaucugccucggccucccaaagugcugggauuacaggcaugagccaccgugccagccgucuucuuuaucaccauagucggagagcaggugagaugcugagaggugguagguuaauugauggauuccuuugaccagggcuucucagccucggcacagcugacauuuugggccaaaugauucuuggcggcaggagggggcuguccugugcauugaggcauguuuagcagcacccguggccuccacucucucgaugccagcagcaccucaccaguuaugcaagacaaccaaaaccgucucggggcaucgcaaaauguccccuggaggcaagaucgucucugaccgagaacuauugauuuugacucccugagguuugaacauccucaagggcucaccagggaaccugcacucauccucugcucuggaggccacgaacuuccccaggccguuggcaaagacauucugggcacccaaaaugguaccaggcauuaucgggaaacccuaaaaagcagaaggaaggguuaguuucggccaagcaguaauaaaaaucucugugagcacagaacgaacacuagcugaugcagccugcuguuccguagacagcaaacgaugcucgaagccagagguccccgaaccugccugugcacggggucaccccgggagcuuguucuuuucauggacccaaguggacucuggagggugguccuggaaucugccuuuuccauguuucuuccuucccccacucagcucuguuuccacccagcaggugcuuggggucaaauccugaagaccccuuggagggaaccaagugguggccccagagcugccagcaggggaggugguuuggagaaaggacuuggggugcaugaauccugccacguggguggcugacuuccuugcgucaggcuggucugguggagacaaugaccucaccugcuuggaagagcccuuggcggcugcuuggaucuggggucggggaggggucccgagggccagacagagaggagcuugggggcugaguacaccuccccccggccuggcugcagcccagcguggcugccuguggucuggcccgggagcgagggacagaccucccccauggcuggcacccgcucagcggccucuucccaaccacgguggggaaagggaaaggggcugacguggggcugaccucacgcccggcucccccuccuccagugccucccucggggguucccugcugcugggaagcuggaccuccugugggaggagugggggaggggaggcaagcagagaaugcgggaggcugaacugaguggggggcucuggaggcugggguuggggagacagaaagaccccccacacauuucuguacuuucucugcagccuccaagagaucugggguuccccuuacuccauguggaagggcuuaugagaguuuuagaggugaucaagaauggacagcccuaugggcagcauaggaggaggcagacugggcacugacauucagcugcugcccggccugcuuacccagccucgcgggcaucuucacaucugcuucuuacaauggcuaucaugggacagaugaggaaacugaggcacagagaauuucagaaacuugccuaagcucccacagcuggaaaaaauaaagccaggauucaaauccaagcaugucagagcccuggcccugugcuggguacugcacaccagcucucaucugaugaaaugaacaauguccugagaaucgcagugaaacgcagauuccaaaccagcagucugaaguggggccaagauuccguauuuuggccaggcaugguggcucgcgccucuuaucccagcacuuugggaugucauggugggaaaaucauuugaagccaggaguuugagagcagccugggcaacauagugagacccugucucuacaaaaauaaguuagccaggcucaguggugugcaccuauaguccuagguacuuggaaggcugagaugggaagaucaccugagcucaggaguucaaggcugcagugagcuauaauugugucacugaacucuagccuggaugacagagcgagacccagucucuaaaauaaaaaagaacaaaaaauguucugcaucucuaagcucccagagguguagacacaacuggccugugcuccauucauuuuaccuaguguagccuggcacgggcauuuaauaaauggaaacuguuauugcuauuuccuacauaaaguauauaucauguguucugugcauaguaggggccaauaaacaguagguccuugugaaacaugauccuauaaagagagucuggugaauucuagagcccaguagaaaccuacgauuagccggguaaaguggcucacgccuguaaucccagcacuuugggaggccaguguccagcagaucacuugaggucaggaguuugagaccagccuagccaacauggcaaaaccccgucucuacuaaaaauacaaaauuagccaggggugguggugcaugccuguagucccagcuacuugggaggcugaggcacgagaaucacuugaacccaggagguggagguugcagugagccaagaucacacgauugcacuccagccugggcaacacagugagacccugucuccaaaaaaaaaaaaaaaaaaaaaaaaaaaaaaccuacaauuggaguucagauggacuuaggagagucaaaccugaaagaggcaaagagcacuugaaggaugaggugacauuugaacaggaccuugaaggaucagaauuuucuccauagcaaaggaaaaagggcagucuagacaaaaguucugugacauuuaacagaccuccaagcuaccacuauggccugagggaagugguugugagggaggugagcccagagguuccguugaacagaacaagcuacaugcuuuguaaaauggaaaugccaggucgcugguugaaaaaccauuaagaauuccugcaugagggcccugggcagcugcccagacugugcacacaugaacuuagccuugaagcugggaacuaggucuacaaggaggaguuggccuuaccccgucagcagcuuaagcaggaauuuuaaaggcuuuugaaguaagcagaugguucggucagacuggaaggcucaaggcagggggaugggucugaaggcuguugcagcagcacaggcugaguccaggacacagaggagggaauagcccgagccacauggaggcugauuuggacacauuugguccagguggcauauaggccuuggaaagauauggguguguucgugucccaaggcugccuaacacauuaccacaaaccgaguggcuuaaaacaauagacauuuauucucucacaguucuggaggccaaaagucagaaaucaaagggucaguagggcugugcucccuccaaggcucugagggaggagccuucccugucuuccagcuuuugguggcccuaagccuuccuugacuugcugccuaucacuccaaucucagccccugucuucacguggccuucuccucuucucuccuuucuuagucucuuaugacacuugucccugcauuuagggcucacccagaaauccaggaugaucucgcuucgagauccuuaacugaauuacgucugcaaagauuguuuuuccaaauaaggucacguucuggggauuaagacucagcuauaucuuuucuggggggccaccauccaaccgccuacagugggaagugcagguaaggcuccuguuugagacagggcagggaaagcagggaggggaggaggcugagaguucuggacccacgggcugucagugccugggccuugccuauggcacacuucucaucuaucugcaaagaaagguccuucagggaaauggggaguguuccagcuggcucgcugggagguggggccugagugagugugccaggaaagagccugcugacagguagugcccaucccggcuuugauucauuggccgucugggcaggagcuggaccgaucagcuaggaauuacaaaaaugcuucgcacauauuuuccucucgcuggugguuuucugcuugguuaaccccugcugggcccccaaucccauugcucgucugugucugcggcuguggcucuuucucugcaucucacccgcccccagccccagacacucucuucacauccccuccccucucccccagucacugacucuuggcuggagugggcagggcuugaccacguccucauaauugaaauuuuuggccccaaagcaggguggugcuuccccaagucaaagggauggacucaagcugaggccucugcuagggcaggaggaggcuugagaaauguccuggaugccaaagccagugaccaggaaaaggcuuuuugccugggucccagaggauccaaguggccuuguaaugaggcagauuuaaggccacugauccccaauuuccugccccaaucauguugccuuccuuccugcccccaccucauggcauuugcagacucuucccagagggaggaaguccuucaucaauaaaaaggguuuuaaacuacuggaguuaaggcagaagcuucugaggcuucugcuccaccuucaaaaguccacccucagucaggcuaaagccccaguuugugccugugucauccuggccccuuuuaggacccguuucauuggacugugucuuagccauuucgguugcuguaacagaauaucgcagacuggguaauuuaaagaaaagaaguuuauuucacucacaguucuggaggcugggaagugcaaaaacguggcaccagcaucuggugaggaacuuuuugccgcaucauaacacggcagaagacgucacaugaugagagcuggugugcacuuuaggucuggccuuucuuccucuucuucuagccaccaguccccaucaugagggcccaacacugauaaucuuaucuaaucccaacuaccucccaaagggcccaccaccaaucaacacacggauuuggggauuggguuuccaacacaugaaauuugggggacacauucaaaucauagcaagcuucacuggaugucgggcgccagcuuuugcaaagauggcugcagaaaccgcccuccaaaaauccacaugccugugcagaaggcuguggcuggaggagagggcaucacaacaccccuguccccccauaagucuccagggagaaauucccuuucgaaaccagucccaggacaggcucugcuuucccugagacuccucuuuuuugauuaugagaaucacauaagaagaucacauuuccauuuuccuuucggcugccaggaaucucagauccaacuuugaagcucagccauggcaauuauguggccccuugugaucugaaacauuuauuuucuuucuuucuguggucuuaguuuucucacucuguuuauaucuucucucaucccgauucucuauuuuaucagcauuuucauuagguaccuucugcuauaagcugcuuuacaugcuguuuggaauaaagaggauuguaaauagggaaauaaauacaucgugguuccauuaugauguuaauauuuauugcugaaaaugugauuguuuagcaaaauaaaugaauucccauucugcauugucuuugaauuucgaacagagguuacccgggagacucucuuucuucugcuaggaaccauugagcuccuguagaucuaacgccuggugcauagaaggccuugccagucuugaccaggugaguggaugguguugaccauaaagaugagaaaacaucaacagcaucucucacaagcugagugacgucaggguacccucugccucccugggccucaguuuccuuaugugaaauagaaggaguaacccagccaaagccucacugagugguugggaggaucucgugaugggugagaagaugcuuugugaacugcaagauguagggccucgcagagcccaugggcauauguauccuguggguagcuguuggcaguuguucucuugggaucgggggaaggguggugccauguccuguugaacuccugagagcuggcugggcaggagggcugccccgcuggcucuaccacacgccuggggucagggggccucucucuccaggcauccucuggaccugagacucaaguuaccaugaggggaucagucagcuacuaggacuuuugucugccaggcucgcccccuccccauccaccuggcccuggccuugaacucaggacugucagaauccucccuuccacauucacugggagagaguggccccuuccccugcaaagagggcaccaggugucugagacgcauucugcuuggaccaucuccacccuuggaggagcgggauucacgaggcauuucuaugucccuacuuguaauuccuucggacaaccuugugaaguagauaagauggcauucaucacugaugauucuugcaauuuucaagauaagacagcugagcucaugaaaagggucacgggacugcaucggggagcgccaggcccaggauccuggccggccgcaggggcagggccuucccagcaaa

SEQ ID NO: 16487 - RNA, 2806 nt, Homo sapiens
auuuaagaauggaauuacuggcuuagaagccaaaguugacuguaauaucuccaacucuggcuccuguuuugaaaaccagaauucuuuggaaguuaauggaaaacucaaaauagcagauucugccuuugggguguuugcagagggcuuugaaguggucucaaauuacugacaagugaagaucagguagaguuaacaaagcaaccaauguagaagcaggucucaagggcaauucacauuuauuuccugagcaugcugacuaaacauacuucaaacacagcagaagguaaagagucuguuuuguaaguaaagccguuucuugccaacagcgaauggugguccaugaagaguaccuugagcaucaucuucaagcugaggcuccagcucugggcaaacagcugcuggguggaccugguccuucuggccuggaugggggccuccaaggaacuacuuguucucauacuugugcuugauguguuuccacagcuucugcauuuuaaagacaagagccacaaacuuugaccuuugccucucacauuuuacaacuacucccacugcccuggucucuaaaaugagcuugggggaaacacaugccauguccugauuaaaaagauacacuuguggugggcaaacucgaagcaauccuaugcuugaugcacauuuuuuuuuugagacggagacucgcucuaucgcccaggcuggaguguaguggcgcaaucucggcucacugcaaccucagccucuuggguucgagcgauucuccugccucagcuucaagagcagcugggaauacagguaugcgcuacccggcuaauuuuuguauuuuuaguagagaugggguuucgccauguuggccaagcuggucucaaacuccugaccucaagugaucugccugccuuggccucccaaagcgcugggaugacaggugugagccaccgcgccgagccuucaugcauaauucuuggcauuuauaaaauacuaugaugcuuucaaucaccaggugaaguaaguggaaaggggugaucuuaauuucacaggaaauucaguuugagauugagggaagugccccaaaacacacaauuauuaaggaaaacagccuggaagaugucucaguucuucaacucccagguauuacugaagagauuauaagugcguagucccaaaauauuucaccaugagccauuuaagacauuuccugggaccuaaauuggcugaaauucucauucccagaagcacaagagguugagcacaguggcucacgccuguaaucccaguacuuuagaaggcuaaggcaggaggacugccugagcucaggaauucaagaccagccugggcaacauggugaaaccccaucucuacaaaaaauacaaaaauuagcugggcgugguggcgcaugccuguggucccagcuacucaggaggcugaggugggaagaucacuugaacccaggaggucaaggcugcagugagcugugaucaugccacugcacuccaaccugggcgacagagugagauccugucucaaaaaaacaaaacaaaacaaaaaaaagcacaaggaaaaugggugaguuauaacaacauacuuggaugucucuccagaucaaugggagugguuaacagaaccacuugcaagagaugggacaguagcaaugcuuucauauggggcaggaaguugcacuggucacaggcagcauagcacuaguggacagugccuucccgggcugcagagucagacagucucaaauuaaaaacacaagugagugguggaacagggcuauauguauaaggccuacuccagcacagucauaauuuagcgauauaaagcaugcacugcaccuagcacagugcaugauacauaaaagucaaaaauguguugcgauuccuaccucaugcuuccacuuucuccugaggaauguaagcaaugauuauuuuucagugguaccaccuaccaggcauguggcacccugccugcaucucauguaauccucacaaucgugcucagguuacuauuaauaucuccaucucacaguuaaaacggaguucagagaagaaacuugcucaacuuaaugccacaguuaagugacaaggaccaguguuccuauccaaggcuuucugauuucauagcccccacucucaaccauuaauaccaacugucuacgugggaagccuuggggaccagaagcgccgucugaaacuucagccacggcgucuaaggugucuaacguccuuuucacgaccgucgccugcucaaaucugcccuugaaacucugagagacaggggucccguuucuggcccugacuugccccuggcuuccugugcagcuaguaaguccuuugcucucacuagccuuuaguuuuugcuucugauaaugggcaaguggguauguaggguggcacacagcaauacuuacaaccccugcaaaaugaaauauauuaaccucgcuuaacguuuuagaauucacaucaagccaaggggacagacggcggacucgagacagaagacgccgacgguuuaccccuuacccccuuccugguaaaaguauacugagucccaucccaccucuacuccacugucaccccucaggcggguccaaggucagggauggcacaggcccucacccccucguugauguggucguagauagcguccgcgccuugaucgaaggcgcgcucgaagaacaugacgcccacgaugauggugagggcgaagguggagguccugcggaacagcagggaguacaauuucgaagucaacgucgcggccgccauguuucuucacaguccaacucgcgccaccgcgccugcgcugg

SEQ ID NO: 16488 - RNA, 518 nt, Homo sapiens
gucccguuucuggcccugacuugccccuggcuuccugugcagcuaguaaguccuuugcucucacuagccuuuaguuuuugcuucugauaaugggcaaguggguauguaggguggcacacagcaauacuuacaaccccugcaaaaugaaauauauuaaccucgcuuaacguuuuagaauucacaucaagccaaggggacagacggcggacucgagacagaagacgccgacgguuuaccccuuacccccuuccugguaaaaguauacugagucccaucccaccucuacuccacugucaccccucaggcggguccaaggucagggauggcacaggcccucacccccucguugauguggucguagauagcguccgcgccuugaucgaaggcgcgcucgaagaacaugacgcccacgaugauggugagggcgaagguggagguccugcggaacagcagggaguacaauuucgaagucaacgucgcggccgccauguuucuucacaguccaacucgcgccaccg

SEQ ID NO: 16489 - RNA, 9550 nt, Homo sapiens
cgagcggagaggcggcuacagccugagcgccgggccgguagcggccgcgccggcgagcggacuagcgggcggcgagcagcgcggagcgcgcggggcaccgaggagcgggcgcggcgggcaccgcgcgaggcagccggagcucucggaaaggccagagcggcgccgcccccgcugccccugcggggccccggcugggagcccgacgagggagcgggcggcauggcccggcggcccggggcgcgggggcgcuaggcccccggaggggcguccccagccucgccgcugccgccgccgcccuccgcagccgcgcgccccgcccgcuccagccgcccccggggccgccaccggcccaugagccccggccucaaaguuugcggcgggcgggcgggcgcggagccuccaagaugccguuccacccggugacggcggcguugauguaccggggcaucuacaccgugcccaaccugcugucggagcagcgcccgguggacaucccggaggacgagcuggagggugaguguccgccgggauccccgccccggcggcccuccuaccugugcgcccaggugaagcgcgggccaggggcgcgggggcggggggcggggggcgguccgcaggugccgguugccaggugggcgccccagcuagcagcugugccccgcggcaagaccuguccgcaccccggggcgccgcggugggggucgcucaggcggagagcggcccagccccugcccgcgugguccccagcgcugcggaaacuugccgggccccgcagcggggucacggggccgcgcagucggcggugacggugcggcaacgcggcggacuggggcggggguccgcgcugagcccccagcgccggcccggccggagcacccgcauccugauccccuccgcggcgcccgcccgcggcucucugcucgcauugacauuccgcucgugucgcuuuaaaaauucaaucugcucgggcagcagcagaaggggagagggcgacugcccugcucuugcccgcugcggggccgcccccguccccaccugcggccguagccccuucccugcagcccugcggggacccccagcccggcgcgccgggaaggcggcccgggaggcgguggcgacaacaaguggccggacugggcggcuaagucgcgauagccaagccuggaagggaaaggcagagaggccaggacccaaacccgcccccaccccguucccccugccucucagacucgcagggggauggcaggccgcuggcugggcgaggucagagcagagggcaggggcagggguccgggacaguguguccugaggagcagugagaccccuggggcccgcccagcuccuucccugcugggcugggggaggugcugagguuuccccuccccccagaccuccuggagcccccauauggaguggagugggggaucugggcugaugggggucacggccuccugggaucugcaugucugcuguugcaaggggcugagcucacccagaggaugggccucucgggguaccuuggauccaggggucucugagaucuggaggcucauuagggccugggagggugcagccaagaccagcacagucagggaggauggugggagcccaggggaagccauggagggagguccucccucaacccaggcccagggugagggcagaucuuagaggagucagaaugggucgggggaagauccagagagagaaggcagccucugccucgcucacugcaccauaggcaugagccaccaggcuccucaccaacugccccugcaaacccucagaagcggggagagcuguggagacagggucuggggucugaugcggacaggacagauggaugauuggggccccccgacaugaccucaccauucaccccuaaaacccagggccagagccuccuccagagcccggggaaaggagggguacgaugguggggggcgaaaggucaggagauggagcauaggccuucuccuccccaccuuuguccccuccggcccugggccaccucaaaccuccugcagauuuuucccuccagaggcccucauccauccccuccuccugaccauccaagcaggagucaccaugucucccagaccccaggcagcuuccgcuucacucccuccccuugcucccagcacccccaccaggaccccaccaccccaacuccagcccuuucugggucccuccucuccugauccccaguccuggagugcacucccugaggaaggggagaggcugagaggcuggcugcaggggcgaggggccgcagggugggcagugcaggggcaaggccgcaggcuccccaaccaacgacauggcgugcuggcaggagcccagcugcguuagucaccagccacaacaagugcccuccccgcuucucuccuguccccuucuccugggcccuggggagcugaggggcccugacucagggggcaucugaagggcagggcccucccugggaugggcagguggggucauggaguagacagaugccuggguggucccagcucaucucuggcccagugggcagcuacagaugaaggcaagaaguuuuccaugaccagcccccuucuuggcugcaggugcccuaaaagcccucuggcggccccaggucccuuucagcaguccuugaaugccagggcuggccauuccuggcacggaucccccucugcccucuccgccucugcagggccucaugagugcuccugccccagggcggucugggcgagacccaggcccucugccgggaggacgccauucgcggaggagccacaugugccaggaagagggagcugggcagcccgggauggaaugcugcagacaguacgugccugccgcagaaauccagggggcggucagucugagcggaaaggaggaccaggcagggaggugggaagcacagaguuaagaugagggcuucccagccaggcggcgcuggguuugagucucugcaccuucagcucauggagugaccuugggcaaucgcucaccucucugagccuugguuuccccaccuauaaaaggggggcuggugauggaggaugcagugaaaguaccuaccuagcacagggggcucagggacccagaugcaacaugaggggaggcccugcggggguaagaggcuggagcgugcagggcccaggcccgugagggugugcaggaggcugagccagaagggcaggcuggcagggagagcuggguggaaaaggccuugaaggucuggaaaaggucucuggggaccuguggcccuggggaggcauggagggcaguuggcaggguaggaauguggcugcacagagcuggccugaggcccacccaggcccugugagggacaggcacggacucucuuagauccccucugugugcccaccauggcugggacauacaccuuuuccaacauacacacacagcagaguccuccaggaacacugaggcuggucccagcaccaucagcugacucgagcacccaagggugggaaugggguggcugcaagucuuagcccuuucuggccgaagagaggaggaaggagucagaccuccaggcagacaguccccaggguagggcucuggggcugacacuuggccugcccagucugugaguggagccuucauugagaguggccaaaugggggccuuuagggcaggggaggcuggggaguccccuuuccuaccucucugcccugcaaggccaggagccgccucugcacagccaaaagcucagggaggccagagugguggggcacggggccagugccacggagaguagcagccacugcggaggauggacacuacccucuucagugaccuccagccagugccugcccucuggacucuggcugccugauggagugcggaugucccuuggagucugcuggggacuugggcccugaugaaacuccacagguugagaaggacauugggggauguuaggcuggagguggcagguagggggcaggucagccuggaaaccugguggcccugccagcccauugccagcauccucaugccaagaugguacccgucaggcuacccuuggccuuacgggacgggaagggagcaaggcuuucggggaaaugcacccagcuguggggugcugauggcacaacgguggcaggaaaucacgacaccugccccacucagggagcccccggcagaggccgggcuucagugauggugccggagucgcuccccauuucacagaugagacacccgaggcuuagagagggacgugacuugcccaggccacugggcugcuaagcaggauagccagaauccaagcccaggccucuggucccagcgaccgccaacaggaaagguggccuggugucccaagcucacucaguccucccucuucuucuggcucugcuaucugggacauucugauuuauagcauccaucucugagccaggaccagccagacacaugcuugauuuuauugcuuaaucaucccagcagccccauuguacaggugagcaaauaccugcccaaggucacccugccaggauguaggagagcugggacuugaccuugggucucugccacuucaggcugccucccuggcugggaagguggugccugaacccggccucugugggcgggugggagucggcuggggcagggcucccagcacaggcaaaggcaccaaggugagacuuugugguguguuggaugugccaaggagggguguuaaagggacucaugcauggggagguggcaguguguggauuuaccuaguggccugggaagguaagccuugccugagaaaaggcugcugggccugcagggcugccucccagcuuaucgccugcccgugcaucccaauauucaccugccuuccccuggcuccccucggcccagugcguuuucucagggucuccagcaaagggacucaggggcuccagcaaagcagcccugggcucugggagcucccgaaggguaggagggaugaccuggagcucagcucacagcaggcaggggaggggguggcucccacugcauccccuacugugaguccaggacuuugccaucccucccugacaucucccaggcaggacccugcagaggaggaaagggaggaggaggagcggugccugacccugguccuccuuccccacaccaccgucuggcccccacucgucuucagcuugaggccccucuuccacggguggcccgcaggcagguggggauggcauccuugggggcuggaaaagggaucaagcagccuccucagccucccugucugcuucucggcugcuuggggaguggaaaugaacguguccccuaaccaggauuguucgugggcucugaguagcggcuucacagcaagcgguaugugaacugcugcucagaagagccagagaacugcgugcuucagauggaugggcuccccacaucagucauucauucauuucaucauucauucagcaaauguuuaugcucgaagaggcaggccccguuccaggcaacagggacacagccacgaacaagaccagccccucccugcugucauggcccuuguagugcacaauccagcguggcccaugcaaggauggggcaagagcagggccugugggggcccagaggagggccagagcuggccaguggggaacagggagggcaccagggagauggugccguucaagcugagagcugggguugugucgggguuugccacggcgagcagaagagcacuucaggcaaaaugggcugcguguucaaaggacuggagauggagcaguccugguacccacaggaccgagagggccccuagccuggauggaguucaggacaccuggggugggcagaacauguggccgggcgaggaggccagcagugcuggccggaaaccuaagcgugugugugcagaugccuccagcucuaccuagaggcucuagggaccggaauccccucagcagccuccguggcugacaggccucagcucacacauccccugugacggggagcucaccaccucuuugguggcccaggaaagcuccaggugggaauuggccuggaguucccagaguccaggguuugcagaauccuguggcccuggcacagaccuccccgcccagaugcuucccuggccccggggccauugguuaggagacgagauucccagguccuggugggaugagugaaggggaaguccagagucagaaagucugggggcccaggcaaccccggugcacaugugagccugucugacccucaggccuuggguguggacaccagugggauaagccugauaaggguggggccuccgcccaagccaccucgaaguguggccugggacauguggccauccucuccgggccauggccccuagucuguggugagaccaacaggcugggcuaggcuccccugucccccgagacuagggaaugacuccaaagugcaagguccuaugagcaguuucaggguucauggaccccuuaaggcaaggccugggccagcccaagcaacagcagcucugagcccacgcugacucugggccggccgcuggggcucucucagccuguuucuggucugcagcacggagcaccucgcgugucucuacuuuuaaacacacagauacacacccucucucacaugaggagauugauucugccugcugaaagcuaaaaguccacccaggggaacagcuuaggcaaaggccagguggcuggcaagcaaacaaggagacccccgggagccggagagagcaucgagccccgccccccacucccaaaggcaaaugcuguuuagggcccugcuggggcugugaugauuaagggacagcagcccuuaaaaacagagaaacagaagagacagcaguacagcuaaggugacaggugaggacccccucaacugugugccagggaguccccaccaucauucugcccauuucacuguggguaaaacugaggcuggcccaaggucacagguuggguugcuuguuccccgggcucccagcgcagugcauugcucaccaccugagucaccgaggucaucaggccucggucuucugcuccguacaguguggagggcgaccccccacccagucuggucuggccuggaccuggaggggggcuccuucccccucugucuucccugaaccaaaagaggucugugccgccugucagcccauuagucuggagcaagcugccucacguggcugccauuagcaaguguuggccgguguuaaggaucuaaggauccgagccugggggaggaggcgcagcgggauggagauggugggggagagggggaugaaaggaaugggggcggguggggaagccgucagcagccgcgggggccggggagauccagcauccuccccugcacgugguccccaccacacggggucguugugagcacaccaggagaggcugugagagccuggcgcaaucagaucccaagaggucacugcuggggggccuugagcccugcuuuacugcccugcucagccugcccagaggucccagaauacggcacccuugugcacccucgggccaugcucucaccagaucugcaggcucuggguugggcucucaaggccaugcucaggcugcagggucggugauccugggggucuggaaagggggucuguuggggaccggggugaagucccagccuacuccauucucuccucagagauccgagaggccuucaagguguuugaccgugacggcaauggcuucaucuccaagcaggagcugggcacagccaugcgcucacuggguuacaugcccaacgagguggagcuggaggucaucauccagcggcuggacauggauggugagcacccccccgccucgguuuccccaccuggcaucugggcccuggggguggggcaggggcuggggccugagcugcugaggcugcauccaaauugggucucucgcuccccugacucccacccucaaaguccguggcagguugcagcccggucuggccccauuucucagccuggagaauugaggccagagagguagugacagucccagccacaugcagggcucagagauggcuccuuucacucuguguugagaaguuuuaaaguacagagaaguaaaaggaugcaauaaauacuccaguucccaccaccugagauaaaaugacuacuugaguuguguuugccaccuggcauuuuauuaaggaaaaguucauaaggaauagugaugccaagcccccucuuuaucccacccgggcccuucuucuccucuucuccauccagaggccaggugacagccuuggcagguugccccacucugagcuucaguuccugucuauaugguggaggauggcccaccccaggauggccgcagggugcugggagcaacggaggguucugggugaaauaggagggucacggcccaccugcugucuaccuccaccuccccuuguaaggccucaucacacuggguggcuucagcgucagcccagagccuggcacuugguagaugccccugacacugacucaaggcucagagaaggcgggcaccugccuaaggccacccgguaggcccaagguguaucaagacuccaucccaggaccucugggcccugggcugcaggccugggcccuacccacugauugauuggaccugugccuccaccaggugauggucaaguggacuuugaggaguuugugacccuucugggacccaaacucuccaccucagggaucccagagaaguuccauggcaccgacuuugauacugucuucuggaagguauccccuggcuaguugggacccagggcugugcacacuguggaguucuguucuggagccagugaauggcugggcccacacuguaaaggggggaugaccacuucaggcuuguguccacuggacauuucaccucucagagggccaugggcucccuggggaggccgguguuggucaaggacucucugggggaauggagcaaguguuuuccagccccccagaaucuagaggccugucaccgggucuguauggccguggggugcugggugggggcugcgguggcucucagagcaccguguugucccccuccgcaagugcgacaugcagaagcugacgguggaugagcugaagcggcugcucuacgacaccuucugcgagcaccuguccaugaaggacauagagaacaucaucaugacggaggaggagagccaccugggcacagccgaggagugucccguggauguggagagugaguggcuggcccuggaaccccacgggugggcccagugacuuggccagggggacgcacgggguggggagagucugcagaggggggcugggggccuccuugccuguccuaagccucugucccauuggggcaccccaugggaugagcccaugugccgaagggcaggcggcuccugacuccaucgcuuugauguccccuucugucuccccggugcucccggcgggcggccacagccugcuccaaccagcagauccgccagacuugcgugcgcaagagucucaucugcgccuucgccaucgccuucaucaucagugucaugcucauugcggccaaccaggugcugcgcaguggcaugaaguaga

SEQ ID NO: 16490 - RNA, 15802 nt, Homo sapiens
ggugucacauccagaccuccccugcccugcccccagccuucccagggaaagagaauaacagcagcaacauuuucauuuuauaagcacuugguuuuauugcacagaagcaauugaaagugaacuccaguggaaagugcgcccuggcauaauucaguggccaguccccggccccaccuggaccgcucuuccagaauagagagcucugggcaagggcuugaccacuccuuuggaaaacagaaggcauuugggaauagguuaagacaucucaagcauaauguauuucuaacugcucauucauuauugcggucaucugucaguugcacauagaggcaauaaaugcacuuauuuggaaaggaggggggcaguuuuuauagucaaguguuuacguguggcauucggcauguaucacauucagcuacauaagcuaucauaauuguccaucgccuggggagggccugggggcaggggccugggagugcccucucuugcuaacauauugcuaacagaaauuccuguuugaagaaggaggccccgucaucuaagcaguuucuucuuacauaaagacagaaaaagugaaaauuguguuacucugauccuugagcuccgggacucuucugaguuucuuuggcuguuccggauguuccuuucucccugccuuacuuccccuuggcggccuugucuucuguggccuucucuggaggcuugcugucuuuuuggucugugcuggaggauuuuucagccuuuucugccuuaggcuugcuaggcucuuuugagagggucuugucaucuuccuuggcuuuggccucugucuuggguuucuccucaggcuucuuggccuucuccuccuuggugucuuuuuucuccggugcugccuccuucuucucugcugguuugcuggguuccuuggccuuggcaucaucugguuccuucuuggcuaccucugucuuuucuuuggguuuagcgucuuccuucaccuccaccuuggcaggagccuccuucucugggguggggacuuuuuucuuaucuucagccucuuccuucuuggcuucaacuuuggauucuuugggcuuuucgacagcagguuccuucuucuccuccaccuugggcuuuggagccuccuucuugggugccuccucuuucuugcuguccuucuucuccucuguuuuugguguggcaggggcuuucucuuccucugccuucuuugggggcucuuugacuuucaccuccuggggcuucuccuccuccuucacuggggacuucaccucuuccuuuuuugggaucuccuucucaggggccuuggcauccuccuucaggggagauuucgccuucucuggggacuugaccuccuccuugacagggcuuuuggccuuuucagggaauuugucugcaggggaccuugcuuccuccuucgcuggagucuuggcuucuggagacuucacaucaagagucuuggccuucucuggggacuuggccuucucuggggacuuagcuucuuccuucacuggggacuuggccuucucgggggucuuugcuucuuccuucacuggggacuuggccuucucaggggacuuugcuucuuccuucacuggggacuuggccuucucaggggacuuugcuucuuccuucacuggggacuuggccuucucaggggacuuugcuucugccuucacuggggacuuggccuucucaggggacuuugcuucugccuucacuggggacuuggccuucucaggggacuuggccucuuccuucucuggggacuuggccuucucaggggacuuugcuuccuccuucguuggagacuuggccuuuuccggggacuugaccucagcuggagauuuugcuucuuccuucacuggggacuuggccucagccggugacuuugcuucuuccuucacuggggacuuggccuucucuggagacuuggccucagccggugacuuugccucuuccuuugcuggggacuuggccuucucgggggacuugaccucagcuggagauuuugcuuccuccuucucuggggacuuggccucaggcggugacuuugccucuuccuuugcuggagacuuggccuucucaggggacuugacuucggcuggggauuuugcuuccuccuucucuggggacuuggccucagccggugacuuugccucuuccuuuacuggugacuuggcuuccuucucuggggaugcagccucuucugcugggggagacuuuguuucuucuucucccccuucugccuccucuucuucacccccuucuuccuccuugcccuccuccucuuuggccucuuucuccucuucuucagucacuucuucagucacuugggucuccucugucuguuccuccacaaucacaguuucuuucucagacuucuccaccacuuugaucuucucuucgcuuuucaccuuuaugugaguggacacagagggaauuuuggggaguccuucuggaagcgagaaaggaauugggccaaagccaauccgacacucuucaccuuccaggaguuuucugcaggauggaucacggaacacauuaguauaaacucagggcaaauucacuauuuggguucuuccuagacuauccugaaggucacugacaucgaaugauauggguuuugguggaacaggaaugugaauggugggcauuaugagacuagagaaagucacuuggcaaaucauuccagugaccacccagaauguguaccccggugggacuggucuuuuuuuguugauguuguuguuuuugagagggucucacuguguugcccaggcuggaacagcuggucuucuucaacacagcuaagccugaaacuuuugaaauaaaacaacuuuugccccauaaaaaauggcccucaagagaaagcuccuaaauaaauuuaacaaaaguuaaauuuauugucccucaaacuaaaauauuauucaagagaacccugggagccugagcaaacaauuccacuuuuuuuuuuccuuuuuuugagacggagucuugcucugucaccuaggcuggaguccagugguacaaucucaguucacugcaaccucugccucccagauucaagcaauucccccagcuucaagcaauucuccugucucagccuacugaguagcugggaguacaggcgcacgccaccacguccaguuaauuuuuguauuuuuaguagagacggggguuucaccauauuggucaggcuggucucgaacuccugaccucagccgauccacccgccuaggccucccaaagugcugggauuacaggugugagccaccgcacccgaccacaauucuacuuuuauaaauuuggguuuaagaggucuuagaacgcucccauuugaaucgcgagugucucucaucacccuguauuaccaucuuuugaguuucaggaauaggguagaggccgcaguuucuccucuuggcuuugcuccucacuagaugggugaccuuggccaagacacaccaacucuuugagccucaauuuccucacuggaaaaagagggucauuagagucccuacgucagaggguuguuucagugagacaaugaauggaaaagacuuggcagaaugcuugucucagaguaaguguggggguuaccccucagacuaguacuucccaaauuuagcagcacacagaugaccggggaucuuaucaaaaugcagauucugauucagcaggucuggggaggggcugagcgucugucuuuuguuguuguuguguuguuguuauuuuugagacagugucucacucugugaugacaggcuggagugcaguggcacgaucauagcucacugaagccuccaacucccaggcucaggugauccucccacgucagccuccugaguagcugagacuaaaggcaugugccaccaugcccagcuauuuuuuuuuuuuuuguauuuuuuguagagaugggguuuugccaugcugcccagcuuggucucugaacugaaacaaucugucugccuuggucucccaaagugcugggauuacaggcaugagucacuacacccaaccaagagacuaucuuucugauaagcucuugaaugaugccaauucugcugguucaugugccaugcuuugaguagcaagauuacagacgagagccaagagguaggaagccacaggucaccagucagaacugggacaaguccucagggaaucaguccugcucccuagcccugcuccccccggucuuauuccucagacuggauuucucaaggcugccacugacuaaggguucccucuguagcagcccagugguaccugugcuuccuggauuagcuugggaaugggauuagcucaucuuccugacaacccuaugacaugguugcccuuauuaucaucuccacuuuauauccccaagaaaugaaugcuugcagagcuaagaaacucuaaaggacagaguuugaaaggucccugacucaagcaccucuuuucccuucaaagcaggccucuggcuggcuggaucuggggaggggauaaggaacuuccaccgucuaaaucauuucagaaugaaaguaagucacucucaagacucauuggcugggcacaguggcucacgccuguaaucccagcacuuugggaggccgagguaggcggaucaccugaggucaggaguucgagaccagccuggccaacauagcgagacccagucucuacuaaaaauacaaaaaauagcugggugugguggcaugugccuguaaucccagcuacucgggaggcugaggcaggagaaucacuugaacucaggacacagagguugcagugagccgagauaaugcugcugcacuccagccugggcaacagagugagauuccaucucaaaaaaaaaaaaaaaaaaaaagacucaugucucucagaguaaaagaguggcugccaggggcugaaggaaggagagaaugauaaugacgguuucuuggguauggaguuucaguuugcgaugaugaaaacaguucuggagacagacagugguuauggcugcacaguaaugugaaaguacuuaauaucacugaacugccuacuuaacauuguugaauggggcuggucaugguggcucucgccuguaaucccaggacuuugggaggcugaggugggcagagggcuugaguucaggaguuugagaccagccuggccaacauggugaaacccuguuucuacuaaaaaaaaaaaaauaaaaauuagccaggcgugguggcgggcacguguaaucccaguuacucaggaggcugaggcaugggaaucgcuugaacccaggagggagaggcugcagugggcagagaucgcaccaccauacuucaaccugggcaacacaguaagucugucucaaaaaauaaauaaaaaauaaaagaaauugguucaaugguaaauuguauguuuugucuauuuugccgcaauuuaaaaagaauuuugucccuaagacagguaggcugccuaaacggggucuugaaacccaaggcuuagcgucucgcaggaacacaagcuuucuucaccaugugacagccccugugcgucucaccuguaagcggcuaucucuauauccagagccaucuugacauugagcagguccugguauucucgcagcugggcggccaucucccacuugguguuccucagcucagcguccagcugcugaauggcuuccugggaaggagaggugacacacaucacaugccagccagugucuggcccucaguaccagagaagcugcggcgggcugugcgaccccagagcaggcccauccagccaggcucacuggggccaaccccaacccugccagagcuguaggguccucauuaguggacguggaacaaucuggagcaaaaauccugcuguauagugaccucagacuggagaaggucugaaaugaaauucaucagaugucaacaguuguuccugcugguuuggcuggcaggauaaugggauaacauuuagagaucuugagcuuagaaagugcucagugaggccgggagugguggcucaagccuguauucccaacacuuugggaagcugaggaggguggaucacuugaggucaggaguuugagacuagccuggccaacaugguaaaacccugucucuacuaaaaauacaaaaauuagcgggaugugguggcacauaccuguaaucccagcuacuugggaggcugagacaggagaauugcuugaacccaggagucggagguuacagugagccaagaucauaccacuguacuccagccugggagacauagcgagacucuggugguucaugccuguaaucccagcauuuuggaaggcugaggaaggaggaucacuucagcccaggaguuugagaccagccugggcaacacagugagaccucauuucuacaaaacaauuaaauaauuagcugggcauggugaugugcaccuauagucccagcuacucaggaagcugagggaggaggauuacuugagcccggaaguacaagacuuuagugagcuaugaucucgcugucacauucuggcuugggcaacagcgugagacugugucucaaaaaagaaaaaaaaaaaaacccagugggagcagggccuugccugcuuuugcuccugucuuucuccagugugccacaguguccaccacacagucaggguuugguaggcauugaugacugccucagccuucugaguagcuaggacuguaggcacacacaaccauacccagcuaauuuuuuuaauuuuuuuaaauuuucuugagacagagucucgcucugucgcucugucgcccaggcugggugcaguggcacgaucucggcucacuguaacccccaucucccagguucaguugaagcgauucuccugucucagccucccaaguagcugggauuacaggcacgcaccaccaugcccaguuaauuuuuguaucuuuuuaguagagacaggguuucaccauguuggccaggcuggucucaaacuccugaccucaagugauccacccgccuuggccuccuaaagugcugggauuacaggcaugagccacuaggcccagccgccaguuaucuuuaaaagaaggaaucugcuaaggucuuccccuggccacccaagacacugguugcuguuuacagaauguccacugcgaccaagaccaaccuagugaguggcagagcugggauucaaaucuagaaagauucgaauguugaagaccuugccgagcucauucacaaguucacacuaaucucauuuaaaguauaucucuuuaggccaggcacggugccucacaccuguaaucccagcacuuugggaggcugaagugggaggauugccugagcccaggaguuugagaccagccuggccaacauggugaaacccugucaauacuaaaaauacaaaaguuagccaggugugguggcaugcaccuguaguccccgcuacucgggaggcugaggcacgagaaucucuugagcccaggaggcagagguugcagugagcugagaucaugccacugcacuccagccugggcaacagagugagacuccaucucaaaauaaauaaauaaauaaauaaauaaauaaauaaauaaaagucuaucucuuuaaucuuuccagcucugcaaagcaggcuuuuuuuuuuuuuuuuuuuucauggcuggaaaggaacucagauucagagaauuagauaacuuuccuagggucacacagcuggaaagugcugguaugucugacuccaagggccacaaucuuaaccacuacaaccccacucagugagggacaguaacuuguccagggcuacccaaucagguaaggcagucuggcugucugccuugccccugcccaccugguaggaggcaaugucggccugaugacgguccuccagcucagagcgcugccucuccagugaguccuuggugcuuuucagugccuccagcucugugguccuggccugcagcugacgccgguacucaguuaucuccuccugcgcugagcgcauagcgucuguguucaccuuggcugccuccgacagucgguccagccucacugggggagaagguagcagggcacaggguuagacacaccuggacuggguucuaaugcccagauuuuuuucuuuguucuuuuucuuuuuuuuuuuuuuugagacggauucucgcucucgcccaggcuggagggcaguggugcacucucagcucgcugcaagcuccgccuccuggguucaagcgauucuccugccucagccucccgaguagcugggauuacaggcaccugccacuacgcccagcuaauuuuuuguauuuuuaguagagaugggguuuugccacauucgccaggcggucuugaacuccugaccucaugauucgcccaccucggccucccaaagagcuggaauuacaggugugagccaccacgcccggccuaaugcccagauuuugaaggugacacauguggauugaccuacugcgugugccagacaccauccuguaugcuugacucacucuguccugugagauaaaggcaagugacuacuccccaaggccacccagcuagugaguggcagagcugggacucaaauccccaaagaucaugcucugucucccccagugugggauccaaaaacccugcagggcagaggaaacccugguccuaaugccugguccagcucccuagcaagggccuggcagugcuggugguucagaugugauaccuggcccauggggcuuaacacugagcuggaggcugcagguuuguggcugaacaaguuaaugagcuugugaccuuuaggaggcaugaggguaccgugagcaaucaggucaccuuguagccauggucccuuccuuacagguuucugcgcacaguccaaggucagugcagagcccguggccugggugccaaccccugucccuuucuccaccuagcugagcauugccccugagcauugguagccacaccccggcccccgccagcaacccgcucgugguucccaggaaaccuuccagaggcaguggaggucuggagacuggucuuuagcucguaaaagugaacauccugaauccccagauaguggcacucagggcacaagucuuggcggggaggaaggaagccagcugagugggccaguacaauccugggacgucugccccuacgacuggcaaacccaaaagagguuugcgcagggaggggccuugcugcggagauggaggaggggaugguucugcucugcagaggaguggaaaaggaacagaaaaagcuaugcaucaaaaucccagcuuucccugcuagugcuggcaaagacuuagaaaccauccaggugguuggagauucucaacuauugucgaucacagaugcuuuuggaaaaucacugaagccucugcccucucucucaaaaacaacgcaaaguuuuacagacaguuucgugagacaucauggaacuccccggauuaagcagcccaguugaucuacccuccucuuucaacucaaaaagaaaugaaaaccagagagggcaaguguuggucaaggucacccugcagcugcugggcacagccucagggcagcgcaaucuagcugacucagggcugcaaggaguugggggaggggcagacuugggaggcucccagcuucccuaaaggagaaaggggacauuaaaacaugaaagggcccaccagccaccuccgccacaggcaacaacugacuguaguaaugguucccucuaggaagaaaggaugcgaaaagguccugacccacccccacguggaagauuuaagguaggaacguuaagcacugagcagguagugggaaggagccugguaggggugagaggaauagaguuucuugcgggguguaggagagggcauggcagcauuggcggggaagccuugcuacuuagaagggcuaagagucuccagcgcuugcagaccagaauccugcaccacuuuuuuccuguagaggaaacuuguuuuuuucuugacgggggagggaucucagaguggggucgccuaagcuugggguagagagcagcagggggcccagaguugaaguacagccguaaagaaccuggaaagggggaaccgaaggacaacccagaguuggggcgucccacaagagacccagaguaaaacugcgauuuaacuaggggcaugcacuuugcagagggaaggugagcagcgcgccacuccacgcgcaguccggcagcgcccccuugggucacgcagcccaaaaguucgcugcggggucagcaggggcgccccuccccccacccgcgcgccugcguaccucggaaccacuccucggacugcagcgugcucugcaccgcguggccuucaagcugcgcgcgaaucucgcgcagcgccgacgucacgucgcacuucagggcgucgcgcgucucggccugcaucugcgccugcgcggcgccggagcccuggaucuggccgagcagcucgcccaccucuuccuggugguggcgccgcagguagccgcacuccuccugcagcgccugcgccuucuucugcagguccacgcgcgccgccucggccuccugcgcgaagcgcgccagcgcgcgggccgccgccucggccuccucucgcugccgggccucgucgucuaggcgcuggcgcacgugcgcgauguccucgagcaggugcuccugcuccaggcguagcugaccgcgcgccgcgcccaggcgcagcaccgcgccgcgcaucucgcggaccucgcgcucguacagcucgcccauagcggagcggcccgccugcugcugccgcagcgccgcagccucgcccuccaggcugcgguugugcgccuccagcugccgcaccuugucgauguacccggcgaagcggucguucagcgccugcagcugcuccuucucacugcgugagguggccaccgccaccaugcagcccuccggcccguugcucagcguguccagcgagucggugcuugaggcggcgccugcgccacggaagcggcugggcgaggcggacacggagcucacggacguccguguccacgaguggaagccgcuggaggagccagcggcggagcgcgucccgccugcgccacccuuucgggcuagcgcguaguggaggcugccgccgccaugcagcggcgcgaacggggcgcccagcagcgcguccgcgccgccgaagcucaucauggccugagcaggugcgcgaggccgggacggggcgggaggcacugcggcagcaccagggcgccggcccuuuuauagccgccgcggccggguccaaccccuuggcagugagaggguggggaggagggccccgcccucuccgccuccuccccugcggccccccggccgaccggcuccgccgcagugagaggggcggggcaggggaccgaggagggaaggggaaucgacgcugcgucagaggagacccucgaggucggggaagcgggcagaggacucccggagugggccagugaggacccccgggugcgcgucggaagagccugcgaguguguucggaauaagaaaggggacuugaaacagggagaggacaaggagaaaccugaugggaauaggggcaggaugcccucgggauggagcaauggaagauugcagucauuaggaugaggggaucccuguaugagacaggacacgaggcuuuccaaauaguuaagagaggcuuucaggauagggggugcagagacugugcagccagccccggaacagaggagggagcaaggcaguccugaaugggagcauggacgcuccauagaacggagacaggagaccccugaccgggggagguacaguguucuccuaacaucuagaggacccacuuggagagcgcucaggaaacuccgcggccagccccggaauagaugaagggggaccuggaguuggggagaauagcaaggcuacccugaauggggguaugggagacacugcagaggauggagagagggaaccccggaugggugggguuggggggaggcaaggcguucucuaaaaagucugcaguggcccccgagagaggagaugggagacccugcugccagccccaguaaaggggacggacccucagcgaagcgggcagaagguccccugaacaggcaggagaaagcugggcugaguuugaggggcagagaaccuacaguggggguaccguaggagggcuugggcaugaaguugagagagcuggccccugugugggguggggggaaaugaugggugucacccgagccagcuucugcacacuggggucagcuaggcaguuugcuggucgaaugaccuuggacaagcuguguccucccacccuuguuuuuccaucuguacaacgaaggggucuugccccagagacaagcuccaacuccugacccccgacugccccaggaaguuccacuuugaggggucucuggcugaacuggggauggggaacccacaucuugccguucugucaacacuaggaaguccucuuuucucccucccccuccccaucuucucagccucaacuuguccucucuucccccacuccuguaacagacaagcaggcgccugagucggcaucccuucucucuuacagggaagugaugagaugcuuucugaguaccaaagucccucaccccaauaggaugucagguagaagaagggguccccaggauuuagggggcccugcaacggcugugacauuuggcucuuuauugguuuuggcucauguuuuaugcugugggaguggggguggugcugcggcuggcgcuucagcaccggggacagggccugcucuuuguugggcguggggcggggaaagagauuaacccucugcuuuuacuuuaggggaaggaagggagggacacugugcugaggggacccgagaggggaggcaagugauccagcagggucacauagugagccagggaccccucccuggacuuccugucggggguccaguuccguguuuucugggcuguuccccuccugcuuagggaccccugcgaaaggaccccuggggaugcugggagcccugagacgcccuugagaguuuguagacucguacuuccacucugaaccucccccaggcaguuaucucaacacccacuacaccccuacuuuacgcggguuuuccugcuccaggauccccaggacagaacagacauaucccccaggaaagaccucugccaguuccuuucucuuugcccucugucuccuuccagcccccuaguucuaagcagacccucagagcugggaaauugauggcgcugucccuuuaaccacuuuuuacuggaaggagagugcgcugggaggagggaagagggggagggaguuucugguuuugcaugaagcagcagaacaugaugaagcauuuuucccccaucuaaagauccagucgugcuccaguuugcagagggcaaggggcugguugcagguggugcugggaggauggaggugaguggcuggucugaggucccugagaaaggcauggggcggguguugggcaggacucccuugcucucagauggcuccccauuuauuugucauucuacuuggaauuuugccauuggagccuuguuccucugggucuuuucagucugcacaaugcugauacauucucuggaugugagaaggcucacaagcagcugacagcaaggaggaauggggguuugggguaaaaagggggcuccaagauguauucuguugaggccaaggggccacagccaucagauugaagcugccuauguaguccaagaagccccaagcaugacucuuguggcuggagaaaauggcaugagggcuggagcccugaggucaguucccccaaaggacccuucaggcucaccuccagaaagccaucccuggccgccuucacccccacauuuaguuaauuguccccuccuggugguucccaugguucccagugcuaaucucuaaugcugcucuuaccacucugugguguguaaaugaaucaaugaaugaauaaguuccgucuguuuuccagccaaacuuguggucuggaggggcugugaaugguucugcccugaguccuuggggcucgaaucgcuuucacuuuccucccugugauucuuaccauuuggaagugaguagaacgauauauucaucuaucuauccauccauccauccauccacccgcaguucuuggaguuaucuucccaaagccuggacuuggcagugagcauugugaaucucccagaggcaaguagagugugcugaguuucccaaacuuaacugcucuugggcccuucuuguccccaagugucuccaggacaaggguccaguggcucacacugaaaggcacacugagauuugggucucagccccugcugucccugggcuuuuguggaccccaaggcuggugcucuucaggaacauacuugcagggugaaggauaaagcaguaggcgcuuaaacagccaccagccucgcugcuacucacuguucacucggcagggaucauugucccuauuuuauaggcaaguagacugagacccgagugaggaaguggguugccugaguugacucagugacacagcagagcccagugucucaacucauccagaccugagcuggcacaggacacaggguggaaacuuguuucucuugcauaguagaggccuagauggucugaggguagaggauugagaggccuucagagaggggaugggcagcuuucuggggcugggguuggggucuggccucugacagaucacccaucugugagucucuguggcccaugacccaacaucagcauagccuguaugugagaaccuacuucccggccuggguacccucugacacugugucaccucugugggagcuacaugugaccacuguuugaggugcagaugcuaaauuccucguucucuuuuccugcuuguuuuuucuccauaggacuugacguuuucugacaugcuacuaugcaucuucuccacuaaauagaacuucaucaggacagggauuuuuguuuguuuuauucacugcugacaucuccagugcucggaauauugucuggcauauagugggugcguagcaaauaguuucaggaugacugcgaggcucugccugagaggcccgugaucacccagacauuuuagcacugggcaucuggacaguuccaggcccuagggaggcugcccgcagguugacuggagaaggaggucuugaaaguguggcccccauccuggggccugaagccucccagcccgagcuguguaguccccuuugcugaggcucaaccuugcuggcuuuguugucugcagacucacccugcuccugcacagccuguuccuuuuuauguucagcaauuccuuuuaggaagugcugagccuuucuucuugcuuccuuuccccgugaauguccgucaugucccacauucuccgucucuccucuugccccucucuccacugcauucccuuccuucucccucuauuauaucccucccucuuuccccccaauuucucuguccucuuuauuccuccccuuuuccuuccucucccuccuuuuuucuccucucccuccuuagagaugccgucuuuuugccgcguuugaaucugauuuauaauaaaagggcggcagucuccccaugucuacuccguuuaggacacagacagcaaaaaacuaaacugugugcaguuuugcauaagccucccccuccuagcuuccacccacagccuuaacccccagggaccagccaccgcagacucaggccugcagcaggucugccugccugccugcccgcccaucugccgcccugggacugcaccaggugggaagcuggauucuaccccaaaggccaggaacugguggauggggucacagguccacccuaucuccccugcucuaguuccugcugugggagauuauggaugaaugauucuugggcu

SEQ ID NO: 16491 - RNA, 15802 nt, Homo sapiens
agcccaagaaucauucauccauaaucucccacagcaggaacuagagcaggggagauaggguggaccugugaccccauccaccaguuccuggccuuugggguagaauccagcuucccaccuggugcagucccagggcggcagaugggcgggcaggcaggcaggcagaccugcugcaggccugagucugcgguggcuggucccuggggguuaaggcuguggguggaagcuaggagggggaggcuuaugcaaaacugcacacaguuuaguuuuuugcugucuguguccuaaacggaguagacauggggagacugccgcccuuuuauuauaaaucagauucaaacgcggcaaaaagacggcaucucuaaggagggagaggagaaaaaaggagggagaggaaggaaaaggggaggaauaaagaggacagagaaauuggggggaaagagggagggauauaauagagggagaaggaagggaaugcaguggagagaggggcaagaggagagacggagaaugugggacaugacggacauucacggggaaaggaagcaagaagaaaggcucagcacuuccuaaaaggaauugcugaacauaaaaaggaacaggcugugcaggagcagggugagucugcagacaacaaagccagcaagguugagccucagcaaaggggacuacacagcucgggcugggaggcuucaggccccaggaugggggccacacuuucaagaccuccuucuccagucaaccugcgggcagccucccuagggccuggaacuguccagaugcccagugcuaaaaugucugggugaucacgggccucucaggcagagccucgcagucauccugaaacuauuugcuacgcacccacuauaugccagacaauauuccgagcacuggagaugucagcagugaauaaaacaaacaaaaaucccuguccugaugaaguucuauuuaguggagaagaugcauaguagcaugucagaaaacgucaaguccuauggagaaaaaacaagcaggaaaagagaacgaggaauuuagcaucugcaccucaaacaguggucacauguagcucccacagaggugacacagugucagaggguacccaggccgggaaguagguucucacauacaggcuaugcugauguugggucaugggccacagagacucacagaugggugaucugucagaggccagaccccaaccccagccccagaaagcugcccauccccucucugaaggccucucaauccucuacccucagaccaucuaggccucuacuaugcaagagaaacaaguuuccacccuguguccugugccagcucaggucuggaugaguugagacacugggcucugcugugucacugagucaacucaggcaacccacuuccucacucgggucucagucuacuugccuauaaaauagggacaaugaucccugccgagugaacagugaguagcagcgaggcugguggcuguuuaagcgccuacugcuuuauccuucacccugcaaguauguuccugaagagcaccagccuugggguccacaaaagcccagggacagcaggggcugagacccaaaucucagugugccuuucagugugagccacuggacccuuguccuggagacacuuggggacaagaagggcccaagagcaguuaaguuugggaaacucagcacacucuacuugccucugggagauucacaaugcucacugccaaguccaggcuuugggaagauaacuccaagaacugcggguggauggauggauggauggauagauagaugaauauaucguucuacucacuuccaaaugguaagaaucacagggaggaaagugaaagcgauucgagccccaaggacucagggcagaaccauucacagccccuccagaccacaaguuuggcuggaaaacagacggaacuuauucauucauugauucauuuacacaccacagagugguaagagcagcauuagagauuagcacugggaaccaugggaaccaccaggaggggacaauuaacuaaaugugggggugaaggcggccagggauggcuuucuggaggugagccugaaggguccuuugggggaacugaccucagggcuccagcccucaugccauuuucuccagccacaagagucaugcuuggggcuucuuggacuacauaggcagcuucaaucugauggcuguggccccuuggccucaacagaauacaucuuggagcccccuuuuuaccccaaacccccauuccuccuugcugucagcugcuugugagccuucucacauccagagaauguaucagcauugugcagacugaaaagacccagaggaacaaggcuccaauggcaaaauuccaaguagaaugacaaauaaauggggagccaucugagagcaagggaguccugcccaacacccgccccaugccuuucucagggaccucagaccagccacucaccuccauccucccagcaccaccugcaaccagccccuugcccucugcaaacuggagcacgacuggaucuuuagaugggggaaaaaugcuucaucauguucugcugcuucaugcaaaaccagaaacucccucccccucuucccuccucccagcgcacucuccuuccaguaaaaagugguuaaagggacagcgccaucaauuucccagcucugagggucugcuuagaacuagggggcuggaaggagacagagggcaaagagaaaggaacuggcagaggucuuuccugggggauaugucuguucuguccuggggauccuggagcaggaaaacccgcguaaaguagggguguaguggguguugagauaacugccugggggagguucagaguggaaguacgagucuacaaacucucaagggcgucucagggcucccagcauccccagggguccuuucgcaggggucccuaagcaggaggggaacagcccagaaaacacggaacuggacccccgacaggaaguccagggaggggucccuggcucacuaugugacccugcuggaucacuugccuccccucucggguccccucagcacagugucccucccuuccuuccccuaaaguaaaagcagaggguuaaucucuuuccccgccccacgcccaacaaagagcaggcccuguccccggugcugaagcgccagccgcagcaccacccccacucccacagcauaaaacaugagccaaaaccaauaaagagccaaaugucacagccguugcagggcccccuaaauccuggggaccccuucuucuaccugacauccuauuggggugagggacuuugguacucagaaagcaucucaucacuucccuguaagagagaagggaugccgacucaggcgccugcuugucuguuacaggagugggggaagagaggacaaguugaggcugagaagauggggagggggagggagaaaagaggacuuccuaguguugacagaacggcaagauguggguuccccauccccaguucagccagagaccccucaaaguggaacuuccuggggcagucgggggucaggaguuggagcuugucucuggggcaagaccccuucguuguacagauggaaaaacaagggugggaggacacagcuuguccaaggucauucgaccagcaaacugccuagcugaccccagugugcagaagcuggcucgggugacacccaucauuuccccccaccccacacaggggccagcucucucaacuucaugcccaagcccuccuacgguacccccacuguagguucucugccccucaaacucagcccagcuuucuccugccuguucaggggaccuucugcccgcuucgcugaggguccguccccuuuacuggggcuggcagcagggucucccaucuccucucucgggggccacugcagacuuuuuagagaacgccuugccuccccccaaccccacccauccgggguucccucucuccauccucugcagugucucccauacccccauucaggguagccuugcuauucuccccaacuccaggucccccuucaucuauuccggggcuggccgcggaguuuccugagcgcucuccaaguggguccucuagauguuaggagaacacuguaccucccccggucaggggucuccugucuccguucuauggagcguccaugcucccauucaggacugccuugcucccuccucuguuccggggcuggcugcacagucucugcacccccuauccugaaagccucucuuaacuauuuggaaagccucguguccugucucauacagggauccccucauccuaaugacugcaaucuuccauugcuccaucccgagggcauccugccccuauucccaucagguuucuccuuguccucucccuguuucaaguccccuuucuuauuccgaacacacucgcaggcucuuccgacgcgcacccggggguccucacuggcccacuccgggaguccucugcccgcuuccccgaccucgagggucuccucugacgcagcgucgauuccccuucccuccucgguccccugccccgccccucucacugcggcggagccggucggccggggggccgcaggggaggaggcggagagggcggggcccuccuccccacccucucacugccaagggguuggacccggccgcggcggcuauaaaagggccggcgcccuggugcugccgcagugccucccgccccgucccggccucgcgcaccugcucaggccaugaugagcuucggcggcgcggacgcgcugcugggcgccccguucgcgccgcugcauggcggcggcagccuccacuacgcgcuagcccgaaaggguggcgcaggcgggacgcgcuccgccgcuggcuccuccagcggcuuccacucguggacacggacguccgugagcuccguguccgccucgcccagccgcuuccguggcgcaggcgccgccucaagcaccgacucgcuggacacgcugagcaacgggccggagggcugcaugguggcgguggccaccucacgcagugagaaggagcagcugcaggcgcugaacgaccgcuucgccggguacaucgacaaggugcggcagcuggaggcgcacaaccgcagccuggagggcgaggcugcggcgcugcggcagcagcaggcgggccgcuccgcuaugggcgagcuguacgagcgcgagguccgcgagaugcgcggcgcggugcugcgccugggcgcggcgcgcggucagcuacgccuggagcaggagcaccugcucgaggacaucgcgcacgugcgccagcgccuagacgacgaggcccggcagcgagaggaggccgaggcggcggcccgcgcgcuggcgcgcuucgcgcaggaggccgaggcggcgcgcguggaccugcagaagaaggcgcaggcgcugcaggaggagugcggcuaccugcggcgccaccaccaggaagaggugggcgagcugcucggccagauccagggcuccggcgccgcgcaggcgcagaugcaggccgagacgcgcgacgcccugaagugcgacgugacgucggcgcugcgcgagauucgcgcgcagcuugaaggccacgcggugcagagcacgcugcaguccgaggagugguuccgagguacgcaggcgcgcggguggggggaggggcgccccugcugaccccgcagcgaacuuuugggcugcgugacccaagggggcgcugccggacugcgcguggaguggcgcgcugcucaccuucccucugcaaagugcaugccccuaguuaaaucgcaguuuuacucugggucucuugugggacgccccaacucuggguuguccuucgguucccccuuuccagguucuuuacggcuguacuucaacucugggcccccugcugcucucuaccccaagcuuaggcgaccccacucugagaucccucccccgucaagaaaaaaacaaguuuccucuacaggaaaaaaguggugcaggauucuggucugcaagcgcuggagacucuuagcccuucuaaguagcaaggcuuccccgccaaugcugccaugcccucuccuacaccccgcaagaaacucuauuccucucaccccuaccaggcuccuucccacuaccugcucagugcuuaacguuccuaccuuaaaucuuccacgugggggugggucaggaccuuuucgcauccuuucuuccuagagggaaccauuacuacagucaguuguugccuguggcggagguggcuggugggcccuuucauguuuuaauguccccuuucuccuuuagggaagcugggagccucccaagucugccccucccccaacuccuugcagcccugagucagcuagauugcgcugcccugaggcugugcccagcagcugcagggugaccuugaccaacacuugcccucucugguuuucauuucuuuuugaguugaaagaggaggguagaucaacugggcugcuuaauccggggaguuccaugaugucucacgaaacugucuguaaaacuuugcguuguuuuugagagagagggcagaggcuucagugauuuuccaaaagcaucugugaucgacaauaguugagaaucuccaaccaccuggaugguuucuaagucuuugccagcacuagcagggaaagcugggauuuugaugcauagcuuuuucuguuccuuuuccacuccucugcagagcagaaccauccccuccuccaucuccgcagcaaggccccucccugcgcaaaccucuuuuggguuugccagucguaggggcagacgucccaggauuguacuggcccacucagcuggcuuccuuccuccccgccaagacuugugcccugagugccacuaucuggggauucaggauguucacuuuuacgagcuaaagaccagucuccagaccuccacugccucuggaagguuuccugggaaccacgagcggguugcuggcgggggccgggguguggcuaccaaugcucaggggcaaugcucagcuagguggagaaagggacagggguuggcacccaggccacgggcucugcacugaccuuggacugugcgcagaaaccuguaaggaagggaccauggcuacaaggugaccugauugcucacgguacccucaugccuccuaaaggucacaagcucauuaacuuguucagccacaaaccugcagccuccagcucaguguuaagccccaugggccagguaucacaucugaaccaccagcacugccaggcccuugcuagggagcuggaccaggcauuaggaccaggguuuccucugcccugcaggguuuuuggaucccacacugggggagacagagcaugaucuuuggggauuugagucccagcucugccacucacuagcuggguggccuuggggaguagucacuugccuuuaucucacaggacagagugagucaagcauacaggauggugucuggcacacgcaguaggucaauccacaugugucaccuucaaaaucugggcauuaggccgggcgugguggcucacaccuguaauuccagcucuuugggaggccgaggugggcgaaucaugaggucaggaguucaagaccgccuggcgaauguggcaaaaccccaucucuacuaaaaauacaaaaaauuagcugggcguaguggcaggugccuguaaucccagcuacucgggaggcugaggcaggagaaucgcuugaacccaggaggcggagcuugcagcgagcugagagugcaccacugcccuccagccugggcgagagcgagaauccgucucaaaaaaaaaaaaaaagaaaaagaacaaagaaaaaaaucugggcauuagaacccaguccaggugugucuaacccugugcccugcuaccuucucccccagugaggcuggaccgacugucggaggcagccaaggugaacacagacgcuaugcgcucagcgcaggaggagauaacugaguaccggcgucagcugcaggccaggaccacagagcuggaggcacugaaaagcaccaaggacucacuggagaggcagcgcucugagcuggaggaccgucaucaggccgacauugccuccuaccaggugggcaggggcaaggcagacagccagacugccuuaccugauuggguagcccuggacaaguuacugucccucacugagugggguuguagugguuaagauuguggcccuuggagucagacauaccagcacuuuccagcugugugacccuaggaaaguuaucuaauucucugaaucugaguuccuuuccagccaugaaaaaaaaaaaaaaaaaaaagccugcuuugcagagcuggaaagauuaaagagauagacuuuuauuuauuuauuuauuuauuuauuuauuuauuuauuuugagauggagucucacucuguugcccaggcuggagugcaguggcaugaucucagcucacugcaaccucugccuccugggcucaagagauucucgugccucagccucccgaguagcggggacuacaggugcaugccaccacaccuggcuaacuuuuguauuuuuaguauugacaggguuucaccauguuggccaggcuggucucaaacuccugggcucaggcaauccucccacuucagccucccaaagugcugggauuacaggugugaggcaccgugccuggccuaaagagauauacuuuaaaugagauuagugugaacuugugaaugagcucggcaaggucuucaacauucgaaucuuucuagauuugaaucccagcucugccacucacuagguuggucuuggucgcaguggacauucuguaaacagcaaccagugucuuggguggccaggggaagaccuuagcagauuccuucuuuuaaagauaacuggcggcugggccuaguggcucaugccuguaaucccagcacuuuaggaggccaaggcggguggaucacuugaggucaggaguuugagaccagccuggccaacauggugaaacccugucucuacuaaaaagauacaaaaauuaacugggcaugguggugcgugccuguaaucccagcuacuugggaggcugagacaggagaaucgcuucaacugaaccugggagauggggguuacagugagccgagaucgugccacugcacccagccugggcgacagagcgacagagcgagacucugucucaagaaaauuuaaaaaaauuaaaaaaauuagcuggguaugguugugugugccuacaguccuagcuacucagaaggcugaggcagucaucaaugccuaccaaacccugacugugugguggacacuguggcacacuggagaaagacaggagcaaaagcaggcaaggcccugcucccacuggguuuuuuuuuuuuucuuuuuugagacacagucucacgcuguugcccaagccagaaugugacagcgagaucauagcucacuaaagucuuguacuuccgggcucaaguaauccuccucccucagcuuccugaguagcugggacuauaggugcacaucaccaugcccagcuaauuauuuaauuguuuuguagaaaugaggucucacuguguugcccaggcuggucucaaacuccugggcugaagugauccuccuuccucagccuuccaaaaugcugggauuacaggcaugaaccaccagagucucgcuaugucucccaggcuggaguacagugguaugaucuuggcucacuguaaccuccgacuccuggguucaagcaauucuccugucucagccucccaaguagcugggauuacagguaugugccaccacaucccgcuaauuuuuguauuuuuaguagagacaggguuuuaccauguuggccaggcuagucucaaacuccugaccucaagugauccacccuccucagcuucccaaaguguugggaauacaggcuugagccaccacucccggccucacugagcacuuucuaagcucaagaucucuaaauguuaucccauuauccugccagccaaaccagcaggaacaacuguugacaucugaugaauuucauuucagaccuucuccagucugaggucacuauacagcaggauuuuugcuccagauuguuccacguccacuaaugaggacccuacagcucuggcaggguugggguuggccccagugagccuggcuggaugggccugcucuggggucgcacagcccgccgcagcuucucugguacugagggccagacacuggcuggcaugugaugugugucaccucuccuucccaggaagccauucagcagcuggacgcugagcugaggaacaccaagugggagauggccgcccagcugcgagaauaccaggaccugcucaaugucaagauggcucuggauauagagauagccgcuuacaggugagacgcacaggggcugucacauggugaagaaagcuuguguuccugcgagacgcuaagccuuggguuucaagaccccguuuaggcagccuaccugucuuagggacaaaauucuuuuuaaauugcggcaaaauagacaaaacauacaauuuaccauugaaccaauuucuuuuauuuuuuauuuauuuuuugagacagacuuacuguguugcccagguugaaguaugguggugcgaucucugcccacugcagccucucccuccuggguucaagcgauucccaugccucagccuccugaguaacugggauuacacgugcccgccaccacgccuggcuaauuuuuauuuuuuuuuuuuuaguagaaacaggguuucaccauguuggccaggcuggucucaaacuccugaacucaagcccucugcccaccucagccucccaaaguccugggauuacaggcgagagccaccaugaccagccccauucaacaauguuaaguaggcaguucagugauauuaaguacuuucacauuacugugcagccauaaccacugucugucuccagaacuguuuucaucaucgcaaacugaaacuccauacccaagaaaccgucauuaucauucucuccuuccuucagccccuggcagccacucuuuuacucugagagacaugagucuuuuuuuuuuuuuuuuuuuuugagauggaaucucacucuguugcccaggcuggagugcagcagcauuaucucggcucacugcaaccucuguguccugaguucaagugauucuccugccucagccucccgaguagcugggauuacaggcacaugccaccacacccagcuauuuuuuguauuuuuaguagagacugggucucgcuauguuggccaggcuggucucgaacuccugaccucaggugauccgccuaccucggccucccaaagugcugggauuacaggcgugagccacugugcccagccaaugagucuugagagugacuuacuuucauucugaaaugauuuagacgguggaaguuccuuauccccuccccagauccagccagccagaggccugcuuugaagggaaaagaggugcuugagucagggaccuuucaaacucuguccuuuagaguuucuuagcucugcaagcauucauuucuuggggauauaaaguggagaugauaauaagggcaaccaugucauaggguugucaggaagaugagcuaaucccauucccaagcuaauccaggaagcacagguaccacugggcugcuacagagggaacccuuagucaguggcagccuugagaaauccagucugaggaauaagaccggggggagcagggcuagggagcaggacugauucccugaggacuugucccaguucugacuggugaccuguggcuuccuaccucuuggcucucgucuguaaucuugcuacucaaagcauggcacaugaaccagcagaauuggcaucauucaagagcuuaucagaaagauagucucuugguuggguguagugacucaugccuguaaucccagcacuuugggagaccaaggcagacagauuguuucaguucagagaccaagcugggcagcauggcaaaaccccaucucuacaaaaaauacaaaaaaaaaaaaaauagcugggcaugguggcacaugccuuuagucucagcuacucaggaggcugacgugggaggaucaccugagccugggaguuggaggcuucagugagcuaugaucgugccacugcacuccagccugucaucacagagugagacacugucucaaaaauaacaacaacacaacaacaacaaaagacagacgcucagccccuccccagaccugcugaaucagaaucugcauuuugauaagauccccggucaucugugugcugcuaaauuugggaaguacuagucugagggguaacccccacacuuacucugagacaagcauucugccaagucuuuuccauucauugucucacugaaacaacccucugacguagggacucuaaugacccucuuuuuccagugaggaaauugaggcucaaagaguuggugugucuuggccaaggucacccaucuagugaggagcaaagccaagaggagaaacugcggccucuacccuauuccugaaacucaaaagaugguaauacagggugaugagagacacucgcgauucaaaugggagcguucuaagaccucuuaaacccaaauuuauaaaaguagaauuguggucgggugcgguggcucacaccuguaaucccagcacuuugggaggccuaggcggguggaucggcugaggucaggaguucgagaccagccugaccaauauggugaaacccccgucucuacuaaaaauacaaaaauuaacuggacgugguggcgugcgccuguacucccagcuacucaguaggcugagacaggagaauugcuugaagcugggggaauugcuugaaucugggaggcagagguugcagugaacugagauuguaccacuggacuccagccuaggugacagagcaagacuccgucucaaaaaaaggaaaaaaaaaaguggaauuguuugcucaggcucccaggguucucuugaauaauauuuuaguuugagggacaauaaauuuaacuuuuguuaaauuuauuuaggagcuuucucuugagggccauuuuuuauggggcaaaaguuguuuuauuucaaaaguuucaggcuuagcuguguugaagaagaccagcuguuccagccugggcaacacagugagacccucucaaaaacaacaacaucaacaaaaaaagaccagucccaccgggguacacauucuggguggucacuggaaugauuugccaagugacuuucucuagucucauaaugcccaccauucacauuccuguuccaccaaaacccauaucauucgaugucagugaccuucaggauagucuaggaagaacccaaauagugaauuugcccugaguuuauacuaauguguuccgugauccauccugcagaaaacuccuggaaggugaagagugucggauuggcuuuggcccaauuccuuucucgcuuccagaaggacuccccaaaauucccucuguguccacucacauaaaggugaaaagcgaagagaagaucaaagugguggagaagucugagaaagaaacugugauuguggaggaacagacagaggagacccaagugacugaagaagugacugaagaagaggagaaagaggccaaagaggaggagggcaaggaggaagaagggggugaagaagaggaggcagaagggggagaagaagaaacaaagucucccccagcagaagaggcugcauccccagagaaggaagccaagucaccaguaaaggaagaggcaaagucaccggcugaggccaaguccccagagaaggaggaagcaaaauccccagccgaagucaaguccccugagaaggccaagucuccagcaaaggaagaggcaaagucaccgccugaggccaaguccccagagaaggaggaagcaaaaucuccagcugaggucaagucccccgagaaggccaaguccccagcaaaggaagaggcaaagucaccggcugaggccaagucuccagagaaggccaaguccccagugaaggaagaagcaaagucaccggcugaggccaaguccccagugaaggaagaagcaaaaucuccagcugaggucaaguccccggaaaaggccaagucuccaacgaaggaggaagcaaaguccccugagaaggccaaguccccagagaaggaagaggccaaguccccugagaaggccaaguccccagugaaggcagaagcaaaguccccugagaaggccaaguccccagugaaggcagaagcaaaguccccugagaaggccaaguccccagugaaggaagaagcaaaguccccugagaaggccaaguccccagugaaggaagaagcaaaguccccugagaaggccaaguccccagugaaggaagaagcaaagacccccgagaaggccaaguccccagugaaggaagaagcuaaguccccagagaaggccaaguccccagagaaggccaagacucuugaugugaagucuccagaagccaagacuccagcgaaggaggaagcaagguccccugcagacaaauucccugaaaaggccaaaagcccugucaaggaggaggucaaguccccagagaaggcgaaaucuccccugaaggaggaugccaaggccccugagaaggagaucccaaaaaaggaagaggugaaguccccagugaaggaggaggagaagccccaggaggugaaagucaaagagcccccaaagaaggcagaggaagagaaagccccugccacaccaaaaacagaggagaagaaggacagcaagaaagaggaggcacccaagaaggaggcuccaaagcccaagguggaggagaagaaggaaccugcugucgaaaagcccaaagaauccaaaguugaagccaagaaggaagaggcugaagauaagaaaaaaguccccaccccagagaaggaggcuccugccaagguggaggugaaggaagacgcuaaacccaaagaaaagacagagguagccaagaaggaaccagaugaugccaaggccaaggaacccagcaaaccagcagagaagaaggaggcagcaccggagaaaaaagacaccaaggaggagaaggccaagaagccugaggagaaacccaagacagaggccaaagccaaggaagaugacaagacccucucaaaagagccuagcaagccuaaggcagaaaaggcugaaaaauccuccagcacagaccaaaaagacagcaagccuccagagaaggccacagaagacaaggccgccaaggggaaguaaggcagggagaaaggaacauccggaacagccaaagaaacucagaagagucccggagcucaaggaucagaguaacacaauuuucacuuuuucugucuuuauguaagaagaaacugcuuagaugacggggccuccuucuucaaacaggaauuucuguuagcaauauguuagcaagagagggcacucccaggccccugcccccaggcccuccccaggcgauggacaauuaugauagcuuauguagcugaaugugauacaugccgaaugccacacguaaacacuugacuauaaaaacugccccccuccuuuccaaauaagugcauuuauugccucuaugugcaacugacagaugaccgcaauaaugaaugagcaguuagaaauacauuaugcuugagaugucuuaaccuauucccaaaugccuucuguuuuccaaaggaguggucaagcccuugcccagagcucucuauucuggaagagcgguccagguggggccggggacuggccacugaauuaugccagggcgcacuuuccacuggaguucacuuucaauugcuucugugcaauaaaaccaagugcuuauaaaaugaaaauguugcugcuguuauucucuuucccugggaaggcugggggcagggcaggggaggucuggaugugacacc

SEQ ID NO: 16492 - RNA, 186956 nt, Homo sapiens
cagaugaaagggccgcggcgcgacggccgggggagccgagcugagccugcgacccacaaagccgccgccgccgccgccgugauggggcugugaggcguccgcccgcguucgguccucagccggcccgcgacuaugcccggccgcgcccgcccuccgcgcccucccgccgcaggaccaugaggccgcgcucgggcgggcgcccaggggccacgggccgccgccgccgccgccugcgccgccgcccccgcggccuccggugcagccgccugccgccgccgccgccgcugccgcugcugcucgggcugcugcuggcggccgcggggcccggcgcggcgcgggccaaggagacggcguucguggagguggugcuguucgagucgagcccaagcggcgauuacaccaccuacaccaccggccucacgggccgcuucucgcgggccggggccacgcucagcgccgagggcgagaucgugcagguagcugcccgccgcccgggccccgcgccgccuccgccacaagauggcuccgggggcugcgcccgccgaccccgccgcgggcugccugacuggcgggcgggcgggagggguggccgagaggccggcggcaucccuccccugcgggcgggcaggcgggcgggacgcggccuccggggcgcauccgcggggggcgagcgcacgugggggcuagagcuccugugaaccccggggcgggaggggcauccugggcccggcacccaugcuggggcagcccccuuggccgguuggguauuuaggucugccucagguggaagucccgggaacuaccuguugaaugccaacuuugaaaagacaagugaugagggaugggguggcucguuucagguugcaggcuuugcuuuuccauccaugcauguucuuuuugggugcggccagguuugucugaagggcugcacaacgucggguucuuccccggaaccugccguccgccucaccugggcgccggugacccuucugcggggcucuggacaagcagcagcaggcaggggaggaggcggagcuggucgaggaguggggaucggggguucccuggaguggcgauggaaggcagcccucgcugcaugcuucacauuacagagggugggagggauaccgccugcccgucccucggccaaagacugaugcgaaggaccugcaaauggggagauggcguaucucacugacaggaccuccaccuuggaccaaaugaaagagaucuacauuccaaaggaaacuggcuagggagaccuuuaagccgugccuacucuuuggaggagggacucucaacugaagcuucugcggaugguuagcuggguggaugucuucccgcuuccuuggccgugauuuuaucaacuuguuacuagacagccagcgcacuaauaauggcaguuaauaugcgcgccucggaugggggcgauucguaaagguuggcuugucuuugaaucuuuggggugaucggaugucugcagggccuaagcuuugugggccuucugugcuuuacucuugggugaguuaugaaugaaaagaaggggacuccauggaaugauugcauagcagcccgcagcguagacagccuguuccgugguguccuuuuccuuccuugggugcagacucaaagcccugccuucauaggacagggagagcugugcagcuugacuccguagaggugugcccuuacaaagcuggaggagguacccaggcccaugcgauuaaucagcagcauugccuuaccgggcucuuauccccauccgaaaacuucuguaggguaaauagaagaggaaacuccuucauugagcccuuugacuaucuauguuaaugcuuuuggacuuaaaaaaaguuguaauuaugaucuuuauaaguuuuagagaugaugcuuugcugaagauuccuaaacauuuaagucuugcuccuuggcaacuucuugucuuucuuugaggcuuucauuguguccugaugguuuuagaaauguuugauuuacagccuucuaaaaaaaaaaaaaaaaaaaaaaaagacgcucuagcguggcacuugacuuuuugaaggagacuuuugaaguuugcaguuuuuaucugcaauguuuuaacgugucacucuuucucaacaguaguuugucuggugagcgagcuauccauuaugaggaguguuaugcuuuggagauaaucuuggguucaccauuuaauacaaaauuagcaguuuaaacaccauuuguaacuauuuuauccuugugaguagagagauaauaugugaauuuggcagaaggaaucuauucucuucugaaacuuuuugaagugcuuaucuaacucuuuuguaguccauuagccuagccaaaaaaaaaaaaaagucaauaguugcuaaguaaagugacuuaaaugguauuuaauaaguuuacuuguuaagcaaucacuaauagguguccuuaauucccuuauagcugcaguaauguuggugaguuuaucugagcugucugaauagucauuucauggugcaccucguaucuuuaguaacuuuauugugguagcugacuuguugaaccucccuguuucugcggacagagugcaguguggcuuucagggauguguguguacaaaggcuagcaugcuuuuaugaguucugcaaauacuguuugauugaaggaauugguguggaccuugucuggcagcccugaaaaaguuuuuuguaaggaaggcugaugauguuuuagggccgcugagagggaauauaacauuuucuuuuggugagaaaugagaaagcagaaggaauaaauugcuguccagcuuuggauuaaucauguuuucuaaguaaccugaacuuuucaaaaccuccuuuuauuuacugucuuuaaauaaaccuccuuuuguuuacuaucuugaaaaaccuuuauaagcuuuagagaugaugcuaugcugaagauucccaaacauuuuauccacagucuucaagaauaguuugaaucuuaacucuugcucauuguaacuucuugucuuucuuugaggcuuucacugugcccuggugacacagucucauugaacuuuucaaaacuuccuuuuauuuacuaucuuaaaagaaaauaguagccaggcauggugacugacgccuguagucucagcauuuugggaggcugaggcaggaggauugcuugagccuaggaguucgagaccagccugggcaacacaguuagaccuggucucuacaaaaaaaaaaaguagcccaguaugguggugugcaccuguagucccagcuauuugggaggcugaggugggaggauugcuugagccugggaggcugagguugcagugagccaugauuacaccacuguacuccagccuggacaacagagcgagacacucucucaaaaacaaacaaacaaacaaaaacugugauuugcugcuuaguguuuuaucgucucagagcagaguucauuuuccuauaacuaaagcuaaauaguagcacuauagcauugcuuuuguuauuuccacugggguucuguagcaguuuuauuuauucaugguuuaggggagaaaaaaccuguuuaggagugucaccuuuaagaauucuaagauaaggaauucguuuguauuacugauuuuuaaccccccuccuuauuauaugccaacgaagagagagagagagaguguguguguguguguguguguguguguguguguguauacauauauuuguauaguagauaccuuaucauagucugguuugccuagauaauucuaacuagaguaccuguucagucauuuccauggguuaggguaggggaagccuaguuaagaauugugucaguuugucagugucagagagagagagagagugcaagagggagggagguaguaauucaaaccuuaggauucgucaucaggaaucuugguucuucuccuuugcguuuuaggcuuaaauaacuaucccaaggucaccaauguaaucugaaugaagaauuuuuuuuuuaaugucuccaucugugaaaguuguggugaaaacaauuuguggguaugaaaugcuauuaguuacuuuuauuaucuuauguauuuaugcaguauuaaagccuguuugcuuguaagagugucaggcauacaguuugaaugcuggagaaauuaauuacacuucuccuguaguucugaagugugggacuuuaaaggguucuuagauauauugauacauauuucaucuuugaaccaauuuguugcuguuaaugagaucauuaucugaaacuuucagacuuggcugugcaacucacaugguuggugauguuaaauaaaggcccgauuaaacaccggcuagugguauguggauugguuaaacaaagaaaauuugcauugcuagagaugaaagauuguuuuaaagucgaaaugcauuuuuuuuuugcuugaagucaaauauuuagaaaagcuugagaaauucauuuguagaaggaaucugaaugacagguucuguguaacuuuaaauucagccuuucuggguccuagguuaaaugcugaauggacuugaaaacagagagaagcugaggacauuuaagaacuaagucaguuccuuuagcuauuagggguggguagagagcugggugguggguuaaaagggcugaucaagguccuuaaauauccgauguuaaguaaagguaucacagagaguaauuuuaggaaacuaauuccucugcuuuguuucccugucagugugcuucugcaguuuagcauuugaucaaacacuuucuuuucaucuccauuuuaaguuaacuuaacaggccugccucuaaaaauugacuuggucuaauagaacaauugugugcugacagcugaccuggauuuagacagaaagggauugccuacugucuucucagaugggccuucauagguuaaaaccaagcauuugauucagggggaaaacuggggcuguauuuugugauguuauacauucuuagagccccuuauuuucuauuuuguucccugagaucucaugggaguuacuaguacaauucugaauaggaaugaaauuggaguucaguguagagcuguagauuaaagggaaaguagugaugguuuccucuuauuuauacagagcacugccaagcaugucauguuuugguucuucucauccugacacuaacaugcaauuagcaacuauuguuaauccauuuuacagaggagaaaaacugaggcugagagaagcaaguugaguucucuaacuucacauggcuagcagaugacaaaccuggauugaaacccaggucuggccgggcgcgguggcucacgccuguaaucccagcacuuugggaggucgaggcggguggaucacaaggucaggaguucgagaccagccuggccaauauggugaaaccauacaaaaaaaauacaaaaaaaauuagccaggugugguggcacaugccuguaaucccagcuacucaggaggcugaggcaggagaauugcuugaauccgggaggcggagguugcagugagcugagaucacaccacugcacuccggcuugggugacagagcgagaccccgucucaaaaaaaaaagaaacccaggucugccuggguugcuuguucuuguuuuugccaagugaacagaacuuggcugguuaggauuuugacauuaauucaagucuaauuuugaacaacauauaauauagggguucuuaaccugagggucacagacuuucagagauaguccaugaacuccugcaaguguaugcguauucuugucuaugggcaguuacaacuuugccucuuccaggguucugugauguguccccucuauacccacaaggaaaaggggaaacucuaaucuaguagagcauugaauaauccauuaccaagaguuugagugggguucaggcugacaagaguuguacggaagucuacaggucugggugccuccauugaacauauuuauuuuguagacaucuaucacagcccuauucuguaccagacacuguauugcuguugucuucuggaguucagucuccuauggagacagacacaugcauggauaaaugauaauucuuaccaaauggguuucuccaccgaacugagcccuuaggcccugaggcauccauugucuauaaugaauuaacuucccuccugugcacugcgcagcauccuugggagaagagagaauauagucacucaaagacuuuucugcauuuacauggcaaaguguaagaacuugacacucugaaugcaggaugugggaaagcagaguauaguuccguuucauaguucauugaaaaaugaaacggagcaccugucgcuguugaaaugccugaagaguagcuucucacaccuucccuuguggaccuggaccccauggggucuguuuuugcucauuucuggaucgacccccuggguucccacugccugcuaugcaugaggcacucaguauugaaugaauaaaugauggagaguggacaucaggcaggcaguggguuuuauggauuauuuaugcuuuaauugaugagaacaacuugcuuuggcuuggcuaauaaauucugggauuauccuuccuuuuugauuguuauuuccagaaacuugcuuggauggaaaggauagcucucucucugguucccauagacccacugguauuacaauacuggguuguaugaaagugaucuggcccggugugguggcucacgccuguaaucccaacacuuugggaagccgaggcgggcagaucacaaggucaggagaucgagacaauccuggcugacacggugaaacccugucucuaccaaaaauauaaaaaauuagccgggcgugguggcgggggccuguagucccagcuacuggggagacugaggcaggagaauggcgugaacccaggagguggagguuacaguaagccgagaucacgccacugcacuccagccugagcgacagagcaagacuccgucucaaaauaaaaaaaauaaaaagaaaucugugugggguguuuauauuccaaggcaggguaccuggcauaagaaaagucugaagguguucuuuuccugaugaaacugaguauugacaaagccuuaaaguggauagguuauggaaggaaagaaucuugaauuuccagugucccugggaguaacaauaagggauuggcauucaguaucaucguuaaccuaaauauaugccaugugaaaaacuuugcugcuugcuugcuuucucucucucucucuuuuuuuuuuugucagggucucaccauguugcccaggcuagagcacagugguaagaucauggcucaguguacucuuggacuccugggcucaggcaguucucaggccucagcuuccccaguugcuagaauuacagguguaugccaccauaccgagcuaauuuuuuauuuuuuguagguauagggucucguuauguugccuaggccggucuugcacuccuggccucaagugauccuccugccuuggccucccagugcucugggauuacaggugagagccaccauaucuggucagaacuuugcuucuugaugguauuuucccaagucuggagaguuuggauuucuaauuugugacauuuaaguaaaucuucauaaucaaaagaaccagauucaguccuuuaauguguuagaaaggagacugaaauccagagaaaugcuuugcugaaguccacauaagguagagaugacccaggauuaauauuuggguccccugacucccaggcuuggagcccuucuguuacccccggcuguagccuggcugagugugacaggggacaccagaugcagggcaugcuuuaugaucagauguauaauugaggaaagccaggcauucuuaaauuguauauuggguuuaagugguugcuuuucuucucuaauuaauuuagauuuugagucucucagucuuccucccugucagagcuuuuaaaaauagcuacuaaugaucaagugcuuauugugugccaggcacugggcacagugcuuugcucacauuuaacagacaagguagauggcaugugccagagagguaaagucacuugucaaagucacugagcaagucauuagugcagcugagguucaaauccuggucugucugauucuaagccauuucuguuuucacaagcccgcuucacuucacacuuucuuaugaugagguuaugggaacugauguggaauuuagaguugaguuuaaacccaaaacgauugaccaagaaauaagucuauaacgucaacugagaaaauccccuauccucacaaagauguauuuccuuccuuucuuuuccucuucuuuuuuuaaaucacaaaagucucauucuaacuuaguuuuuuccauaaagagccaaucuaccagguucacaaagagggaccagugacuugacauauauaacugucacucgauggcacuucuguuguuuucagcuauugggcaagcuggaauggcuguaguuuucuggcauuuaaagggauuucuggugugagacacaccuccuuccuguggcugacuuuuauagcaauuugggagucugcaugucuuucuccaaagaggucacgucccauguuugugaccuuucuuacuuugcacaggcucauugaauccucuugguuguuaaaacuuaccacgagugcuacaugccucagugggcaaacauucaguggugccccccguccaucagauccuuuguggggcaaggcaaugaacacaagaguaagacuuggucccugccugcaggcagcugaguguagguguccagacagcacacgaacgguuaccuuacaguacaguggggcauguccuaucugguaggaaacagccuauaggauacugaagaacaccugggggagggaaucgggcccuggugcuaaguuuagaccugucugucacuguaugagcauucuggccuuuuccaacucauuuuuaccuaccuuugagguuaaagcugauaaccucuuugaagagaggugccuuuauaccuuucuaacggaauaggaaggagguagagaguagagguucuuuguucuauuuguagcuugaaugagauguuuuaaaaucugacuuucaguggcucuguuuacucaugauagugucaaaagaauaaggucagcuggcccauugugguucaaaggagagcacuuuauuuuuauugcccuuaagauguguuguaagacuugauauuaauuuccuccucuccccagcagccaguguaauauaguuguuuagaaacucaguauagaguuugauucugugaaaacgaaguuugauccuagaauuuugaugggaaaacguauguuagaauggggacuucuggccuccuggugcagaagugccugcauuuaaaaaauaaaagagccggcgcgguggcucaugccuguaaucccagcacuuugggaggcugaggcgggcagaucacgaggucaggagaucgagaccacccugacuaacacagugaaaccccgucucuacuaaagauacaaaaaauuagccaggcgugguggcgggcgccuguagucccagcuacucgggaggcugaggcaggagaauggugugaacccggcagguggagcuugcagugagccgagaucacaccacugcacuccagccugagcgacugagcgagacucugucucaaaaaaaauaaaaaaauaaaaaauaaaauuaagagugggguaguacucaauuagguguguguaaguucccauccagcacuguaagaauuuuauuauaacuuaauuuucuacuugaguuaauuuggcuuugcuaucuugucagcaaacauuuauugaauguuuacuguagauaccguauagagaagaaacaucgguuuuaugcacccgugguauaauuugugcuuuucaaauguuauuuuucugauuuauucgagaguuugaggcugcagugagccuugcagcuaccagugugagccaccgugccagcauugguaauuuucuuucuuucuuuuucuuuuuuuuuuuuuucgagacaaguucuggcucuaucgcccaggcuggagugcaguggcgugaucuuggcucccugcaaccucugccuccugggcucaagccauccucccaccucagucucccgaguagcugggacuacaggugcacaucaccacauccagcuaauguuuguauuuucuguagagaugggguuuccccauguugcucaggcuggucuugaacuugggagcucaagcaauucacccgccuuggccucccaaagugcugggauuauaggcgugagccacugugcccggccugccuugguuauuuucauaagauuucuagaauuagguucacugaguuaagugauauaaacauuuuugaggcuuuugcuacauauuuuuagauugcucuacaggaguggucuaguuuauacaccccuaccaggucgccauguauguuucuacacaauagcccugcucgcaacagauaguauauuuugcucuguugcccaggcuggagugcaguggcgcaaucuuucuuggcucacugcagcuugaaaucucaggcucacaagugauccuuccgccucagccucccaaguaacugggacuacaggcaugcaccaccaugccuggcuaauuuuuuuuuuuuuuuguagagauggguuuuugccauauugccaagguuggucucaaacuccagggcucaagugauccacccaccuuggucucccaaagugcugagacuauaggcgugagccacugugacccacuguauguuucucaaaaauacaaaaugucguaaaagugaaagucuauauauuccuaucauuuaguaaauaguaaaauacuggcuuuuuuuuuuuuuuugucugccauaaggaucugaauuaugacuaaugucugcacugaagggaagguaccuggcguggcaucugggugccucccuuguagguguaucagagcaugauucaggagcagcagguugcccuuguauucugggcaggaacacggcgucuguccaggcagauggccaugcucagaggccucacgguggggaccgcugugcugucgucacacccuguggcagcagauuguugcccaggagggugcugcuucaguugcugguuucugcccuuccucuuuccugucgagcaggcuuucugcuucugaacaggcuggauucagaaaggccgaaugaaucuguccuugaauucauagugacacugucaguugguggugggcagagaugcaaguugagcccaagcaccagacucucaggggugcauuuaagcagcaagcauauaggcugaaaacagcuuccagguauuuuguucgaucgcuguuaaaaaucuagaaaguguacauaaaaaugggcucuucuaaaaaaaaaauuaaaagaucuggcaucaguggguccacagucccaugaggcaauagccugccauaguggaguggcagcugccccccuucagcagguacacaggcccuccagucacaaguccuuaucgcauugcccagcuuacuucccucacugacaguuccauuuacagaugccuggcccuguagacacuguagcuggccauccuuucugucucuggaaguuccaaaguugaaagcuuuuaacuugugcuuggcaagucucuuuucucuccuuccccaaccaaccugagugugagauguccaucaguggaccccaugagucucaaguuaugcuacugaggaaggcccagcuacccuugaugugaccagagggcucuuuuugcuuugguguagguguugaaggcugaagucuggagccauuggccugugccuucaggaucuuugcuccuucucucuuuuuggcuccaugguuucucaacucugagacuuaauuguuugugcugaagggcaccuugaaaaugcugugacuccggccgggcacgguggcucacgccuguaaucccagcacuuugggaggcugaggcggguggaucacgaggucaggagaucgagaccacgaugaaaccccgucucuacuaaaaauacaaaaaauuagccaggcgcaguggcgggugccuguagucccagcuacucgggaggcugaggcaggagaauggcaugaaccuggguggcggagcuuacagugagccgagauugcgccacugcacuccagccugggcgacagagcgagacuccgucucaaaaaaaaagaaaaugcugugacuuagcucuccuuuugcagugagggaacugugggcaagggcaucuagccuuuggucuuaagagcugggauuagaacucagaacuugggguucucgggggagggguggucuuucuagaauggcauucugcugcgaugguugaauuccagaaaaucuuccaugugccuguugcuuuaggguuccugguguacuuucacuuacaguaucuuaguucauccucucauuugggagugccuuuucuggauucugccccagaaggcugucugcuguucagguggucugaggcggagucuugcucugucggccaggcuggagugcaguggagugaucuuggcucacugcaaccuccccauccuggguucaagcgauucuccugcuucagccucccgaguaggugggauuacaggcguccaccaucacgcccggcuaauuuuuauuuuuauuuauuuuuauuuuuaucuuuuugagacggagucucgcucugucggccaggcuggagugcaguggcgcgaucuuggcucacugcaaccuccgccucccggguucaagcgauucuccugccucagccucccgaguagcugggacuacaggcgugugccaccacgccuggcuaauuuuuguauuuuuaguagagacaggguuucaccauguuggccaggauggucucgaucucuugaccucgugauccgcccgccucggccucccaaagugcugggcuuacaggugugagccaccacgccuggccccuauauuuuuaguagagacaggguuucgccauguuggccaggcuggucucaaacuccugaccucaagugaucugucugccucagccucccaaaguguugggauuacaggcgugagccacugugcccggccugagaaugcuuuucuuuguaccuaauuuguauacuuuucuuuaaaugcauuugacauuguguguuuagcaccuuuaugggauuucuggaauaucgcuggguaccuggagacuuggcaucuuuucagaaaguacaucagucuuggaguagguggugagcagacagcuaauggcauguaaagaauguugcaagcuugacuugcaaagcuauuucaaaauuuaaauaaagguagcuuguggcugaguugaagggaaauggugguaucuucaagacaaugcuuggcuugcucugccucuugcugacuucccucuucaggccugaugcugcccaagcuguuucccugucucucauucucucucuuuugguuuuucuuuuucuuuguuuuuaaaagagaccaagucucacuauguugccuagacuggacuugaacucuugggcucaagcgauccuuccgucucagccuuccgaguagcugggacuaugcaggcaugugccacugcagucggcucucacauucucuuucuucccaucaguucuucccuucccuucagauucauccuucuaaaguaguguuuggucacaucagucucuugaucaaaaucuuucguggcguccuguugcuuacuacugagcugugugaagaggugaccuagcugccccagucucucauuguugccuccgggcgugggccuguguguugcuguccuuguuccugaguggguccugggcuuuccucucucagugcuuuucuuucuuuuuuagggggaucggggagacagaaucucacucugucacccacccaggcuggaguacagugacgugaucuccguucacugcaaacucugccucacgggcuuaagcagcccuccugccuuagccucuugaguagcugggaccacagaaaugcgccaccacgcccugcuaauuuuuguauuuuuaguagagacaugguuucaccauguugcccaggcuagucuugaacuccugagcucaagcaauccaccugccucaacucccaaagugcugggauuacuggcgugagccaccgcaccuggccugugccuuuccuuuuggauugccugcuguaauacgugucuucaccuccacauuuucaacucccgucuuugcuuuccacugucuuuuuccuguccuagcuccucccaucugcagccaaacuuucaguccuucccaugaagcuuuuuccuggguuccaccaguguguuccuuugaaucagagcacuccaucucccuauugucuuggauguaaaacauguaaauuauuuaccgaaccggaauucuccuagaucacacuacuuugggauagcauagugagagggaugugaaagggguguuaauguggccugcagaaaaaaaggcuuggcuuuuuuucucuuuuuuuagguggggucucacucugucacccagguuggagugcaguggcacgaucucaucucacugcaaccuccgccuccuagucucaaacgauccucccaccugagccuccugaguagcuggcugggaccacaggcacacaccaccacgccuggcuaauuuuuuguauuuuucguagagaggggguuuugcuguguuacccaggcugcucuuggacuccuaagcucgggugaucuaugcaccucggccucccaaagugcugggauuacaggcgugagccacugugcccagccaagacuuguuuuuuugagggagaauuuucugugauugucgcaacuauuugcaagcagcuuucagacaugguguguccugauuauuccaaauaguugggauaguccagacucucaaaauaauuucaccuugccugugcuuccuggaggucuggagaaaggagacaguaggaggugacacccucuggcuccuuccagucuggcgugugccugcccugggaacauuguucagaacaugcuggagaagagaauaucacagccugacuguagacuuuuggggauguguuuuauuuaaauauguaaaauauaauauuuuggugucacuuaaaacaccgggacuuuuggaggcguaguagaaguucuauguagcuucagaaugacccaucagaaacaaauguauaugagucuuuacuuacauuugugccauauugcuucccccuauauuuuuuucccuuuggaagcucuggcaugggccuugauccuguguuuaagcgcugugugggaagcagaauuuaaaaggacuguaguaguauuucuaaagagacuuaacaggcuacaugugagagaauuuuagauuucaauuuagcaaacguuugauuuucuagucuuuauggggcugacuguaagcauuugggaaauuauugaauuauugcuuaguucuguauaaguugacaugcugagguuuuuuuuuuuuuuuuuuuuuuuuaacuguuuuugugggacaguggugauuacaugggcauugggacuuucaggaauauuccagaaucuaugauauguuguauuucacuugugcuagaggguuuucaggcugccuuuucauggcauguucacuccagaaaugcucuaaugcccaucaauaaaugucacccucauccuaggaauuagaugaagagauuauaguuuugaaguuuugguguuauuaggcuuaaaucucuaggacacauauaaacacacuugugguauuaaaugugccgggugggugauuucaaguuccaguggcagugguaauuuuugcauuuccugacucuuguguuuaaauuugcagucucaacauugcaucacuguaaguuuucacauuuaaugaauauuuauguugagccaaguucuauacgaauguggugguuucugacuugauuauagcuugcuguguacuguggccaggagugcccuacagacaacagaguuggcacacgucucagcaugccaagccccggcggaugugguuagggaccacggugacuggggcauugguugccauaccaaccuuguuuuuggaagggaaagcucugaaacagcaaugggaugggggcagaauaguuuugaauauuccaaguaaacuuauucccuauauguucccugcaagaagaugcuauagaaaacuauaauucuuacuaugugcucagauagcaugaguuaauuuucuuucuuuucuucuuucuuucuuucuuuuuuuuuuuuuuuuaagacagucucauucugucacccaggcuaaagugcagugguaugaucuuggcucacuuuagccucgaccuccuaggcucaaacgauccucccaccucagccucccaaguagcugggaccacaggcgugcaccaccaugcccagcuaauuuuguuuauguuuucuagagaugaagucucaguguguugcccaggcuagucucgaacucuugggcucaagcaauaguuaguuuacuuuugcaaggcuguuuuaauuguccuuuugcaaagguguggaaguuauauggugggccuuucaugugugaauuucuucccuacuuguuggaggguaaacaggggaucuucuaucucuuccuauuacagaccuucuucucucaacuccugccaaccucccuugcccucugguaacuaaccuagugaugacugauugggggagggagaagggaaagaaaaacaggaaggauaaaugggggacuccuccucccccagcuccuuauuuauauuccucacuuucccuuauaccaagaugggguuuccuugcuccucccuauuguauauaagcaaagaucacagucgaaggugccaucacccauaagugggauguuagggugcccugcucacgagcuucggcagacagaacugggaugagaggaaggaaacaucccuggcaucucacacuggaaugcuguuaccucuuugcaaauggugccuugcaugauuaauucuaugguacuugguauugugcaguaaaaugucuggaagggaauugaucaagucugguaagccagaucagagcccagaauggcagagugggaugugacuugcagguggcaucugcuguucuagugccucuuuacagaagaugauccaagucucuggaagcugccaccuguccagguucaacagcucaggcagucuguuguuguggagggcuuguccucaagccucaucacacaaaaaaaguaaaaaccccaccccuuugaaaagaaacuuacuguuucagaagagggaggcaguccaaugauuuaaucuuugcuugcugacuuggagccaacuccccauuagauuguaaccuccuuccgggcaggguugguguuucaaucuauuuaacauuuuucagcugggugcgguggcuuacaccuauaauaccagcuuuaggaggcugaggugggaugaucgcuugaggccaggaguuuaagaccagcuugggcgacauagcgagacuguuccuacaacaaauuuuuuuuaaaaaaauuagccagguaugguggugcacaucuguagucuuagccacuugggaggcugaggugauaggaucacuugagcccuggagguugaggcugcagugagcugugguagugccacugcauuccagccugggugacacagcgagaccugucucuacaaaaauaaauaaauaaauaaauaauuuuuuuuuaaaugcagaaaacauuucccaguucaacucaaagagccucuuuguuugaauuuggaagagcugucccuuccugaagauaccugaauucuauuuucugcucaucggucauaaugugaaucuaggaugagcacagaugugaacggcaccuccuagaguugugcggugcauaaggccaacgcccagaaggcacucuuccaucucccuguuggcugacguggcaccugaguuguucccccuucucuaaugcuucuccuucagcaauugugauuugcugcuucugauuucuguaguccuaggaaaccagggaaccauguuuguuagaauuauguguaaaguuaggggacagagacaucaaggggguguguaaguaguuuaguauguggcugcuuuggcugcuuuucugcuuuuugcuggcuccucuuuagagaucagcugacuggcgcauggaguccucaaauuuugggggcauguaauaaaugauggauggaccuuuuuuuuuuuuuuuuuuuuugagacagagucuugcucucucacucagacuagaguguguaguggcacgaucucggcucacugcaaccucugccuccuggguucaagcgauucuccugcuucagucuccugaguagccacgauuacacgugcgcaauaccacgccuggcuaauuuuuuguauuuuuaguagagaugggguuuugccauguugcccaggcuaguggcuaggcguuuuauggugcagaaauggcaccacuauuuugugaguauuccuaaucaccaacuuuuaaguuaacuuuuuuuuuuuuuuuuuuuuuggagauggagucuccgucuguuacccaggcuggagugcaguggcaugaucuuggcucacugcaaccuccgccuccagggcucaagcaauucuccugccucagccuccugaguagcugggauuacaggugugcaccaccaugcccagugaauguguguauuuuuaguagagaugggguuuuaccauguuggccaggcuggucuugaacuccugaccucaggugauccaccugccuuggccucccaaagugcugggauuacaggugugagccaccgcgcuuggcaaguuaacuuucauucaccugguuuggguauaaguucucuuuaguucuucaaacuacaacuuuuagcugacuguauuuaagaggaguugggaggacagagcaguaguuuuccacuuugcuacgcagacacccagcauuugccaggccuuuuuuuuuucuuuuuuugagaugggaucucacucuguugcccaggcaggagugcaguggugugaucuugguucgcuacgaacucccuguccugcgcucaaaugauccucccaccuuagccuccugaguagcugggacuacaggcgcccugcugauuuuuguauuuuucaccagguucuuuaagcauguuguaaacuuugcagaacaaauugguucuggguuuccuuugaugggagaggcugcagagugcugagucuggagccagacagcuuggguuugaauccuggcuuuggcaguuaccugcuguggaaagauggcuuugccucucuggaucucaguuucugcaucuguaaaauggagauaaacuuuuccuagcguuguuaugaggauuacaugaguuacucacagcaugcaauuuauauuuaguggggaugagguugaagaaaauacauaauuucaugcugcuccucacauauaccuaacguuuauguugcaguucccaagugguugcaaauucuuauucuaaaaugguagcuuaucaaaguuaaaggaauccaaaaaugccauuuacugagaagagaaguggucauaacauaggaauuuuuuuuuuuaacaugcuuagugccuuucuacuugcaccuaugucccuucuccccuagugugggggucugugggcuccccaggguagugcuuaagcacuuugcaagaggugcaggcugcucauuucuccgauucccaguucccucuguuuccugggagggacgcuuugcugcagcuucaccugcuuaucccuacucucuacagcuagaucauuguccaggccuuaagcucugucagucgggcacgugugcacacacagacacacacacgcacagcuggaugugaacucuugacuccaguguguuucuaggccagccugcuuguuguuccugguugcuccgaggaaaggagggugcugauugcuccucuggauccagccggacgcauggaaugcugcaacauacuaagccugugcucugggggccuaauuacgugggacuuggggcaagcacaagugacuucagcgcuugguuugauccagcgugugauuuuugccaaagcaaauacuuuauuaaucuuaaccccccaaauuagacacauugacuuuuucuaaaaaugggaaugauuggagagcagaauuuuuuuuuaaauccccuccccauccugaaccccuccuccagcaagacugggcucugcauuccucuccuugaauggagaaggugaguuccaucacugccuaccuccuccucuaacauuccugaaacuaggugcuaggaaauugccccuuucugaagguguguuuuuuguguguuuuccgcaagagguuccacuccuuccuacgucaaggccaaagaaaggauuugccguccugauggaacuuuccuaacugggaacuuguccuggauuucuugggauucugauccagaauguguauagggaaaacuguugggugacuucccauggugaccuugagugugucugagaggcucagccagaauuucuuguguggccugugagugagcuagcaagccagcgaggucagugggccuucccgcucaacacccugucucucuccucaaagugucuuggguaaagggcauacucacaggguggaauuaaucuggcguuagagagugagcuuguucuuaucuagucuaaacuggaaaaaaaaaaugcauuuaaauaagcaaccuaaccucaccccagaaaacaacuccuaguuaaccuuggcuccucuucacucggccucugucuuuaagucugagugaccuggugggauugaucagcuuugaaguccuaaggugcuauuuuaauacuguucuuuuacguugcaggcuucgagacugauuuaacuagauucuggagggagcuuacuuuacagcauucuuaagagcucgaacaaucuugaaagaguuaaacucuaauuagcucauuccuaagguauuuaaugcccuuauuaaaacucaacugcucguucacuuuuuucuuuagugaaucagauuucuugaggagcugagccuucgcuccucagaucacaggcucacauguugaagcuggcagugcuagaggcuaguuccuaucugugugacagcauuuuuaauuuaacaggaccgccuuugauguucccaaauauuuauaggcagcuuuagaucauuucagugugugcuuucuuuuucuucucucucucucucucucuuuuaacuggagcaaaaguucuuccucaugcaacagccuuccuuuuauccuguuuaguuuauuuuuguuuccuuugcagcuuuggcgaaggcugucuggcugcauucacacacacacaugagauugacccuucuuuuugcuucuuugguaaaggcuaccucucuguauccuccugccugcuugagauugcuuaaggcacuucuguucaucccuugacuuucuucaggcugaguuuuuuccuaaucuggcucaggaaucuguucuuuggcugaccugagagcuuucagacuaucaugcagaccugggcauugugugaaagugucuuuuuuuuuuuuuuucugagacagggucucacucugucacccagacuggaagugcuguggaaugaucauagcucacugucaccuugaucuccucaagugauccuucugccucaaccucccgaguagcugguacuacaggcaccugauaccacucccagcuaauuuuuucacuuuuuuauagagaugaggucuugcuuuguugcccagguugaucucgaauuccugggcucgagcaauccuccugccucggccucccaaagugcugagauuauagguaugagccaccucaccuggccuugaaugugucucuuuauggaugaccaggcuguaauauccuacucugcuugccugcauugacacugauggggccucagcaaguuaugauuuacaguguauguuuugcagauacuguuuuagcuggggcaggaaauucagauagacagaauucuguccugaucauuucaggcuugcucuguuuggcucuguuagacuucuuggcugaaaauaacagagaaucaaagauuuuggucucagggaugggaaaaacagggcugcaacauagauuuguuaagccauuaagaaaaagaaaaaggaaacuuuguaccaaucaaaacaaaugauagaacagaggauagugcuuccuccagcuuggccucuggguaaacauucugcuugugaaacaauccaaauuacugaauucucagcugcuguuacuuaccugggccuggcagacagaagaccagaagauaucauggcuucuuccaucauugcuggcugugccuccuauuagguggaagccuuuuagugcugaaggucucauaggugguugaugaaaugugugaaugaaugaauacacuauucuugggaccuuauacuguuuuucucacuagauccuuaagaggauucugagcgauaagauauuucauaucuguuuuuuuagaugaggacacuaaagugcagagagguuuauacagcuggugagugaauggagaagcuggccuggagcucaggacugugucuuauagccucaccaugagguaauuggaggcagguaaauccaauggcagucugcuaaccucuuagagcuaaaaaagccuguugaggcuaagcaugguggcucacgccuauaaucccagcacuuuaggaggcugaggcaagugaauugcuugagccuaggaguuugagaccagccugggcaacguggugaaaccucaucuuuacaaaaagaauuuaaaaauuaacugaguguaguggugcacgucuguagucccaacuacucaggagauugaggcagguggauugcuugagccugggaggcagaggcugcagugagcugagauggcaccauugcacuccagccuaggugacagugaucugucuccaaaacaaaacagaaaccucucaaggcuaaaaucuacuguauguugcauugugagaguucagagcugaccagauucuugccauguaaggggcauagugguggagaguacaucccugagaccagauaggccuguguuuugcaucucagcccugcuacugacagcucugugaccuuggccaggucauccaaccucucugaaccucugcuucuucaucuauaacaugggacagauagcuuguacgaccaaaagacuaugaaaauuagaugauauauguaagguguacauuaagugcuuaacacauguucgguuggugucuguugcuacaaaauugugacucucaaaggguucauaguccugcaagaaagcaucagguaaaccaccuauuagaagacgacuuggcagcuacaauagagagacgugcuggugcugaguaggaacccagggcagaaaccacuggcuuggauuuuuauuuucuuucauucagcagauauguauugagugcuuacccugcgcuggcagagccacuggaucacacugauugcugccagcucccccucaccucccaauuuucucuuucccuucuugggagaauuugagcuaaaauguuaauugccaccugaagaaagauuuucacggagucauuuucuuuucuuucuuucuuucuuuuuuuuuuuuuuugagauggacucucgcucugucgcccaggcuggagugcaggggcaccaucucagcucacugcaaccuccgccucccggguucaagcaauucuccugccucagccucccgaguagcugggacuacaggcacacgccgccacgcccguccaguuuuuuuuuuuuuuuuguauuuuaguaaagacaggguuucaccauguugcccaggcuggucucgaacuccugagcucaggcaaucugcccaccuuggccucccaaagugcuaggauuacaggcaugagccaccgugccuggccacauggagucauuuucacauaaaaugccaaggugccaaauggcacagccacacugcauuugaccauguaucuuacauggccuugugcuguccuucaacucucauuuuaaucuuaucuaauuuucuccaauuucucuggucucuucuacaugaaaacuuuaugguccuugagaauguacaagcgacucaccaagggagcaggugguggccgcaugguuccccacagugcccagaugguguccgugccuuucauggucugguuccauggggauuuguugauaagauuuugcuuucauuugguuuuccaacccagcagcauauuuagauuugauuacugguacuagcuuuuuucucugcagaguuucauugucugagucacuggcugucuugaaacauaagucccauucuccacaccccuguaccccuuugcaaucaguggggaugguuaugugguagaacuuuuucccugcccacagcgcauggugcagaguggugucagcacacuuucacuugcugaguugauugguaacauauugaaucuagaacaaaagauacaauugaaaagcauuugugguugucuuuguauaguuacaagccucuaaaauagauuugaggucauuucuaugucuuuccuuuugaauuagcaagcaagcuuucagagggaagugggcguuuucuaaaugcacuauugauuugaagcuaacaugaugcucuacuuuuggaucaugaaaauaauguuaauuuuuuauuuggcuguuuggagggaccacuggaguaggucauuuauauucaacucuuauucaugcuuucuuuaaauagcauguuuaauuucacauuaaaacuagcuucuguucagcuaaaacaaaaacugaaaagaugguuuggaagaaagcaaaaugacagagaaaaugcagcaugcaauggaaauuggcugcaagucaucuccauaaggugauugagaaugaagugaagcucagcuuucuuuccaaagaacccucaacaacccucuauguuaacuuaccuucuccugggagucuugguggccuccuuuuguccuugguguauguugcaugccaaucaugcuguagagaaggcaguaauaucuagaaacacaucuugaacuagcguugggccgugugcaagucucuuuugguggggauaugcgagagucacuaacuagcaaccuuuagggaaaaagaaguccaagaggguugaauuaguaaccacuggggccuguacguggugauguuugcuuuuuuaaaugauccuuguggagcaucauuugcccuguguccuauggggcaugucaccccauucccuggaugucaaaacuaagaacagaagcaaaauccauucugcauuggcucuccuucuuuagacuuagccggauugcuggaugcgcggucaguuggaugcaaauuugcuuuugcuaaagaaaaagaaggccugcauuaauaauacaaugauaagaccugugcuuucaguuuguguuuuuuaaagcggugauuagauuugucuggguggagagcaaagaugaagcuauuggucuaguagagaccauugguccccagaugagggccuggugucuccguuggguguuuuguuuguuuguuuguuuguuuuugagauggggucuugcucuguugccaggcuggcguguaguggcacgaucucgacucacugcaaccucugccuccugaguuaagcaauucuucugccucagccuccugaguagcugggauuacacgugcacgcugccacacccagcuaauuuuuuuuguguguguguauuuuaguagagacaggguuucagcauguugcccaggcuggucucgaacuccugagucugccugccucagccucccaaagugcuaggauuacaggcgugagccaccgcgcccagccucuguuggguuuuuuaggcacacuugucugaagaaagucuuuugauuuugagccacuuuuuagagcuuugaagcucuuccugauuuuaacuauugcuaccuauggaagaguugcucuuugggaauggacagcaacuuggggcuaacagcuuuuaagcauggaccucuccugggggcguguugggccuguuuacuaaccuuacuguggacuccgccuucagaucaggaugauuuucaugguauuuuuuuuuuucucagaaaauaaucaaaccaaaacuuucccuugcugauacagagugacuaugcaaaucaggucugcaugcuuaucuuccuagaaauguaguucagugaaaagaaaacagcgccuuccuuuagcccacauacuuuccucauucauaaaaugaaucagaugaaacuugauuucacccaggcuggagugcgggggcgugaucucagcucacugaagccuccaccacccaggcucaagggauccuccugccucagccuccugaguagcugggacuauaggcgcaugccaccaugccuggcuaauuuuuuuuuuuuuuuuuuuuuuggugguagggaaaggguucuaccauguugcucaggcuaguugcaaacuccugggcucaagggauccauucaccucggccuuccaaagugcuggaauuacaggugugagccaccauggcuggucacgcccagcuaauuuaauuuuuuuuuucuagagacaggggucuuacuauguuucccaggcuggucuugaacuucuggccucaaaugaucuuccugccacugcaccuggccugauuuguauuugggagccucacuuucuccauuaacuuuuuuuuuuuuuggagacagaguuuugcucuuguugcccaggcugagaugcaguggugcaaucucagcucacugcaaccucugccuccuggguucaagcgauucuccugccucagccuccugaguaguugugauuacaggugcccaccaccacaaccggcuaauuuuuuguguguguuuuuaguagagacgggguuucaccauguugaccagauuggucucgaacuccugaccucaagugaucugcccaccugggccucucaaagugcugggauuacaggcaugagccaccaugcccagccucuccaucagacuuuggaucuggaagauaguaagaaaaaaagcaaaguaacuuaguucuguccuuuccuagaggacguaagcagucuuggccucuucaugaugguccacuuuguuaccgaauuauuggguacaaaagugaggucugcaacaggcuuuggauguuucaaggugugucuggcugugguuugcuuucugagugccagcuuuaauguccucuuauuuucuggcaaggguugauggauguggcacugaauauuuucugaauaguguucacagaaucaccgagugaaugcuggccuccuccugcaugucuguugagggagggcuuauggaccagugggaaagucagaugugucccugagauggugacaguauaacaugcauaggcugagugccaaaugcuuggggcccagagaaagugccuagaaaucagagaaaggucuuggggguggaccuccagcuggacucuuaaggaagauuggugcuuggauuugcuccugcuggcucuugcuauggggaaggcauuucuugcugagacccaggcuaggcuggcaacuaguggagcuuuuucuagcuuguguagaccuggaggcugccuggcauagaaugugcccauggcagggcggggagaaagaagaggccaagugaggugcggcugggagacaacagaucugcuaugcucucuggucugucauuuaagugggaucuauuggauucagccuuucugagccucagucuccacaucugcaaacuggguguggggcuagaugagauuccuggggggaauugggggaucugcagcugugccucugaaggaugucuggggacagaaguguaaguggggaagaagcacacuaacuggggaauuggggagggaaagaacuuuggagggcaaguuaggggagggauaagaggggcuuugaaugccagaaaaggguaugugacuuuuaucauggagaccagugggucccauagucagaauauaggugaugucuaugugcaugaccguguuuuuggugacacaacucccgccugcccuguguccuccagcagcaugguauguaauugcagcccucacugcacagcagucggcaggcuuauucaggggcaguuuuccagcagucacuccucucuugagaacagucuggaauguaagggaguaagugauguucuagugacaaccuugaauucacuuuauuaaagauaaauaaaucacaugccaacucuggccuuuagcuguuauuaguaacaaauagcuuucuacccguacacuugaccauucaugacaccuuggaagaaaauugcugccauggcauuugaccuugguuagcacuuuguuuuuucugagaguuuuuuuuuauauaucaugaguauguagaaacuucuggggagcaauuccucaguugccuuucgaguccugccccuaaccccucaguuugggcuccaucuguugacugcccuggguuucagaagggagauagugagugugcucucuugaacaugguccuuuaggauuaggcaauagagugguaggcugguuuagacauuucugguuauugacaggccuuacugcggcuucccccaaaugaaugaggaauauauuuuucuaaauccagccagugagccaaaugagccacacugggauaaacuuuguuuguuuacaaauuauguaagagaagggcccggccauuaaauucuucugagccagaauuccuagcccucuucaaaguuguaaucaaacuaaacaaacacuuuccacaggaacuaacucccucccgagaaacaggagcagaugcuccugggaggccuucagcaacuuuggaauguuuaaaguagaaauauguaaccaaggugaaguuguuccagaaacauugccugcucuggccagaaccaaagcacgugucagcuuuuuuauuuagggcaagaggugcagaauggacugggccaguccaggcagaauuuucuuuagaauguuuaauuuuugguuuucaucuuaacccggcuucucauaguaucagcuccuugugaccuuuauucccuucugcuuaaguaacucuuuuuuuaagcuugaucuuaucucuuaucuuuuagcuaugcuggauuacauccggggaucaaggagcccgccucuuaaagcacucaauuauugucccuaggaaagaugucagcuguagcacaaacacuccaggggagggaggcugaggcucgccuuaacuucauuauugucuggauaagauagggagaauugccacucuccaguucuuuuggagauccacaaagaccguccaucuaggcucagggacacgguuuucuuuucuuucuuuuuuuuuuuuuuuuuuugagacggaguuuugcucuuguugcccaggcuggagugcaaugguucaaucucagcucacugcaaccuccgccucccggguucaagugauucuccugccucagccucccaaguagcuggaauuacaggcgcccaccaccacacccagcuaauuuuuuguauuuuuaguagagauggggugucaccauguuggccaggcuggucuugaacuccugaccucaggugauccacccaucucggccucccaaagugcugagauuacaggcguaagccaccgcacccggcagggacacaguuuucgaauccuugccgauuugagucuuuacugagcggcuugauuuaucuuggcuugggaaguuguggauuuuuagaacauuggguacacuuguauuaaaauagauguauacuuucuuaagccaauugcacauuuuucuggaguaugcccaagaugagcuuuucucaaggcaucgccugaagaacagcaguccugcacaauguucuguggugaaaggguucuaugaggaucuaugcuaugcauuaaugguggggcucaguauuugagaaauacuguugauccuaguuuucucuuagagauauauucugcacaguagugaauuaauggcucugagaaauucuguugaagagcggucuuucacuuuauuuaaucugguacuucccaaauguacuugaucacagaacuuuuucucaaaggacucaaggugcuaggggauauggaguggcggguagccaguauuagguuaguuuagggucugcacugguucaguugguguccuguuagauuaugaggauggaaggccaacaccaaguuaacuaccagcuuuccacagggcccugggauagagucaucaccaccuagaaugaauggccugaacaccuuugaacugugguaggacuauuucuuccauuucagcuuagauuuguggucuucucuauaauugggugaugggguauagggaguuguaguauaaaagaaccaagaaacagugcuucucuuugaagaauuuaauuucuacuggaaugggaagauucaugaaggaguuaaacaguaccaccguccaaguagguaugaaauaaugucaaguagccugucuuguaggcauuuuguagccugucuuguaggcaggugggggccacaggaagcaggggcagccuuuauugugacuugacuuaccaaacuuuggguacugugauggcgggcagauaagauagaggaguccccccgaccccugcagcccuaaaugccucuucguuugccccgccucuguguguaauguacuaugugugaaagucucuuagacuccccgcaagguagacauuuuagaguuggaugaaaugcaugauaagaacuccuucugguacuuuccagauguauuugaucccagaacuccuuuuucucaaaggacccaaaguacuggggaacauuugguuccuucuggaaggagaacucccucuggcugaucugcaggcccccacugcuggguuggcauccuggauuucgagguggccaccuucugugacucuuaggccuugagcuuggcuaucugguuuuggagaccuggugccuuggaagugcugggcugaguugaauggaagugcauuuuccggguuagucuaccuugguuaaugcagggaagaguaaauaggcucugcugacucuagcugcccauaggaaggaugugugugacauaagcggggcugagauaucccccauugagaugcuaagaggaaacugagaugaggaguuuaaauucuucuccaaauaugugucauauuucauagacuguugacauagagcuuuuuuuuuuuuuuuuuuuuaaacuuuaaaaguuggaggccgggcacgguggcucacgccuauaauuccagcacuuugggaggccgaggugggaggaucaccugaagucaggaguuugagaccagccugaccaacauggugaaaccccgucucuacuaaaaauacaaaauuagccaggcaugguggugcaugccuauauugucagcuacucgggaggcugaggcaggagaauugcuuaaaccugggaggcggagguugcagugagccgagauggcgccauugcacuccggccugggcagcaagaaugaaacuccgucucaaaaaaaaaaaaaaaaaaauuagguuaaccuaccugauggauauuguuggcagcugagcucugucuagccugggacauucagccuuuugccucuagcuuucgaugaggccccaggcucugcuguguauuaaugguagggcuuagccuuaguucaggacccauccccugucauacccccaaaccccagaggggaggcguucucuuuuugcagaugcagauuaucagaaaucguucuuccuuacacugaaccaaauuucuucugcuccuugguucugguucugucuucuagaguauauuaaguauccuuugguugcuauaacaaaguaccacuggcuagguggcuuaaaugacagacauauuuacucaugauucugaaggcuagaaguccagaaucaaggugaucaggguugauuuauucugaggccugucuccuuggcuuauaaagugaugguuuuccuauguuuucacguggccuuccaucuguaacugucuguguccaaauuuucucuucuuauaaggacaccacucauauuguauuagggcccaccuauaugaccugcuuuaacuuggucaccucuuuauagacccucucucuagguagucacauuuugagguacuggggguuaggaccuuaacauaucaauuuuugagagacagaacucugcccauaacacagagccauuaagacaugaugacccuccagauuucugaaggugauuuucuugucacuugucuuuuccuugcugagaacccccaguucuuuccguucuuuauaugagaugguuuugaagucccucaccaucuuggaaucuucuggacuugccuuaguuuuggaaggacaaaguggaauacuuuggacuacccgugauauuauagauagaauucauucuaaugucugcccaagcaaacaauuuugaugauuuccgaaaaagauuaaaaggcuaaaaaucagacuguacaguuucaguaacagcuuuaagauauuugucuuuaauuuugccugaguaggucugaccacugacacacacacgggcaccgcccccauaucccaccccaugcauccagugcuaacuuuaugucuucuuuugacuuaagcauuuacguuagaguuaguaagugcucaaggucuaaguuuguucaccacccuuccucccuuccuucauacuuuuuuaguuuuaggaaaccuaguugggaggguuauuucaaaagaauaaaugaauguagagauuuuuauuuuuuaaauuuaaauuacauuuaauuuuuuugagauggggucuugcucuguugcccaggccagaguacaauggugccaucacagcucacugcagccucccccuccugggcucaagcaauucuuccaccuuagccucccgaguagcugggacuacaggcaggugccacugugcccggcuaauuuuguuuauuuuuuuguagaggcgaggucucacuagguugcccagguuggucuugaacucuuagacucaagggaucagacucagccucccaaagugcugggauuauaggcaugagccaccaugccuggcugagauuuuuauuuuuuaaauguaauugcugucuggagaggguagaaauaacucaguuacuggaguauaacucauuuuagguucauaaugucaugccaaccuguaguguaguuagauuuaaaauuauuaguuauucucuucacuuuuggaaauuguuuacuuuuuauugcccuugugcaccaaaaauugugucaaaaaagcucauauguuuuguucuuugcauuuucagcacuuagcagagugaagguuaaaaaaaaauuguugagugacuaaaggcauccucuuaaucaucuugugcuuauuuaaucaggagcauccuguugugucuuugguagaauuggcagcuugggguuuagggauuauucuggccgcugucccuuuugcuuuugaauuguggagcuccccacaaagagacccucagugcuguucacucuucugcuaaauugugguuuguaaguccugacugauaguuuugacaggcuuuuucuccuuaccguagucucuuuagauggagugugacgcucuuggaguuccuuucuuugaagaugcuuugacuauaccgcccaggauuuccaaauuguagccuuuagaugccuggaacccuggccccacacagcuguuaggcccccucuauucuggaggcccgacaacauuaaaaauaccaacuauuuauagcauacuuuucagugucaguaaauuauaggaugcccuugccaguggauggggugaacgcucaucugccugccacugugugauugccuagaagcgucggccagguggcaggagcucagccccaccugaaugcucccagguccucaccuggcacucccacaggaaacuaaggacugccaggaugucuugggguuccaguagaguccauguccuuugcgauggagugguuggggauaaaacacacacacacacacacacacacacacacacacacgacacuagguaugugugcucuugagagaagcccauucugaucuaacugccaacuccucaggaggcuguguugucagccaucugugcacagaaguuugcugcaucacuggugagcuggggaguguccugugugguguccacuuaaucuuacuaggaaggauccccucauuucaacaagguaacugaagaauguuaaaucuaaauuuggguaagauauacucucuguaggcugaagaauuugaagaguauauaaaagcucuuauagcugggugccuauagucccagcuacuuguaaggcugaugcgggaggauccuuugagcccaggaguuugaauccagccugggcaauagugagacucccucucuuuaaaaagaaaaaaagcuuuuaaaaaggccaaaaggacauagggucuuuaucuucccucagcugccccuuggaaaggaucuccuggcuugccauucagaguacacagugaggggaggcccccuccacaggguaccauuuagaacaggcucagucguuagaacacugcagagggcgugcuguccccuggccaccaagccaaguugggcuuuuggggacagguuuuguggugguagcuuuuggguucuucauuucuuugccuggacugaacagugagcagugcucaagaggccuguucuguuagcuggaguuuccauugaagugcuaacugcuggauccuuugaaccucuagccugggaggguauuuauaacuagcuguuugcgugcuuagaggaacugaaguccugccuuucuguagugguuuaagagcugugcccuuggugugggcugaaaggcaggccuggcgaaguguggggacucaaaugcccaacuccccacgaccuuguuugccuucccccugcccugccagcccagcggcccuuuuaggguuaacuucucugcuuuggaagcagcuggccaguuuacacuccucccugggcuguacaaaaauacuuccuuugaaguguuaggagaagcggugaaggguaaaaccuggugaagaauaaaaccuggaguggggcuugaaugcauuucucuuccagggaguuugcugggugacugagccccacagccuuccucguaaccuauagagcugagugguucuccucacauaguuacagcuuggagccuaguugcagcuggcaugugcaugugugggugcgugcguguguguguaugcacacguguguguauguguaucugcaugugugcguguguguguguguguguguguguguguguguguguguguguguaaagucuccucaaaaggaguauuucuuuucaagagagauaguuagaauacagccaccaagcuugccugguggcuggaaucccuuugaaggcacuuuucccuagggcgggucugagucagggugguauccugggguaugugcgaagcuacaauguuuccacuucguccuaaaguggccagcccuguucuugcucccuacugggguaggaaagcugccacugaucccaucucugauucaggucaaagcacagcagccuaaaagaacgcugggcaugaagucaguggugcugacuucucuuaaccuuggguuucccaucaauaaaguugggcugguggaaauaccggauugggggcaccuugagaaagugcaagacacuucucuacuguaaagccugcaguugagcagaaauggcauuuaggauaaagaggccaaagagaagaaugccagagcagaaaugagacggaacaaagcuugaaugucuucuuaauccuugaguauuugcagccaaggagggguuggggcaagaugggaggagaggcagcuguuauuuucuagagaagaaugccaaccuguuucuccccacagaggggaccacacaaguuauuucugaacuggaguuugcagucccuucuuuccuggaaaaugccuucauauggauuucuuacaucuuauuacacuacuuccuaucucccuuagacaaggagugucccuuagacagaucuaaaauaauaccauagagcuaacauuuauuguuggcuuuugccagguauuggguuaagcacccaacauuaaugaucucauuuauuccucauaacaucccuaugcugguugcugcuguuguccucauugaauagaugaggaaagggaggcuggaaaaagugagaugacuuauccaagguccucuuaccuacugaugcagguauggaaauacagacccgguuagacuuuuagccucuuuacuuuuuuuuuuuuuuuugagacggagucuuacucugucacccaggcuggagugcaguggugcgaucuuggcucacugcaccucagccucccgaguagcugggauuacaggcgcgugccaccaugccuggcuaauuuuuguauuuuuaguagaggugggguuucaccauguuggccaagcuggucucgaacuccuaaccucaggugauucgcuugccucagccucccaaagugcugggcuuacaggcaugagccaccacaccuggcccccuuuacucuuaagagauguaaguuacaauaagcgaugagggggugaaauuuaauucugugccccaaaccugaucagaagcuguuuuuaaggaaagagguggaacauugaacucuguucauucuggcuguuuugacucauguuauauucaucaguggacuuuuauuuuauuuuuugagauggaguuuugcucuuguugcccaggcuggagugcaauggugcaauuuuggcucacugcaaccucugcaccuacccuggauucaagcaauucucgugccucagccucccgaguagcugggauuacaggcauccgccacuaugcccagcuauuuuuuuuuugguagaaacgggguuucaccauguuggccaggcugaucucgaacuccugaccuugggggauccacccaccucccccucccaaaguguuggguuuacaggugugagccaccgugccuggccuauuuuauuuuauuuuuuguuuugagacagagucucgcucuguugcccaggcuguagugcaguggggcaaucuuggcucacugcaaccucugccucccggguucaaacgauucucgugccucagucuccugaguggcugggauuacacgugcccaccaccacgcccagcuaauuuuuguauuuuuaguagaaaugggguuucaccauguuggccaggcuugucucgaacuccugaccucaagugauccacccaccucggccucccagaguacugggauuacaggcgugagccacagcaccuggccagcagacucuuauugaucaguuauauuucaauacacaugagugcguuuugccuugcgguuacugaaaagaaacuuuucuuauuucucauucucuguguugacuuuacaauagcuaugcuuuuuucccucucauuagaaaggguugggaagauggcugcucuguaacugcagcuuuguuacgguugaaggucuuggugucagggauugacggguagccuguaccccuuggaauccuuagcuguaggcuuuggucuuuccccagccuagaaccagacuuggcacuuacuucaaggggcuugagauccugugcuugacccuccuuagcucaugggggaaaccaaggccugggaaaguuugagugauuugcccccagucacacacggggcuagacccagggccaggcuggcagguucccagcccacuggccacaugcuucuccuuuucaccugaauuucaaacaggagggaagaugaaagggauagaaaugaccagucagaggaguaggagggcugucauuugcaaacaguuucuuuugaucuuugccccauuguuuaaaaaacccccaccaaaccacaacugguagcaucagcacaugguucccuccgguucauugaggggcagucauuucucuuuuaagugggaagccccccccaccccuaguagucuguuucacuuagggcuccauaccuccucuccccuucugcuacucggcugccagaugugcuccccuucacaaaccuuucagagcuuuuuacugcuuauaggauggagucuaaccccgccuuccccuaauauucuaaagcccuugacauuuugugcccagucugucuuugcauuuuggcauccaaccacagagccccuugccucuagucaaagggcuccuccgaaugagcuuuggccuuuauuugcaucuuugcccacauucugcccaucuuucaaugcugcugccuccaggaagcucuguuggacuaaugcagcacccaguugccucugcugccuccgaaccugaaacaaucuggucuggcaacucauuugacacuuaauauuguuuuguguuguuuaacuuguagaugugucugucucccuaacuagauuguaaguucacugaggucaacagcaugccuucugaacugcuucguauuccccucugaacuguuucauauucccccacagcauuccacagggccuagguuguaugcugugcaaagaucugggacugaaaugcuauuaucuuucuaacuguuaauaggaauggaagaaauuaguuuccccaaaaaggaauaaaaugauuaacuagagagauuuuuaauaggaucugugcuacguuaggauuaauauauagguugaguaucccuuauccuaaaugcuugggaccagaaguguuucggauuuuggaauauuugcauauacauaaugagaugucuggggggugagacucaagucuaaacaugaaauucauuuguuucauauacaccuuauucacauagccugaagguaauuuuauacaguauuuuuaauaauuuugugcaugaaacaaaguuccucuuaaguacuuauguguggaauuuccacuuguggugucauguuggugcucagaaagcuucagauuuggaagccuuuuggauuuugcguuuuucaguuaaggauguuuaaccuuuacuuuaaaucggguuacuugaaugaaucagggaauuuuaguuuguuguaauuauuuuuuuguuuguguaauuuugcuggcaaacagucuauagugaaaauuuugaccuagaccccuucaagaugaaaguaaauaaaugcauguuauuuaaaauuugcuguuguugcuauuuagcacccuagaugccuguuuacuuuuuuacuuuguuguucuuauaacuuuuucucuaaguaauuucuuggauccguauucgcacuguuacaauuguguucuugaacauacuucuaaucuuuuuuagccauuaugauaauauauuuuguuuucuugacccuuucuguaguuuguuagguugauggcuuccacuggaauuuuagguuugaccucccaaagguggauccaccuguaugggaaagauuuguuuucccuucuccauccccucccagucccucugcguucuggccuuggguguaugaaauucuggccuugaacacaccuagcaguccuggcccauguccguuucccaguuaacucuuuugugcccgaucuauauguggcauguuccgccacagcuguggguggaaucaugcuugugcccccauauaaccuuuuccuucuuagcauuuuuuucuuuucuuacuccugaguuaaacguguagcagaagagguguaaagacacagggccagcaugaauagugcucccuuuuuaaaauguggaaaccggcuuggagaaguuaagugacuuauccaaggcuguacauccaguaaggagaaaaacuggccuugugacauagccccagggaugugcugugccccgugauggccccauauguugguguugggaguucaguggcucaucaagugccuguagcucuuaaaggaaaggaguugauaaaaugaagcaaccuggggcgcuuacuccaggggccauuucuaaucugauuucuguaaguaguggauuuuugagaguggguucuuguauuuccuccuggucugcuguguucauggguauuuuucuggagagauggacucuacaucccaaaacuggugaagauccccugauagaggugccgcuaaugccccuccccaugcagggauuguacuggagaagcugugucuguggccugcaccccucuggaagcuccagugaguguccuggggacacauuaggaaagucagaugugaucuacccucacacccgccagucucaaacggcuuuuuuuccuucuuaaaaguaagcaaggaauaaacuuuaaaaauagcaaagggucagaaguuccuuuuuuuuucaagcuuuuauuauaggaaauguuacauguagacuccaauagauagaacauguuauguacacaccgucccuccauauacucaccaucacccaaaauaguugucaacaccuggccccgcuuguuucacuuacacccccaugccacccucauguuauuuugaagcaaagccagccauaucauuucccugcccguaaauauuucuaaaauaucuauaaaagcuucuuuuuaaaaaacaugaucucaaggcuguucccacaaauguuaagcuagugauguccccucccaaggggcaaccccacacucccugagagaugguguauguguuucacugcucaugcacuggcagccacgucuagaggcugggucugggguggagcccaaguggggugggggaccgagcgggcgaggccauggcuuugcgcuggccgggcaaucaugaugaucucggaucccgcgugggcgcugugaugguaucggcuuugccccgggcgggaaccacaagaucaaaggcgccgcgcaccggggugcuucaaagccaguggagcagcccggauugaugcccagaaugagagcucucugcugauguaaucguagccugugagacagguucuuuuuuuaaauuuaaacaaagacaccccuuguuuguuuagugaggugaagcauguguugcagagggcacgcagcaucuggagggcuccacucuggccugguggguccaugguagggcaggaaugcugcaagugacuagaauuuucaggcgggcuuguagaucuuccauaaaagacaaccuguuucuguuaagaguaauuuuuuucucccuuuuuuaguauagucaggcuuguucucaagugacuuuccugaaauacugaaagugcuuuccucuggugggguugucaggcuuuggaacacaccuggugagccagcuaggaauucagaucaaaaaguagguaagcagccagggcaugguggcucacgccugucaucucagugcuuugggagguugagaggauugcuugagcucaggaguucaaaccagcuggggcaacauagugagacccugucucuuaaaaaaauuuagcuggcuguggugaugugugccuguaguccuagcuacuugggaggcuaaggugggaggaucgcuugagcccauaaguucgagacuacagugaacuaugauugcaucacaguacuccagccugggcaacagagcaaggccuugucucuaaaaaauaauaauaauaauaauuuuuaaaaaguaggcaagagggcugacuuuggucagucauuccuugggucuagaaaggaagcucaucugucccuucccuagaguaugugagaggcuugcccaaggcugguagucagaucccauccuguuggaaggagagaggggucuccaagaauauggcugagugccaggaucaccaccaccccuagccugaauauucucccagucucuguaaaaaucauagacauguggcugauuuuucugggguauucccaguuaagaugguaucccugccuuuaguaguugaucaguacacaaaucagugaaacccuguaccauacauaccuccaugagugaaaucguggucauauucuguuuucuugcuuagcaaaucuugcugacagauagaugaagaagccugccaaacggagucagcuuguuggaugcugagguccuucccaagaucuucccuacaucagaauucagggucaguggggucugaggcacuacucaacuuaagucauagugacuaaaguccacuucagcaucuuacagaugucccaaccaaacccagcauguguaaaaccagauuucucuucucuccacaaaccuguuucuguuagguucuuuuguuacuccagcuaaaaagcuggugucauucuaagcuguuuauccucaaugagguguccccuucucuaaccccaugaugccucuacccaugcacauugaauugucuguaaguuacuggaaggcaagacuggaaggguuuuuccuucccuuuuaaacuacaaaccagguuucccccaucuucuguaaaagcaccccccaauauugugaauuucaagcaugcaggaaaagugagaguuuugcagucgacacccauauacccacuaucuauauuccaccguuaacauuucacuguauuugcuuucuuacauuuuuuaucuaucugugcaugugaugggguuuuuugagacaagguuugcccaggcuggaguucaguggagcaaucaugaaucacuacagccucaacuuccugaacucaggugauucuccuaccucgugauggguuuuugauauuugaaaaucaagcacaugggggcugagauguuauaauggaugugacagaguauguaagguucccuuuuuaauuugguuucuaucacuuuuagauccaggucuccccuucucucccuaucuacugccuccccgcuaaccaaccccuaccccauccccuggcugggaauagcccuagagaucuugcgucuuuguucagacacucaagggagaacccaggaaguugcaccuggaggaccaccuggggcauggaguuugcuauggagacccuguuguguuugaaugacuugcccucucacauuuccuaaagccuacugcccuuccuucaucuugucccucucuuugccuucuaguggucuggccuuguggcuacagugagcaugugcacauucuguucagagacugcaguuuuuugugcaaugggguggaggugcugcugcagagcauggagcaagccagcugggugggacuucugguggguuuuaaauugauuugaagaaaaaucucuaaacaguauuuuguuucuuugauugauugauuuuuuuaaagagaugggggggucucucuauguuaccuaggcagaccucgaacuccuggggucaagugauccugccaccucaucagucuccccaguagcugggauuauacacacaucacccugccuggcuuuuuuuuuuuuuuuaauuuuauuuuuuaaagucaauaaaauaggccaggcaugguggcgcacaccuguaaucccagcacuuucggaagcugaggugggcggaucgccugaggucaggaguucgagaccagccuggccagugaaaccccaucucuacuaaaaauacagaaauuagcugggcaugggcaugccuguaaucccagcuacucgggaggcugaggcaggagaaucgcuugaaccugggaggcggagguuacagugagccaagauugcaccacugcacuccagcuugggcaaugagcgaaacuccaucucaaaaaaaaaaaaaaaagaaaagaaaaggugaauaaaacaaguggcugggcgcgguagcucacaccuguaauuccaauacuuugggaggcugaggcgggaggaucacuugaggucaggaguuugagaccagccuggucaacauggugaaacccugucucuacuaaaaauacaaaaauuagcugggugugggcacaugccuguagucccagcuacucaagaggcugaggugggagaaucacuugaaccugggaggcagagguugcagugagcugagaucauuucacugcaacagagugagacuucaucucaaaaaaaaaaaaaagugaauaaaacaaguuacuuuucuugagauuaucaauguaaacuugaguuuuggcugaguaggggcauuccauuggacuuggcaaagucagcuuaucugaaauguuaacgcuuucauagaaaggcuuuagcuuuucuuguaaaccugcucaaagcaccgggcgugguggcucacgccuguaaucccagcacuuugggaggccaaggcaggcgaaucacaaggucaggagauugagaccauccuggcuaacacagugaaacccugucucuaccaaaacaaacaaacaaacaaaaaaaaccugcucaaaggauccgggaagcccagaaaaauuugauuuauauauuaaaugagcauguuuugcaaaguuaagaugagcuacaacuuguugcacuuagaauggcuuuauaugaacuauuuucuuuugcuuugcucuguauccccuccaaaacaaauuaauaugugauucuguguguguuuguauguguguguaaggucuuuuagaguagaagcagcauucaucaucuucgcuguugugaacaggagcuggacaggucuacaagcuaaccugauucuuagaacagacuagauucacagaauagauaagcucuuuaucacauggcagcauauuuuaauuccagccuguggcuucccuccuuacgggagcucagauagauuucucuuuuacuguguguguaugugugucuauaugugugcaugcaugagugugcaucuuuagaagcaugaucugacuuugcauugggcuccuauggcuuccaggaugccaagagcugugacuuuagcuaccuggguaguggaucugcugacugugccuuuugugccaguguugugccuguuguauuuugcuguagcuauagaaggcagcugcacaggcuuuaaauaaugaagucaagaccaccaucuccaguuugauuuuguuuagagaccauuuuugguacaguuuagagccaguggauaauugcaaguugauuagugucucccaaccuucucuuuuggucuguauuuaauuuuugcccaaucuuuuuuaaauuuuauuuuuaaaguuuuuaagcccauagaaaaguugaaugaauaguuaguuguguguggcaaaauguuaacaguugcuugauuugugaauucucucuuacauacacuuaguuuugauuuuuuuuacccgcguuuuuacucacuuuuuaaaaccaccuuuuuaggccagacuauuugaaaguugccaacauaauggcauuucacaccuuaguacuccaacauauauacaucugcugagaccaaggauguacuccuaacugcugugccauugucacaccgaagaacuugacauauuuaaauuucucugauuguuccagaaaugucuuuuuuuuuuuuuuuuuuuuuuugacggagucuugcucugucacucaggcuggagugcaguggcacaaucuuggcucacugcagccuccaccucccggguuuaagcaauucuccugccucagccucccgaguagcugggauuacaggcauacgccaccaaacccggcuaauuuuuuuuuuuauuuuuaguagagacgggguuucaccguguuagccaggguggucucgaucuccugaccucaugauccgcccgccucggccucccaaagugcugggauuacaggcgugagccaccgcgcccggcccagaaaugucuuuuauagauggcuuuaaaaaauccaggacccaugcaagguucccauaagguauuuaaacuuuuaaaauauuuauacugaauagaugcacagguccuauaaugcuaacaagaggcaaaagacaaggaaagauuucucucacaauucuacuaccacaguuucaaaccaauuucuuuuucaucucucuguucuuuaaaaaugaagcuuuggacagauuuucuuuaguucacuuuccuaaccauccaugagacaaaaaaagaacacugaucaagacuguggugcuguuugacugcauaagcacaaauuguggucuuugaaaguucuugcugagagauuuggaguuuuauuaagaauaccaggaagccagcggccuuugaguaauguuugaaacaagagggaagaaaucaacuauugcuuuuguuuguucaaaagcugacuuuauugaugauauaacagugucuguaggucuugggauuccuuuuuccuuauuguagacgugguuucuccaccuuggcacugaugccauuuggaacuggauaauuuuuuuguuguggcuccuguccugugcguuguaggauaucgagccacaucccaggacucuacccacaggacgccaguagcaaaaccuccuucccaguuaugacaacuagaaaugucuccagacacugccagauguccccugguuaggggcagggaggggcaaaguugaccucaguugagaacuacuguucuagaaauucuucaggacuaacuuaaauugagauugacuguguuacugauaaauuucugcggagggacauuuucuuuuauaauaagccccaucccaaucugaaaauccagaagugucuagauguccacuggccaagggauugaaaucaguuggcagaugacaacugagugugugccuuuucacgauuuucacacuuuagcagaagccuuguuaucugauacuguugggaccuguaggugguuggguaauugaaaaaggucaguuaaauugaagcagggaaugauuuaaaaagaaucaucuuaaguuuuaauuaaagcuuauaaaagggauucaagcucaggccuuugugaauaggaccacagauaugcacuccuuacauuaaccucagccuugauguaucguuuaaaacauuucucucaguuugagaaaaaauagaaauaaaaaacauuuaaaaagaaaaaaugaaaauguacauuucugauggguuuuuuauuuguuuguuuuuucaaagcagaacaaauacguauaaacacuuguaaagcuaucaggaacuaucuagaauuuugcuuuuuuuugucuuccaaaguugcacuuagcucucaggugcuuuuuuuugguuuuuguuuuuuuuguaguuauuugccuucauuuagucuuucuauccaaaguauauucaacuuauuuucauagaauaaaauaguauauuuugcauuguuuaauauuaaaaucaguuacauaauuauaggaggugagucugcauaaacagaucuagaaacacauauagcucagcuggugggagcagugguguguggagguacuagagaguaguuucccagccaggagucugcagugcaugcaggcugaaguuauaggucugcuaauagccccugccauauucugaaauucauggaaagggccccagaggaugguuccgauuugagaguuggaagauuggguucaagccccgguucuguugcuuucuccaugguuuugggacaagcccaucaguaggcacaagccucagguugcuuaucugucaaaugggaaugauaguaaugcuugucuugacuacggagcagguuaucuugcagguuacacacaggccacauaacaggaaaugccuuuauaaauguuccauggcgcacugguauguuauuaaugagcugguuaugcugagccugagaugugcacuucugagaauguguuggcuauccuuugcucuuugagcacagagcacuugagccucacaguaagagauuuaggucagaagaggaauggagggggccuugcucaaugcaaauuuauacccacucuugcagaaacagcuuugggcuccugccaugcugaagguggaggcacaucacauggcugggucuuugucauagguuuugcuugaguggagauuacuggcuucucagugauaaacccagugagcaggcagggggugagaauaccaaggguuuggccagaguauaacaggcagccaagguucucauuacaaguccuuuacccaugcuuugauguguauacaaagugagugacaucgugaagauugugccacccuggaggaaaagaaguagucauuucagugcaacacuuuagggucuucuggaaaguaagaaauuauauuuauuuuugccaguaugccucuuuuguucuuccagugauucgucagcagguugacuaaaauuagagccgucugcuagucuugucccaucuaaugguuagauaaaucuugcacugauguucauaccuugaaggacccuuuuuuguggaacuucauguguuagagaaacugaaccuguguaaaauggagcagauccaauugcucuuuguaaccuugcucccugggcccccaaagaagcuagaaucucccaguuuuggccccguaggugaagauguuacuuugggaguacuuguguaaccugaagaagacugaaaguauauagcaguucucaugagggaaacccugggauuauuggccuaagucucucuucagugcagcagaaauucugcuguuagaccggcauuacugucuugacaaaaggggaaacaaagaggcuacuacauuguuagggagccccauccaucuguccacccaucuguccaucuguccacacacccaucuguccaccuacccauccgucuguccaucugugcaacaaugcaagguacugggaauauugcaguggaaaagacaaaaaccccugcccuguggagccaacauuguacuaggcaaaccagauccuagcacauugucacccuagaaucaggaggacucuuccugcccaguuccacugggcuagacauguaaagagaauaugugaguaauagcuaaacuuuggucuuacucagcuaaacuuuggucaaauggcaaaauacaggugagguuccuauggacagagaaggcagauggcauaauggggauaugcugagcucagugaugcaucacuguagacagcuugagaacucuaggcaugggccagcuugggacagaggccauggaagagacagguguagugcguggcaccuguagcugaggcuuagaugauaaccuuacucugcucuagcauggagaggacccguucagccacaccuguggucaucauugagugccuguuuguaaccaagguugaaaggauugaagaagaggucugugugauaagugggagguggaagagcugauggcuuaucuuagcuggggaggcuguucugucuccuggccuugguuuccucaccuguaaaauaaggccgguaucucaaaggucacccagguuaaaaaaaaaaaucuuaacuuuguugaguaagaauguaacugguugccucuuugaucuuugaucagugauccgcaugaguggagagaaccugacuuuuccuggugccugcugccuuuggagugagugcaaaauguccauuuugcugaugacaggcucccuguuggcauguacagagaaucucaggcagugugagaguguaguagccaccuagcaacauugggucuuugugcgcauguccuugugaucuaucaccaugcugcugcucaucuugaucuaagaugcauugccagucugcccugcauugacucagcugagaggcaaaacugggcagaaaagugggcuucugcaacuggaaccccaaaagccugggcagagcugacccguauugccuugaauccuugucuuggguguuacuggccaugguuggcucuccuuaagaaccgucacagaagaaagucaccaaaugucugucugcccaucaggagcucugcacuugaucucagcuaaaaggcugagaagagauucaucaggagcucuguagccuucuugauaccagcagugaaucuuuaauacaugucuucucuaagagauacugucuguucucucugaucuuucccaugcccccuuccucucccuucuucuaccuuaaugaaagagcaaaacggcuaauuauauggaaacaaagauugccaagguuuguauuaggaugaaguguguguuccaccuaugauaguggccaaaucuuccaaaguacaucaucugacauuuuagaauacagacuucccuuucauagcaaaccuguauuuuaauagcuugugguuuuaaaaauaucaucuaaacucaugaacuaacgcauucuucucaauuauaucccaacucuaccaucaucuucucuuucuucuccuuaacuucucuggaaauuauuggaaucugcuuuuaaacacuggggggauuguauauuauaguuguuuaaaaaugaaucaauuuaaguuugagcaaugugguaauucaaagcaguuuuagguguuauugggauuuuuuauaaagagcauuccugagccugaaugaagcagucaguuuuccugaugagccaugagcccauugcauuaauguuugagucuccuggugcucaugauaacgauuaaggaguuaauguuaccucugccauguuuaaacauuaaccaaagggcuuccucugcuauuaucuguuaucaacaauuacuuggaacauuuucuggcaguggagcuuuguuuuuccuccgaggagaugcuagaacaggaugagaauagacauuaggccacaucaaaggaagauucuugauuauguccaaagaaacucuggccuuguggguacagagaguuugccuccuuaauauuuuguaaacuccuaucacacccccacccccaccccaccccccccacacacacacacacacacucacucucucucucucucucucucucucuccccucccuccucccuccucccccucccccucaucugggucugaggaagagggcugcagugauuauuucauuguaucauggugagugguaccucuuuucuuauuugggauacucauuagaguugcucgguggagauggaaugaugguggggugcaguuaaacauggcugagugcuuucugcuuaaggaccugauguauuaaugcucuccaggucauucauauuugggggaaggaacaaagaggguacugcucuacugcagauguguucauuugcuuauuaacaaaaggcugggugacccagaaacuuaaacccugagaacaaaaguacuuuccagcuuccaaaugggaagaucuuggagacucuugaguggcuccucuggagugcuuucuuuaccaccuagcuguuuggagcugucgugccuaauagcuucucagccuagagggccccauaaaauuuuagucuguuucuguauagagugcuuuggaguggccguuucucucugccucuuauuuacucucaaauacccuuuggaaaaagagcugaugaggugcauugagacuuggcaucaaaagccauucauugauagccaucgcucaacucucuuggacuuaaauuuuguuaaacaacaaucacaaaaagucuuaaagaauuaccccuguuuccccugaauguugaaguaagaaagaaaagaauuacuccuguaaugcaagaagacauacucauuaaaaucuaaacagcgaaaaaguauaucgauuagguugggcgcgguggcucauuccuguaaucccagcauuuugggaggcugaggcaggcagaucacuuggggucaggaguucgagaccagccuggccaacguggugaaaccccgucucuacuaaaaguacaaauauuagccaggugugguggcagaugccuguagucugagcuacuccagaggcugaagcacaagaaucucuugaaccugggagauggaggcugcagugagccgagauagugccacugcacucuagccugggugacagagcaagacucugucucaaaaaaaaaaaaaaaaaaaaaguauauugauuaaaaaggggaaacccucccauccuguucuuccuguagauaucacugggaccagcuggguuuccaguuuuuuuuucugugcauuucucuauacucacacaugguuuugcauaaaugggauuauccuauacaccuguuacuugacuugcuggcccaggacuucucugaauguaggguaugcuagaugcacgauaacacagccccaucauggcuuguaauucaggcauuuagcguaagcugcuggguuucacuuuucuucuggaagcuucaggcauugcccugcuuucuggaugugcuaugguucuggauucuuccuuucuuuuucucuuaauagggcuugucuaggauggaauuucaaaauaacuugauucuuuccaucugagacacaagcacacaaacccuuuagcagaagguuuuuaagguugccuguguaccugcccuuugccccuagaggucccacugugagugccccagucacaugauccacucuggccuuaugggggcagcccacccuggcgcccguguggugaagccuacucguugucagguuuccagucauuccucucugcccuuagcccuguuguucuguggcuuugcuuucugggugcucugcccauguccucaguucauuucucucauuccggguucuuugccugaaauauccucacuaggcuccacucuuuggggucaagacugcugucuuugugcacuuggaggcuagccugucucuguugaaguaauguguggguagggugcccacaccaacaucccugacacagaucuggccagccaccuuggaucagccugcugccuucucccaucuccucuuagauuuguucaguuccacccuuuauuggcugcagaaaaugauucucuacaauucuuucacugugguuuaugauagaauccauuuucuuaaaucugauguaggaucacuuuccccagcagcaagguaauucucuuagggucuucaaaauggcuccccuacccgaauucccgaccaucccacuaacucagaggguggggagaggugaguagaugaugcauuugcuucaagaaguguugccuguacuucccauccaucaccaccagggcauauugaaccccucuggcaggcucuucuggugcccucugugaugugagaggaguucgggggugcagagugaacauagucaagguaauuuaggaagcuaagcucuccauguucuccuuggcacagguuucucugagucaguuggucacucccucccaaccgccauaguuuuguuucaccuuggggcuuuuauugugaaucuccacuuacggugcuccuaacaucuugcaaaggucuuucagccauaggucccugaucaggaaaaauggucuccucucugcacuccaguuuuauucuccuaauccucucuggcugagaguccugaccugacucagccacgccccagagccagagcccuggccacuuuuccagcuugguccaucucucaucucugccuauucagccuaggugucgugaccaucaugcccacccagcaugccacccuguguggucuccugccuugacaaggugugucccuugcccuggaguacaucagcaggcaacccugacuccuuucagcuccuagugccccgguaccucuccugggauccugagguccacucugcuggaugcccuggcagagcagcaggcuccugggagcaccugggauuguggccccugcuuccugggcccaggaagugcccugaguagcuacuuggugguggguggguuacuucugauccguuuauauuugcuguacuccagcccaccuugguuuuuucauccacagaguagaaauaaauuaaguggcucuaagaaguagugauucuuuuuuuaagguuggauuucugugcuuuucuuaaccauggcuuucauaguuuugcuaauagacaaaaacagucccucgacugccucugagaguagagcugaaauaaaaauucuaggcgucuucuacaguagcuggaguccugcacuguccaaggagucucagaauguaguaggaggggaagaagcuggggauuauauaucuaccuggaccauggaacgggaucaaagaagggcauugagcggccaucccaaagccagggcuuguaacuuaacaugacaccucauucaucugagcugcuacugcauacagguuuaggauucuuuuuaaauugugcaaaugagucucuaucuuuuaaacucuuagcugucaugcccuggcuggugcuguuauuauaaaauugagacuggaggccauacauuugaagacgaagacaguaauccgcugccaaccuacuucucucuuauaauauauauauauauauauauauauauauauauauauauauauuuuuuuuuuuuuuuuuuuuuuuaacaaaaggaaagaaaaaaacucaugccagacuuguuugucugagauuuaucacuguagggaucccagagacccccauggaagcuggcuuuagugguggcugcggcuggggacuggacagaacaggucagugugagcuugaacuagacugcgccugccuccuggugcacguacuguguuugggcauguguuggcucuuaaaaugcuguucauccaucaacauacugaccccuuuugcaaguuucauuguucuauuauugugacuauaaaaguggcacuuguuacaaaaccaguuucugugaucuagaaccguguucucaaacuugcaucuaucagaaucaucugccccaccucuagagugucugaucaguagcuuugggguggggccugagaaucugcauuucuaacaaguucccagaugcugcugcuacugcagcugaccuggcaaccacccuuugagaaccacugaucuagaagguacaaggaaaugaacaucgucuucagucuuaccacucgggagagaaccacuguuaacauuuuaggguauaaugaauauauucauacauauguggacauauuuuuaaaaacaaugauaguuuugugcuguacauagcguugcuuuuuaaaaaaacaaccuucuuucuuuuggaauaguuuuagauuuguggaaaaguugcaaagauagaacagagggcuccuguauacccagcacccaguuucucuuacuguuaauaucuuacacuauuauggaacauuugucagaacaaaggagccaacauugauacauuacuguuaacuccacauuguuacugcuuuuauugaaaauacaugaauguauuuucauaggauucaaauaucagaaauacauaaugacagagugccucuucacuccuaccaucccacuuccuauauauuucagaguauuuuuuauauauuuauauacacauguaauuaugcacacacacccauccaucuuauuuuaagacaugcuuuuuucauuuaaauaugucuugaaagcuuuuuuuuuucaguauaccuagaucugcaccauuauuuuuaauggacaacacauuguuuuacacccuuuuaaauauaucuuaucuauuuuaaucuagcagauuaaaggugaggucuggcacaccucccuuuuaucuuaaaguggagguuagagauuauuugcccuccuuuguggaguacuuagcguauucuaggcacugccaagcacuuagcguguauuaucuaaccuaguuaucaaaacagucuuacucauagguaucauuaucccuguuaacagaugaggaaacugagggucagggagguuaagugagcaaaaacuuuugacgacuuucuagcugaagcaggcugucucugguacuuugggugacaugagcuguucagcuuagggugaacauugcuugguuuauggagucuuccugagugccacaccuagugccagaauaugaaggugaaggguaugcuuagggaacucacagucuuauagcugaggggagauguauauauaaaacaaaugauuaugugauaaguauuacauuagaguuuguaagauguaagauggguuucggauaccuuaaaaaauccacuagaaguaaggcaugugcuuggaaccauggcagaacagauggaaguauagcaucagauuuggcaaucagacccgaguucuaauucugaauauuacuguuuagcugugugacucuagauaaggcauuuaaccucucugaguuuuugguauuaauaucucaaaauaggccaggcacgguggcucaugccuguaaucccagcacuuugggaggccaaggcuagcagaucgcuugaggccaggaguuugagaccagccuggccaacauggcaaaacuccgucuuuacuaauaauaccaaaauuagcugggauagugguaugugccuguaaucccagcuacuugggaggcugaggcaggauaaucucuugaauuugggaggcggagguagcagugagccaagauugugccacugcacuccagccugggcaacagagugaggcucuaucucaaaaaaaaaaaaaaaacaaaaccucaaaauauacuucauauguuuguuaggguuaagauuaaauaaauacauauaagaaguagcuauuguuguguuuaguaaauauguacauauaauguguuuaguauauuuagcauaaacguauaaucucugccacaucaguugcugaguugaaaccugccuuuaaaaguccuuggaaaguuccggauagaaacaaggacagaacgaaaucccccggucuuuuaucucuaagaccaaauccugaagcccucccugaaauccccugugcccucagucuuugcauccucagagcauucucuuaaugggccucacucccauuuacauguuauccuguuugugccgucucuccucugcaaguacuguuucucggagggcagaaucugugccuuucauucuuguguccccugcaauuuaauggaagcacauuaaauauuaguuguagaaccagaugcuguagaaaggguucacauccuacaccccaagucagguggagcuuacauguuaugguuuuugaagaguuuuuuucaccucuuccaaccauccuucccccacugguuuuuuagacguuagccuuugacacccaaacuugaguuuuaacauagaagggccauugagcauuuuauucaaaaagauuuuuaaugaauuauaucuugauauaugaguaguccucauuaugaauuaacuuaauccucaggucuuucacugugaggaaagauuuauguugauauuuucccccaacuuagaaaagcagaacaaaaccucagcaggccuaugucuuguguagccagggcaauucuuaccagacugccacagguuagagaaaaugcugcccauucuuuuccuuuccugcucgugcuuagaggagggagcauucuggcagggauucugggccagugaaauuggaauaauacuguaaagaaguuuugguugaagacaaggcuaaaugaauuaagggaaaggcuaguuucuuaauaaguuucugaguucguccuagaaagauugguaguuaaaccauguuccaugucaaccugaacugucuaaauaguaaucuugagagguauggcaguguuauuuuuuuucuccuucuggaaaaucagcuaaacuuguuagaguaugugaaaaucuacucuccuagauuugaagagcaggauucuuuuuggagggcaguuacagagccacacuagguuucugcuuuuuuuuuuuuuuuuucuuaaauaggagauugcucccucuuaagagagccaacgauuuagaaaacuuaaucacagguucuucuuccauucacacuuaaucuggucauucagaggcucuugcccuccccuucagaggcugcagcgccugaccuggggccacggaggucuuccuccucaaccuucagaagguucaaagggcaggagugagucugauucuuuggauaggggguuggguuggaucuuuuaaaauuaauuucugggugugaacuguaaaagagacgaaccaguagggauuuacucuccuccguaauuuacuauugcagccagaagccugaugguuucagcacccccacccagaaaaaaauuuauaaaaugaccaaaauguuacagaaauuuauuucauggagguuguucauuuuauggacaguuguuccauuuuaagcacuuugaucacccuccugauucccuuuuuuuuuccucccccuuuuuggacgucaguucucuggcauguuuagugacagaagcaaaagggcuguaggaaaucuuucuucauguaaauaaguaccuaugucucuccucauacuuuuauuuuccucuggcauuaaaaugagaagaguaggguaggggacuuggaaauccuaucacugcaaaaaugguuggcuuagaugccggugguggugguggcagccagggagggaaaucaagaguccuuugcaugugccugggugcaccugcuuguuuauuagaugcguggcuguaagucaucuggaguagugcaaauuuguauuuuuauugauuugaauucagagaagguuuuuggucuuaauuuaacuaauuuauuuauuuuucauuuuagaaauucaauuucagcuucacccuaauugucacuacuaaaauccuacauaugcaauucuaagcuuaccaaacugauaaaauaagaugacuuuauuacuuuuauuuuuuaaaauuucucguuuuccuuuucucuuuuccacuuggcugaggacaaauauagauaaaaucuuggccuauugaagagccaguaaaauguuguuuuauuuuuguuucuaaccugggauguuuuauaucugcaaaauguggugaagacagacccauucauuaaaaacagacugcucaacugggcaccauggcucacaccuguaauccgagcacuuugggaggcugaggcgggugggucacuugaggcccaaaguccucaagugaccagcauggugaaagccugucucuacuaaaaauacaaaaauuagcugggcgugguggcgcaugccuguaaucccagcuacucgggaggcugaggugggagaaucucuugaacccgggagguggaaggggaggcugaggugggagaaucucuugaacccgggaggcggaggucgcagugagcagagaucgugccauugcacuccagccugggcaacaagagcuaaacucugucucaaaaacaaaacaacaacaacaacaacaaaaacaaacacaaaccagacugcauaagucuucgacuucugagguuuagucuggaagaaauuucuggugccauuuuaguuuuguccugcacaugggaugugguucuuugaugcaguuucaggccugaagccaaauguguaccucuagcccggugaaccucucaccuguuuuaggaaauaauuuugagcaaaucauacuuucuuugaggaucugaaguuucucaacaaagcuugucugaagcuaugugaugugacgcgaugccgaugcagagagccuggaugaggcugcacagaugugcccaacugccugauagccugacuucucugaaaaccuacuaaaaccaacaggcggacuguucuuuuuuuggacaagaaaaaagaccuggcccuuucauauagcacaucaagccuugguagcaaccagaaacuaagugacaaaugcaagcuuuuagccccuuuccuucuugucccuagaccuucauaguuguagcuugucaguagaaagaacuuuggccugggaguugggagacuaccugggcuccagauuagcugagugaccucgggcaagucucuuaguguaucccaagaucuuucuccagagcgagagaguggaauuugauucucuagcggucucuuacccuggaauccuguaugauucuuagggguccgugcuacgucugagguuagagaucucagaugugaaagagacuguuugagguguccacuuaagagcugcaaacucuauugacccuugugucuuucaacuggaaaaaugagagcagcuucuacucaaauuaagaggugcccucagauuccccuauuuagauucugugaaccagugauaagucuccucuucugugugauugguguugcccuuuugggauguagacauuuuggacuaaggauuuagagauuuuuuuaccgagacaggauuguaugcguacuaagauguccuuaaagcugguacuuuccccuuuuaucacuaauggcugcuauuuccagagcugugggcuuuaucugaccaucuugcagguauguugaaagauuugacuagcacuuaaaagguauguucagaaaaugcuauuuuaaguguuucuucuuuacccuauuucccccuuguugaacagugcaaaacuaccagguuuuauguuccacugggcagcugcugcuggucugauguuuuucucucugucccuccuccuccuucugucuccccucccccggggguccucccccagugccucccccugccccauucuugcuccggucugaagggagcuguaccuuugugguucuucugcagcugcuggacuuugauggggacaugcuugcugccucuacacuugcuucccuuagcaaccgauccuuugacgaugaccucuugcuguuugccuguugucucucauguuggauuauagaugagagauuuaccaggcuggggguagaggccugcuguuagcacauuucuuuuaggguucccagcgucccucagccuguguuuucucucucuaaaauaugagguuuggagagggugcauguguguuuauguguggcggggauauuagugccgaaucaaacaguuuuaaguucauaggguuguccuaguugugagcuaauuuugaaguagaugcuguggugguuacugaagcuacuugauuuacuucucauuuuuauuauaaugugauuaacacacauggggggggaggggugccauuuguuccucuuuacacuuuccaaguguuuguguguuggcacuaaacuuguuuccugguguaaucugagcucugagaauugccaaauuaccuaaaucuccacacauuuuaacacauuuauuuucucccaaagcauuaaguuuuuguuuuauuuaaaguagcaguauuccuggacauguggcucuuauuuugcauggacagcuuaugauguuccguguguaacuaguuugugcauuucuguuuagcucgguggauuugccuuggacaaauuagggacaaggacauugugggacagcaagaauuccaaaagaaccccggauuaaggccaaaaaggaaaaaaaaaaaagccauuuuuaaagcuacccaaagaggagagucuaaaauaaaauuagcaaucauuuuuauaaaaagauacaagaaaauagauauuuacacacugcugguggggaggguggcuuguagcaguacaauguaucaagagucuuaaaaauacucauaccccggcuaggugcaguggcucacaccuguaaucccagcacuuuguuuuguuugauuauauagucuuugggggaacauuuuuuuuuucuaagucuucacaguuuagaggagagcuacuuaaagauuucauuauauaaacuuacuacuuuggcugagugcaguggcucacaccuguaauccuagcacuuugggaggcugaggcgggcggaucacgaggucaggagauugagaccauccuggcuaacauggugaaaccccgucucuacugaaaauaugaaaaaugccgggugcgguggcucacgccuguaaucccagcacucugggaggccgaggcagguggaucauuugagcucaggaguucgagaccagccuggccaacauggcgaaacccugucucuacuaaaaauauaaaaauuagccgggcgugguggcgcacgccuguagucccagcuacucaggaggcugaggaaggagaaucacuugaacccaggaggcagagguugcagugagccaagauugugccauugcacuccagccuaggugacaaagcgagacuccaucucaaaaaaaaaaaaaaaaaaagauuagcggggguaugguggcacacaccuguagucccagcuacucuggaggcugaggcaggagaauugcuugaacucaagagguggagguugcagugagucaagaucgugccacugcaccccagccugggcaacagagcgagacuccgucuccaaauaaauaaauaaauaaauaaauaaauaaauaaauaauaauaauacucauacuccuugacucaacaguuuuucuucuaggaguuuauccuuaaaaaaaguuuaagaugggcugcgugcaguggcuuaugccuguaaucccagcacuuugggaggcugagguggguggaucacuugagcucaagagcucaagaccagcuagcaacagaaugagacccugucucaaaaaaaaaaaaaaagucaaagauguguaucucaagacuuacagguaaggauguucacuaacauguuauucguaauagaaaauuacuaacaauaucuaacaauaaagggcuagcuaaaugauaauauuuuuguucuuauaguagaguacugugcagacaucuagauuguuugaggauacuuaaugucaggggaaaaugcucauaagugaaaaaagcagaauauuaagcaaugugucauaugaucguaauuuaaaaagaaggaccgggcacgguggcucacaccuguaaucccagcacuuggagaggccaaggaggguggauggcuugagcccaggaguucaagaccagccugggcaacauggcaaaacccgucucuauuuuuuuuuuuuuuucuuuuuuaagacggagucuugcucuguggccaggcuggagugcaguggugcgaucuuggcucacugcaaccuccaccucucgaguuuaagcgauucuucugccucagccuccugaguagcugagacuacaggggggcaccaccacgcugagcuaauuuuuguacuuuuaguagagacgggguuucaccauguuggccaggauggucucgaucucuugaccucgugaucugcccgccucggccuccugaagugcugggauuauaggcaugagccacugugcccggccccaucucuauuuaaaaaaaaagaauuguguggcauacacagaaaaagaaugaaauucuauccacaaucugucucuuugguaaugggauuuuuagugcuuucauuuucuucauauuccaaguucuucaguggucagguaucacagauuguguauccuuaaucugaaaaucugaaauuugaaaugcuucaaaaucugaaacuguuugagugcugacaugcucaaaggcaaugcucauuggagcauuucagauuuucagauuagggaugcucaacugguccguauaaugcaaauauuugaggaucuggucccaagcauuucggauaagggacaccccagccuguaguuuuauaaguugagaaaacuuuuguuuuaauugacucuucaccccccgaaaauuauuuugagaauauuuugucuaaagcuaaggacuuaauagaugaaccaagacaaugacuuuucucuguguuucuucuuguuguuguuagaauguguuuguggguuugugcuuuuuaaaauuaaagcccccuuuuuucuuugugugagagauggcuuugggguuuuuaaguugcaguguuaucugaaggaaguuauaucgcuuagcaggaacucaguacaauaaugugucauccuucuguaaucauguaaugaugccugacuucaaaaugacuuacuaguauuugggaauugguguuuggacugguuguuuaugagaaaguccagguagaccguccauuuacuaaauacggacgaauggcaagggacuugggagcuuucuguuugauggugguugaaaucacuaguuauggaugccaucuuuauuuggaaauguuuguaauuugggaagaaugagaaguguuagcagaugaugguucuaugaacaguuugucuaggagcaucagagugggaggaggguguucuggggacuggggaguggguuucauuuguguuuggcaguagcuggugauggcuguugauaguugaaagaucuauggucucuguugaggaguacuugaccaugagguugguugagugaggaggugaguagcuaugagaucacaaccugacaggccuuacgcuuccucagccuucacugucaacaauugcuugggaaaccuguaagaauggggagaagagaaauauagcagccauaucuugggcagguauugagaggguaguucaaaauguuggaauauggguaaaacuagaaugcugcacuucuauugggcucaucauuugggagagacuagugaggguagaguugguucucuuaaguugguuuagucuuuuaacacuuuauuuugaauccuuuaaauaagcacauaugggaaugcacagguagauagaauuuucuuccacugauaacuugcuaucagccauguauuacugaguaguauuucauuguguggauauaccacauuuuauguauccacucuucagucaguaggcauuuggguuguuuucacucuguuuauuaugaacaaugcugcuaugaauguucauguacagcuuauggacauguuuucauuucucuuggguauauacuuaggagcggaauugcugggucauauuugccacucuguuucaugucuugaggaauugccagacuguuuuccaacauaucuauaccauuuuacauuucccaucaguaguguaugaggauucuaauuucuccauacccucucuaauacuuguuauuauuuauauucuuuuuauuauggccauccuauauuagcagguaugaagugauaucucauugugguuuugguuugcacuucccucaugccuaaugacguugagcaucuuuucauguacuuauuggccauucauauaccuucuuuggagaaaugccuguuuagaucauuuguccauuucaauuggguuacucauuuuguuauugaaucauaaggguaguuacacuuuuaaaguguuggaucacaaagagauuugccaucugagaaguuagaaucaaacauuuaaaauucauuuaagaaugguuaaaaacacauuacauguuaacaaaaauaacuuuuuuuuuugagauggaguauugcucugucaccagguuggagugcaguggcgugaucucgacucacugcaaucuccgccuccuggguccaagugauucuccugccucagccuaccaaguagcugggacuacaggcgugugccaccacacccagcuaauuuuuguauuuuuaguagagacgggguuucaccguguuggucaggauggucucaaucucuugaccuucugauccgcccaccuuggccucccaaagugcugggauuacaggugugagccacugcgccuggcuacaaauaacguuuuuuauuuaaaaaaaaauuuuuuuaaaaaagaugugguccugcucugucgccuagacuggagugcaguggcacaaucauagcuccaugcagccuugaauuccugggcucaagugauccugcugccuuagccucccaaguagcugggacuacaggcaugugccaccaugccuggcuauuuaaaaaaaauuuuuguagagaccgagucuugcuuugcugccuaggguggucucgaacucuuggcuucaagugauccucccaccuuggccucccaaagugcugggauuacagguguuggcccagcaagccuggccuaaaauaucuuuuuguuuuagaaaauauagugagaaaaauggccuuguuuuauauauuugcaaaucucuuuaaugccuggcuuaguaagacaguuggauucuugcauccacuuccguaccuagucuguugcaauaugcuuugguugaaguauaacuaagaaaaucuagccuuacacagauauguaguuggaaaagggaggaguauuuuauagccuguuaagauauuaguaauuaugaguauucuuugauacuauaucuaaacuggacaagagguaguuucugaaagauuaguugcaauguagaaucugaaaccaugucaaugaacuauuccuacuguuucacuuugaaaucuauuggucucuguugcauuuugaauggaucuuuuacuaaugaaugauuuuguauuaucaucucaugcauuggucauuuagaaaauauugauucacuuagucauguagcucuuccaaauacuaacauuucauuauacaguacuuaaaaauucacauuuaauuaauuaauuaauuauuuuugagguggaguuucgcuccuguugcccaggcuggagugcaauggcgugaucucggcucacugcaaccucugccuuccggguucaaucaauucucuugccucacccucaugaguagcuggaauuacaggcacgcgccaccacgcccagcuaauuuuguauuuuuaguagagacggguuucaccauguuggucaggcuggucucgaacuccugaccucaggugauccaucugccucggcuucccaaagugcugggauuacaggugugagccacagcacccagccuauuuauuuauuuuugagucagggucugacucuguugcccaggcuggaaggcaguggcaugagcuaggcucacugcagccucuaccuccuagacucaagugauccuuccaccucagccuccaagugucuagggcuuuagcugcaugccacugugaccagcuauauuuuuuuauuuuuuuuuuauacugaugggguuucaccauguugcccaggcuggucucaaaacuccugagcucaagcaaucuuuccaccuugaccccacaaagugcugggauuaagcgugcaccacugugcccggccaaaaauucacauuuguucccaacagaaaagucucuaaguaucaggauucugucagacucauagugauagguacacauuucccaaaaguuuaauuuuugcuugagaguucaaguuuuaucauuggcaaaaaauauuaucaauuguuuccuugaaguguuagucucauuucauuccuuuuugagaaaaugccugcccugcacucaucuauauaacuguacuuuaaggucaguuacucguuuaaguaaaaaugguguuccgugaaaaaaguugacuaguuuggcuuacagcuaacaaucacacaaguauuuugucuugaggcaaccacugugcuuugguaugcagcagaagugcuuuaugcguauuuaaccauuucgccacgcagaauuuuuuuuuuaauguacucaaggguugagauuuaauaaacuuaauaguuuuuauugcuucaucugcauugcuucaucaacauucuuaaggaaacuuuuauuucaauuccaaguauacaaugaucaagagugcaguuuggugucacugcuguaauucuugcaacaguuuuucccaccacugcuuuuguacaugaaucagugcaaaugucagcagacuguaaaaggcuaauaaugucuuuguguuauuacaaaaaugguuuugcccucacagauuaccugaaaagguugaaggacaaaccuccacccaccgcccccugcccugggcuugcagaugggaugagaaccacugggcuagacagcauuuaauggaaauggggauaaaauuguuuugaaggugcuugcugcucuguugucugagacugguagcauaaacuugcauggugauagcagcaaaauguguauaguguuguguaccuuguugcguuguucuuuccagucuuuagcaauaugcaaaaucacaaagcacuaaccacugagacuccuuugaaaauaaacugcuuccucauuuucuucuuccuuuccuuuccuuucuaacaagaaaagcaccucuucaccaccuaccuugcaaaugugcuguuucccuuauuucauguuuugaguuuuaaaaagacaguggcucuuuagggccuuccuccauaucucuguuucugaggauacuccuuauacuuagaacgcuugacugaugucuaguucaggcccaggccaguggcuggcaaugaccucauucuugccauguaaauccuuacugaauggcaugagacuccaacuuagcaguucauggaauuguaaggugagcccaguuucccagccaauuaugacuccaucuaaagccguagcugggccauuaauguauuuugcgccuuguccucuuuuauaucuugccaaacucugagagucuacuguauagcuacuggcaacaggccucugccaaaacagucuaugaauguaucauuuuacaccucauuuuuccuuguuucccccugugauggcaccuugccuguguuucucucucccacaucuuucuacccacuuaaaaaaauuauucauuuaacuuauuccuuuauugugguauuauagacuuuuggcuucuguaguuauuuagugugaaagagauacugaagaaugaaaaugcuaauaucuucuuauagcgcccuuccuuuuucaaccacuagugguucuccuaagggcccucuucuggguugaauuguguccccccaaauuuauauguugaaacccuaacucccagcaccucagaaugcgaccuuuuuuggagauugagucuuuacggagguaaucaaguucaauuaaggucgucagggugggcccuaauccaauaugacugguguccuuauuaaaaggggaaaucuggacauaugcacacacaccaggaacgugccaagugaagauggaggcagugauuggggugaugauuccacaagccaagaaacaccaaagacugccagcagcccaccagaagcuaggggagagguguggaacagauucccucauagcccccauaaggaaucaacccugucgacaucuugauuuuggacuucuagucucaacugcaagaugacaaauuucuuuuuuacccaguuuaugguaguucguuaaggcagcccugggaaaugaauaccaacucaaagcugacugcugucucccauggcccugugguucucuugcucaccuuggaccuuuguucuacaggucacaccacggcuggucucccagggugaccugugcgccugccauguaagguuccuccucagagcagugcucugugacugcucacgcuaaugaagaaugcaagguugaggacuguguuuucuggaaagauggauagagaugguuuagggacucagagauaggcgacuccauguaccugcucccaucccguuugcauguaccucuuccccuguguugaugagagguauuaaaauccugcuggccuccacuugcuccucuuccccguggagcaaggagcacugagccagcauggguauaucuggcuuucuuuucuccgagugcauucuccaugggacccuccugcggguucccagcugaccgcugguuugcaccacacagccaggagaaguggccaagaaaagcgagcugcuggauggaaugcucagggccccaaaacauuacucuucgugauaguuugguucuugccaggauguccuuguaaaacuuuuaugaagauguuguuguacuugcauuggagguugaaaauugcuguuaaccuugcuaagucccaugucccccaggaauguggaacgcuauggaaaugcucuggcccucccuucuggacgggugcuccacugcagcagcugccugcacagaaaguugagcuggcuggcuggauuaagggacaucagcuaggccuuuguuuaaaaauauuuaaaauauguuugaaccucccuuuaucaacaaagaacaguuucuuucagcagagagaaguuuuucauuuccauguuuuuuuuuuuuuuuuaaccauuuuguuugguucuuuuguauauuagcaacuuuggaaaaguguucccauucacaguuugaaagccaaguauaaaagguauugcaucguuauuuucuauuuugcuuaagagaaaagagcaguuugcuucuauuaagaacauaauguuuaugaagauaaucuucuggcuugaguuaauuuuuuucuggugucgagcuuugacaguuaaaaagcaagaauguguuugcgaauguauuuaaaacaucucuggaauuaggaguuuaugaagguauauuagguaaugagaaugagcuuuggaaguuacaaagaaauaaaagagguuccugugucugagucugcugguaugagagccaggaguauuaaccuauggagaguccuugacuauuaggucuuuugaguuaaguuucaggauaaggcagcauuuuucuaaaauccagguuuucccuugccugccuuugugaugaucacaguguguaucagguuucugcuuaacuucagaucuucuuuggguaucuucccaguguuauuagaaaccugagauauuucccuacuuacuugcaggaggagccagcauguugcauaacugcaggggccccauucaucuuagaguguggauuagaccagggugucaagggcccuaggcagcgugcagugcuaugugcaggugcuagcagggaaggcaugguaggugaagguuccuguuucuugggugcauuaauauggaauuacuuuucaaaacguauccuagccauacccuuguuauuccauguuuuuaaaccagaucauucaucuugaggaguacucggccaacucuagguacggcuuuuccuccagccccucagccacugcuugacagaguugugaggccacagccugugagaaaucaaucuggagaauuauuaguugucucuuaaguugcuuuaaaaucgccuggaggccaacccugaaguuuaggaaaagagugugcuuguguuucuccuguugacuucuuucuccuccaaguguucuuguccuucaguugacucuggagacuggaauaugaguaaagaacaugaaagggacuuuaguuaaacauuagaaccuuucaaguuucagggcuucaacugagcuuagugacaugccaucaacgaccaagguucccauauauccugaaaggauauuucucuaaggccaguuaggcaucaaucauuaaucagacacuuuacaaaugguacuuauauuagguugaaucuuaugaccuugccauuuuuguagaucagaaauuguuggauauuggcaguuucccaugguuuuaccuggaguacucuggagaggccauguagcauugugcuucagaauagggaccugggaccugugggccuugugcuaggcuggaauuuucaccuuggcacuuauuuguaugugacacuggacaggucacccacugccauugacugccauugauugcucugaaaauggggcgauugugguuccacaccauaggguuguuuuuaagauuaaauauguccauguauauaaagcaccuaggacagggccuggcacacggcucacucuguguguguuuuuuuucaugacuucuucauucuuaggaccuucacaguuucugccauaucugcgugccagcuguguagucauugucuuggucagcacaggcugcuguaacaaaauaccauggacugugugguuaaacagacauuuauuucucauaguucuaggugcuggaagucugagaucagggugccagcauggucggguucuggugagggcccucuuccuggcucacagagcugucuucuugcuguauccuccuguggcgaagaaagugugagugagugagcaagcucucuggcaucucuucuuagaaggguacuaaucucaucaugauggcccugcccucaggaccuuaucuaaucuuaauuaccucccaaagaccccacgcaucuccaagugcauauugggggaguuagggcuucaaaauaugacuuuuggggagacccaauucaguccacagcagucauuuauuuaguguuuuucuuuaaaagugacaguuuuuaaaacaggaauaacuuaucuuguugauucuuggaugcuuuucuuguuuuuguauaucaucucugaaauuagaaugucuuuuuuuuuugagucacucuguugaccaggcuggagugcaguccaugaccauggcucaccacagccucuaccuccugggcucuagcaauccuccugaguagcugggacuacaggugugugccaccaugcccaacuaauuuuuguauguuuuauagagacaggguuucaccguguugcccaggcuggccuugaauuccugggcucaagggauucucccaccuuguccucccacagugcugggauuacaggcgugagccaccauaugcugggcacugugggauaauaucuuaaaaucugugaaauguccugguuuaauuuuuuucuuguccacuaaaagauauaauggcugauggcaucacagguuugguggaaaaugguauuuuugguguuuuuuuuuuuuuguuuuuuuuuuuugagacaaggucuuguucugucgcccaggcuggaguacaguggugcaaucauggcucacugcagcuuugaccuccugggcucaaaugauccuccugccucacccucuggaguagcugggucuacaggcacgugccaccacacccagcuaauuuuuuaaaauguuuuguagcgauggagucuugguguguugcccaggcuggccuugaacuccugggaucacucaagugauccuccuucaccagccuuccaaaaugcugggauuauggggaugagccaccaugcugagccccuuuaaaaugguaguuuuuuaaaggaaauauuaucaagaguuugugcuaguuauguuuuuccaacccauguuaaaaugaauaaaugucuguuguuuuaaaaaguccuccuguguaccaccuugcagccucuguggaucagcaguggacuccuggccuacccucugggaaacaugaaugugguguauaguuuuuggaucauguuuuguggagcagcauccucacucagcauagcugugcuuugguuggucucacgcacugaaguguuacuuaagguuuggauuaugggaaggacuuuuacuacuaaagacguuggaaaaccauauguuuugggaggcugaggugggaggaucaccugagcccaggaguucaagaccaaccugggcaacauagcgagacccugucucuauuaaaaaaaaaaaaaagagccaggcaugguggcucgugccugugguuccagcuacuugggaggccuaggugggaugaucacuugaacccaggagguccgggcugcagugagccagguucacaucacuguacucuggccuagaugacagagugagaccuugucucaaaagaaaaccacaucaguaagccaucuucucguuugccucacuaacauccuguugaggugucccacaaaccaaacaggaugugggggugcggaggauuauccccucuaggagcaaguugccccaucugguugagggagaggugguucugucaccaguagagcauguugagugcugcagagauggcuggcgacggggaugucuggccuggcagaugucaccuucaaggagggagugugcucauugcaggcugcuuucugggaugggaguaggcuaguaaugugauguguggggccuucccugaaauagaaggcacuggacaggcauguaguauggauaagguagagagggugauggauaguuuuggcuuuccuugugaggugggcaugcugguggcauguuuuagauuuuccgaauggccuuuguuuccauuuccuuuuuuuuuuuuuuuuuuuuuuuuaaagcugcauccuuuugcaucgaaugaaaccccaucaagggcaucuccuaacucuucuuccauucucuuguccagggcugguguuuuuuguguguuugugacugacaaugcagcauggagaauuuggagaagcuaguuuugccuuuucuccuacaggaagagggacucgucugcaaagaaaggggucugccuuucaguccuuugaagccaccuggucugacaaagacaguuucccugucccuuuuuggaccuugagcugagcaaaaaauuacuuaguugcugaaagcaggucaguguagaggacuuccucuacuccugcuuugacuucaucugcaagagagcugagaacugagugaggcauuucugcuucuugagacuucucuugguguggcagggcuuccuguccaggaggggcuccauugccucaugcccuggguauaaacagucccagagggcuuuggaaucagccugggucaauucuggaggaaaaauaaggccuaauaagcauggcucuuuucccaaaauguagccacaggggucuaagcagcugauugugggguccagggccaccaggagucuuggcuggccuagcauaucuugauuuguuaagaagguggauaugaauucagucuagagaagauaacgugccuauugugcagaaugcagggcuuuuuguucaaggcugucuccauuuggaaguagaaugacaaagcaguguagauuuacacagagcaucucugagucuguuacaacccuuaaguuuuaugguuucgagccaggacaguacuucuuacauucugucuuugucaagggcuuuuguaguccugagauuuuacuguggugcacugguuaugagaugagacucauaguuacaaaauuccaaacugaggauuaucaucuagaaccacuccacaguuggauccuuggccucacucuucacugugucacucacagcaccugucacaaugcauguauguuacccagagggugcccaguaaauuuacugaacgaguuucuaaacuuccaaauugcuuucugauuggauaauaaugacaguuuuuguuuuguuuuguuuuguuugagacagagucucgcccugucgcccaggcuggagugcaauggcaugaucuuggcucacugcaaccuccgccuuccagguucaagcaauucuccugccccagccucccaaguagcugggacuacaggcacacaccaccauguccagcuaauuuuuuguaucuuuaguagagacgggguuucaccauguuggccaggcuggucucaaacuccuggccuugugauccgcucgccucggccucccaaagugccaggauuacaggugugagccaccacgcccggccaaugacuguucuuuuugagaccuuggacauuacacugaauccagugaaguuucuugagacuguaccgugauuaggggugggaaauaaauguugugugcaguuuuggaucuggagaacuuugugggagugaagagccaagaaggaugcuuugaaaagcauaacucuugcugggcgcggugguucaagccuguaaucaaucagcacuuugggaggccgaggcgggcggaucacaaggucaggagaucgagaccauccuggcuaacacggugaaaccccgucucuacuaaaaauacaaaaaaauuagccgggcguuguggcuugugccuguagucccagcuacucgggaggcugaggcaggagaauggcgugaacccaggaggcagaguuugcagugagcugagauugcgccacugcaugccagccugggcaacagagcgagacuccgucucaaaagaaaagcauaacucuucucuucuguccacuuguuaauaacagcuaagguugcaauucauggaacaaugaguuuugucuuuucugaaacuuaguaaccacuuggucuaucaacaacuauuugaguaguccacugggcaggcaauaaagcagugaucaguagauuuggagauggauaaaacaguugguuuucucucacuccccuccuuuaggggagggaaagguauaugauacagugauuaagagcauuaacugagguggcgggcgguguuagagugucuuuuugaacauggguccagcugacuguuucuuugggucuaugaccuccugagcccagguuccuuaucaucccauggggcaguaaucacucuccugcccaccucacagggaggaaguggaugugaccugaauuaugaguuguaaagaccgaacacuggaaaugauugccacugacggagagaggguauaagaguggcccuuuuggaguacagaggacaccaggagccucaggcucaugacuggccucauuugguucuccuccccuccuuguguaccaaucacccaaggaaggugauucauuagacuucauuagacauacuucccaguucagcuucugucuuagcucagaguaaacaagugacucucuguucagaaccgaaugaauugcaucugguacuuuuaguccuugcgucuuacagcaaagauuaaaugguacucuggaggcuuggcaagaugagacucacuucaucagcagagaagaauggagucacuugggagggagcacccguucugguaugaaauuucuccugaucacaagugcuugugaaaauuaaccuuuugcauacucucauccuucucaaggaaaggcugaauugcuucucaaguuuuguccugcagccuugggugagaauucugguuuuguugcaaagcuagagcucagaaacaagaaaguacaaggccauuuuucuuggaggaagaaggcaggcagcucagcuugcaugagcaucugacccagcagcccauggcucccuuugugggaaguguccccuuagcuguggaacccagguggguaggugaacaccucaccuuaugacugccacaccuuaugacugcccauuagcugcugcgccuccucuccuccuucucuuuucuucugucuuucuggaggaauagucuaguucggguuggagaugaaccucuggccugggaagaccucuuucaaauaagauuaugcccaucuguggcuuaagaaguuacucauucaccaaggcacaugcuugugucuagaaguaauaccaucauguuaccacaguaauauuaaguagaacauacacaagugccauuuuuguaaauaaaaucaggaaacuagccauuucauaugguaauucccaguaacucuugagaaucuugaguugugauuucugucauguagacaaguaugauggaccgaauauucauuucauuucucuaccaaauucuuguguugaagcccuaacucccacgguggugguauuuggugauggggucuaugggaggcaguuaggguuagaugaggucaagagggugggaccuucacagugggcuuagugcccuuauaaaaagggacaccagggagcuugcucucucuuucuccccuuguaugcacaaagaacaggucaugugagcaugcagggaaaugguggccaccacaagcuaagagaagaggccucagagugaaaccugccucaguggcaccuugaucuuggacuucccagcuccagaacugugagaaaauaaguuucuguuguuuaagccucccagucuaggguacuuuguuaugauagccugagcagacugagauacuuaguucagauagaaagugagaagcuaauuugaauauguucuuuaucuguucuuggccuguuuucuuuggucugggcaagucauuuucaagguguucugugaaguucaucuucaucagaaucaccugggaagcauguuaaaaaaccagagucugggucccaaccccagagauucugaugggaguuauauguguggcuggacugugcauuuuucguuuauguuuuuuucuuugagauaaacuuuacauggagugaaauguacaaauccuaaguguacugucucauggguuuuuaauaaaugagucccuuugugagacccaaccccugucaagauagagaacaacaugaccaucagcccagaaaguucccuggugucccuucccaaucaguccccacuggggaucuucaguggcaucccagagcuguuugcuaugguggcaguagcuggagagcuacuguuaauuaauuugagcaacagugcagcugauaaauuugaucuagcagggaggucugggacugccauccugaacucaagguucucaaauccuguagcucuugggucauauugauaggggcuauauuuuuaaaaagggauaguugggcagcugguuggaaggaaauggcaaugaguucaucuuugggccuguuuacugcccccuuuugaaacugggucguuuccaguuccgaguggggaggcugcauuguuguucugagucucagauuggagcccauuaccugccaggcuccugcucauucuuacuuccucuuggagggauccccagcaauuccaauuccacuaguaggguuucccagccgaucacucuucccuggcuguucucagucauucuaaguguagaagcuacaucauccuuggcuucugccuaguggcucacuuaaccacaucaucucaauuuaucauguugcuguuuaucuuuuuaacauaaaguuuuauuaugugacauacuaucucagucuguuccuuuugcucuaacaaaauaccugaaacugggugauucauaaaagaaauuuauuucucacaguugaggaggcuggaaaguccaagaucaaggugccagcagauuugguuucugcugaaggcucacuuucuccuuccaagauggcacaaaagggucaacucuucuucaagaccuuuuauaagggcacuaaucuguucaugagggaagagcccacacugucuaaucaccucccaaggccccccaccucuuaauaccaucaccuuggggguuaaguuccaaagugcauuuuggagggccauauacauucaaaccauagcacaugcauuaucucauuuaauccagagcuauugguugacaucccaucccauugggacaagaacacacaugugauaguugagcuuaaagugucaaaauauggacaguauucagaggaaacagugauagugagcuggaggguucuagaaagaucauguggaggcaauggggcaagagcuggaccaugaagaauggauggggcagaagaugggcaggcaggagaaugggggauaaggaccuccuagugacuuaggugaauuuaguaugacaucuugguuuuauuaaauaaguagcauuugauacucuuuagucuacuuuaccuuuuccuuccaacaacucugugaauuagaaagggcagaugguuaaaucuauuuauuguugagaaauggagguccagaggggaaaaaaaugcuuuacccaagacacacagugaaauuaauggcagccugagcuucucaccguugcuauuugaguuucuccauguuacuugaccacccacugguaucugaccccaaaagaccuuccuugcugacuuccugugguauuuuauuuuguuuugcacagcaugguacugcuauuaaaaacuaaaucuuuuaaaaacaacauuuccucaguagcaucaaacauaugucuuuaucuucuugauucaagcugguccugacuuuaagauaucuugaggagaauaggguaagaauacauguggacuuucuuccuugagaauauagggaaguauuagauuucagagucugagguuaacacaguggucaccagccuaauguggcuauuuaaauuugaguuaauuaaguaaaacuuaaaauucaguucucgguuugcauuuaccgcaucccaacugcucaauagcaacauguggcuuguagcuccuacauugcugguauagaaacagaacauugccauuauugcagaauguucuguuggacagcacuagccuaaagcugcugucucagcuaagugacuucucuguaaccucugacucucuguaacuucuaacuuguaacuucuguguaaccuuugaccuuacaagguaggcuuggagugcagaggggugcaaugaaguugucugugauacuuaugcuuaucucaggccauacuguaauguucucugggucagcucuccaaaaggcacaagcagucacuuguuuuucacagagagagaaccccugauucuagcuauuauacugacucucguagaggugcuacaggcaggccaugauaggaucuggagccacuguguuaucauuucuuccauaguuauagauggagugcuccaugugucauuagucauuuacacuguugugugugucagccucaaugucuacccaugaggauacaugccuguauuuggggagguaugcaggggaggacagcugcagcccaaaaagcuccuauaugaaggaaugagcugccauacugaugccuccauucuuaagaauguucuguguugugguugcuggucucuggcugaaauuugguacguacauucuuuaguuugcaagaauaaaaggcucagugcaguguuauaggcaggggucugcucuuaguucaaaugcauugaaggaagccguuuuaugcacaguggcuuguacccugaacauccuuuuggaaagacuaaacaaagaggguuauuuugugacuucaccauauacauggccugaauggaugguaagacuguugaauggaagguuggguagauuagagugugcuaccaaaggcaaaagggcucuggccaggggcccaauacuacugugaacaggaugcaaaugaugguggucucacaggagacacacuaaacggggaguugggugggacuggagcuaaccccauuuaagguccucaagaccauguaaugaagcaggaaacccaacacacagagugcaugaaagcaggacacagagaugaauccugaaugggcagagggccccagagagggagacagugacuuggguucuuuaagggcucacaggcuauagccacaggcuacagauucaccucauugcauccccugcuucucuguaauugcccuggugaguuuccaaaugaagggaaagagccaauagcccuuuaggaagagaugcacuagaugaaaaucaccugauuaaaauauugcuguuaaucgcaggagagggggguagggagggaaaaaaaccacaggcucaagcguuaaaagcaauaaauuauuuguuaggcuuugccacccaguaugaccuugggcaaguggcauaagggccccauucucucugauccuggagcagggggaaugccugccaccugccuaccucuuggggguuuugggaggauuaaugacauaaugucugagcugugcuuugggcuccuuggagacagccacuauguaucaggaauuauuagcacaagcuaggacaguuucuugacuauucuuuaccucauuaagcuaccuaugccugauuacaucugcuuauaaaaguugcugcucaaagaagaguggacugggaaggucauaacccaggcuggaucuguccugguugguuucauuaaagccacucccuaaacccacacucaucagcaacagggcaccuugaaagcuuagcacaguacccagcaucuaaugccagagacggaugguuaaaaagaaaagaaagaagaagauccuguggacuuuuugcacuucuguguuuuguguuacuacuaccaacccaccuacauucuagugcaccuaggggagugacugccagguugccggggaugagggacaagcuccaggagucuucagcuacucaguuuuuagaaugaguagcugucagauggauggacagguuuuuucagugucaaauuuugaggcaaccgacuaaagaaaccaggcggcucuaaguucacauaccaagaaaccuauauugauuguguuucuaagugagggcaaguccauguuguaugaauguguauuauguguaaaagacacaaaaaaguauauucagugugggucucuauccucaaaggucuucauccaguuggauaaauuugacauuuauuccuagaaagcucaccagccuugauauagaccaggggagaagucagauuaggggaucaaagcacuucaggucaaaggauucagaggcugagccugggccaggggcagaggggugaggggaacaacucagccacaacauccucgaguguauccagaggccaugcagacagaggcuugaaccacaguucacaggaggcuuucagguaccugugauccuccuggaacaggagaggacaggaagauccuaagguacacuucaaggccaucucccacccaccuccuaucucuugggaggcugucgugagacagugucucaucaccccucagguucugaugaggaugaacuucuguacuccagcccccucagaauagagcugcagaagguaaagcugcuuagcuacagucucaaguggacuccucagcaacagggcaucccgcagcucacgcugcggucaucuggccccuucuguuccaaggucauaauuuuugguaugaaggacaaagccguggggagcuggcaccuuuggcuacucuuucuuuugcugucuauguaaguaauaaacugccugaauccaaaaguggcuugugauaccuuuaccagccgaauuaguaaggucuuggccuugccuugucucguaugcuugaaaagagggugugcccaacucucaccucaacugcgccaaagcuuuaggccaaaaggauagagcugguucccagggccugucaaaagagaagggagcaggaccgagggcaaccagcaaagcuuuagacccaugcagaccagugccaccuggcucagccauccuagcacagcuggaauucuuuccaucuuuguugcaucagccacacacgaggacacuaauacugacauuauaagguuguuguuaagauuggagauaauguauguuauacuuccauagccguccccgacacaacuacuaaaacagaaaauaacagccacuaacauuuacuaugugcuugccucguuccaggcacuguucugcuaguuuuauaggcuaacucaucugacccuuacaacuaccuuugaaguagauauucuuuuuuuauguagaugaggaagccaaguucagaaauuugcucaaggucacauacaaguuaguggcagagcugggauuuaaacccaggcaggcugugagccuggguucuuaaccacccugccucaguggacaucagccacguucccacacuuugcugcugaaaagaaaguaacauuuuauccagucuaagugcugagaacaguucuggucuccuauaucuuaguaucagguugagccugaguagaaggaaacaacaagacagaagggcuggcagggaucuagauagagaagacucugaaagugaugagugaucugguuugcaggugguagaauauguacuugguuuguaguuaaggagaaggacaaacuucaaaagcugucucauaagucaaaggccccaauuuaggaauacgcaaguguugguaauacauuuagccaaaugcuggacagaauaagcuagaugugacaguggacaugaaaaugccaaauucagaaugguggucacauuuuguaggaagagagagagaaauacuauuuuucaggcuaguauuugauguauuguuacuguuuuauaccucaaccccuugauuucuugaaacaguguaaacuuggugacuuuacugcauaauaaauccacccauugcaccuacauugcaagcaaacuccacccacuccauaaauuggugauuuucccgcugcaucuccugucuacuuucagauaguuuuccuaaagcccugacuggcaaaagccuaauuccgcccucugcaaagaucucagguccuugucuaacgaaaggggaaaaacauuaaaaaugaaauguuugaaaugcaacagagugaacagagugaaaacuacugccuauagucaugugucgcauaaugacguuucagucaacaacagacugcauauacaacagugguuccguaaagauuauaauggaacugaaaaauuucuaucacucaguauuuacuguauuuuuuauguuaguguacucuucuacuuauuaaaaaagaaguuagcuguaaaauagucccaggcagguccuucaggagguauucgagaauaaagcauuauuaucauaggagaugacagcucauguguguuacugcgacuaaagaccuuccagugggacaagauggacacagaagacagugacauugaugauccugacauuguguaggccuaggcuaaugugugugucuuaauuuuuaacaaaaaaaguuuaaaaaaguaaaaaaaaaaguuuugauagaaaaaagcuuaugaaauaaggauauaaagaaauuuuuuuacagcuguacaauguguuucuuauuagaguguuauuacaaaagucaaaaguuaaaauuaaguuuauaaaguaaaaaaguuacaguaagcuaagguuaauuuauuauugaagaaaggaaaguauuuuuuauaaauuuaguguagccuaaguuacaggcacauaguuuuaaaaaucuuuuuuuuuuuuuuuuuuuuuugagauggagucucgcucuguugcccaggcuggagugcaguagugcaguggcauaaucucggcucacugcaaccucugccuccuggguucaagugauucuucugccucagccuccugaguagcugggauuacaggugccugucaccacgcccaucuaauuuuuucguauuuuuaguagaaacgggguuucaccauguuggcuaggcuggucucgaacuccugaccucaggugauccacccaccuuggccucccagagugcugggauuacaggcgugagccacugcacccagccuaaaaaucuuuuauaccauauuuuuuacuguaccuuuucuauguuuagauauguuuaaauacacagauauuuaccaugguguuacaguugacuacaguacaguaacaugcuguacaaguuuguagccucagagucauaggcuauacuguacagccuagguguguaguacgcuauugcauccagguuugugucaccacacucuuauguuugcacagugacaaaaucgccuaauauuucucagaacaugaccccugucaugaggugacacguaacuguauuuaggauuaaggcuuucagugaaguagaaccguggacagaaaagaaaagacuaccuuugaauuguuacuccuucacagaucaucugucuucucuguuaguuuuggaaacuuguuuuauccuguauugggcuguuucacugcgacauaccuaggggugaauuuauggauuuaauauauccuguugaggcugggugcgguggcugaugcuuguaaucccagcacuuugggaggcugagguggguggaucacuugagcccaggaguucaagaccagccuagacaacauagugaaacccaucucuacaaaaaaacaaaaacuagccaggcauaaugacacacaccuguagucccagcuacucagguggcugaggcaggaggaucgcuugagcccagggggguugaggcuacagugagcugaggucgcaccacuacacuccagccuaggugacagagugacaccgugucucaaaaaaaaaaaaaaaaaagaaaaaaacacaacuauauauauaguggagcaaagcccucuguuuuugaucugaaaacuuaugucuuauuucacuucuggaaaguucacagccuucaucuuucugaauaggguuggucugccaccacuccaacacccuuccccuggauagcuaucaaagcuguguuagaggcuuaggucugcccucugugucacuaacuacuauuuuucuucuuccucuacugcauucugggugacuuccucagcaugucuuccaguucacuaauccuaucuccaucuuuguccaguuuggauuaucauuuaaaauuuaauuucaaugucuguuuuucauuucuagcauauauacauuauucuuuuuuaaaaauauccauguauuauuuccuuucugccuguuguguuuuauauuuccuuauucuuucuuauagcuauaauuccuuuuugcaucucccauaauuccuaaaacauacauuuaaaagucauugucaggcugaguaugguggcucaaaccuguaaucccagcacuuugggaggcugaggcggguggaucaccugagguuaggaguucaagaccagucuggccaacauggugaaacccugucucuacuaaaaauacaaaauuagccgggcaugguggcacacgccuguaaucccagcgacuugggaggcugaggcaggagaauggcuugaacccgggaggcggagguugccgugagcugagauuguaccauugcacuccagccugggcgauaagagugaaacuccgucuccaaaaaaauaaagucauugucagacugcccuauuuucauuuaaucucaaauaaauuaaccccccagugucgauuuuguuggcugucuucuugaguuaguuuucuuuugguauuuuggaaauuggguuuggaaacucacggagucagaguucguuuggaggaaauggucuucucugugccaucccucccccaacagccuuguguuuacuucuccaaggaccuguaagccuauaacaggucucauagugacaugucaggaccaccaggacauacagacacagauaaacuucagucuucauaccuccauguggucuuggcccacaugcaggcuguagauuguacaugcuucuucguaacauccuaggcuucacugugagcuguaauugucagauguuuucagucuccuuucauagcuggggcagccuagcccaaacuuugguuuuaaguaaggacaguggcucccaucccgccccacuugggcuacuuuuaguucccaguccaccagaauagagcucccagcaccaccaccuacauucagacucaaagcacagcgggacuguggcuucagcauucaucuuugcuuuauucuguucuguucuuuuuuucccccguagauauguuuaucuuguuuuuaagcauaauuuacaccuuucauuuucuuuuuguauuugauguuuggaauggaggggagggaaacugaaucaaaaauaaacuuauacacugagcagaaggugauauguaaaggagguuaaggacagagucaagccuagugaggguagauuauuccaggcagagggaacaagagcaagugcaaaaaaccuaugguagguaggccuggcaugugggaggaacagcagggaggccaguguggcuggaacagggugaacaagaaagagacuggcagaagagaggggucaaaggucauggcaggucagacacaggauuuuccagggcuucauaagucagcuaggaagccagugguaacuugcacagaguaguaacauggcaugacuuauauuuuaacaggauugcucuggcugcuguauuugagaaaagacuggggaaggggcagugucagggaguggaagaguugagggagagcaguuaggagcucuggcaguaacccagaggagaagugaagggggcuugguacaggguggaagcaggggaggugcuggaaagugguuggguucugaauagguuuuguagguaaagucggcagaauuugcugaaggguuggauguggguaggggagaaaggaagcaaggaugacuccaaggaaugaaaugccauuacuugagaagaggaacaugacagaaaagguuuguuuuggaggaagcucaguuuuaaacaaugaaaugaaaauuagcccuucuuacccgacuacaaagauaugauaauuacuguaagauucaaaagaagacugaagacuguuacucagaauauagaaagaacucugaaaauucaauaaguacacaacccaauuaaaagcagguaaaagauuugaauagagacuuuacaaagaagagauagggauggcaaauaaacacaugaaaaguugcucagcaacaucgggcaucaguaaaugcaaaauaaaaccacaaugagauacugcuacgugccacuagaauggcuaaaauuaaaaggcugauacuaaaaagugucagugaggaaguggaacaaugggaacccauacauugcuuuugguaauccaaaauggcacaguuccuucggaaaaguuuggaguuucuuauaaagcucaacauacaccuaccaugugacccagguauuccacccguagguauuuacacaagagaaauaaaaacauuugucuacgcaaaccuacucaaauauccguggcagcuuuauuuguaauagugaaaaaguggaaacaauccaauguccaucaacagaugagugaaugaaaagugguucacccauacaguggaccacuacucugcaauaagcagcaaaacacugacacauggaugaaccucaagaacauaaugcugaaucaaaggauccaggguucuucccuuccccccaaaaaagagugcaugauacaucauguuuccguuuauguggaauuccagaaaauauaaaccaacuuauauaguaacagaaaucagaucggugauagucuggguaugggguggaagaagaaauggacuaucagggaacaagaaacuuucuggggugaugaaaaugcucuguaucuugauagugguggugguuucacagaugucugcaccugucaaaacucacuacacauuguuaucaguaaaugauuaguuuauuguauauaaacaccucaauuaagucuguguuuguuuuuugggaugugguggcacaagccuguaguccccgcaaguugggaggcuaagguggaaggacugcuugagcccaggaguuugaggcugcagugagcuaugauggugccacuguaccccagccuggacaauagagcaagacccugucucuaaaaaaauguuuuuuuuuuuaauuacugaauucaggauaugaacaaugacagcauucuuaaaagagagucaacaagucuaccauagagcucuaugacccaaccaaaagucauaguaauuccagugcugaccacuugauuaucaccagcagccucaguuaugggcuuuuaauucauaaacagaugacuugaugaagaaaaaagggaacuuuacucuucugauucagguauggcuaagaaccaggccaugaaacacccaaggaccuaagacacaaugcccuuuuaagacagcuagcaugaaagugguucuuuuccaugccucguacgcccuaauugugguagaauaaagacugacaucccacaggauguaagacguguguuuauuaaggacaucgacuugugccaucucacucagguggggcuggcaccauucuuauuuuacagaugaggaaacaaccuuggggaaauaaaguaauugccuggaguaauggagcucagcugcauucuuuuuuaaaaauuaaauaagaaauuuuuaagagauggucucucugucugucauucaggcuggagugcaguggcgccaugauaggucaccugucaccuugaacuccugggcauaagcaauccucccaccucagccucccaagcagcugggauuacagguuuacaccaccacaccugccuaaguuuuuguauuuuuuguagagacaggguuucgccauguugcugaggcuggucucaaacuccuggcuucaagugauccccuugcuucggccucccaaagugcugggauuacagggaugagccacugcgcccagccuguucuuuucaucacaugacuccacuggugauagucuugccucacuauauuuuuccuuuucuccccauuuaccauuuauuugcauaauucuuuaauaacagcuuuauugagauauaauucacauaccauauaauucaccuauauaaaguguauaauucaguggcuuuuaguauauucagaguuguacaaccaucaccacaaucuauuuuagaacauuuuaaucaccucagaaagaaacccuguaccuuuuaacucucacuccccugucuucccauucuucuaccuccccagugcuaggcaaccacugaucgacugucucuguccuauucugggcuuucauguaauagacucauauaagauguggacuuuugugacuagcuucuuuuacucagcauauucucaagguuuauuccuguuguagcauauaucaguacucuguucaauuuuguggccaaauaauauuccgugguguggguuaaccacacuugauguuuccauucaucggcugauggacauucacauuguuuccacucuuugguuauuaggaauagugcugcuaugaacguucauguacaaguuucugggccauguuuucuuuucucuuggguauauacucaggaguggaauugcugggugucauauggucacucuauguuuaagccuuugaggaacugccagacucuuuuccaaaguggcugcuccauucugcguugccaucagcaguguuugaggguucuaauuauuccacauucuagccaacacuugguaugacaugaugucucauuaugguuuugauuugcauuuccuugauggcuaaugauauugagcaucuuuuaaugugcuuguugacauuugcauaucucuuggagaaauauguauucagauccuaugcccauuuuuaauugaauaguuugucuuuuuauugaguuguaaaaguucgcauacauuuucuucuguggguuuuauaccuuuaaauuauucauuuauuuauucuuagagacagggccuugcugucuccaggcuggagcgcaguggagccaucauggcuuaaugcagccucaaacuugugggcucaaucuuccugccucagccucccaaguagccaggauuacaggcguguaccaccacaccuggcuaauuuuuuaaacguuuuguagagacagaguuuugcuauguuacuuaggcuggucucaaacuccugagcucaaauaauccuccuaccuuggccucccaaagugcugggauuacaggugugagccauggugccuggccuuuuuuacacuuucuugaugguauccuuuauagcacaaaaguuuuuaauuuugaugaaguucauuuugucuauuuuuuccuugguugccuaugcuuuugguaugaugucuauugcccuacuuuuugcaugagagguacaugggccucuuuguaucugaacaucagaaauaaaagcaggaugggcaggaucaggacugcccuucagaugagguuacaugacucuucuaaggucacacagaagaggcaguacugggauccaccgugggccagugcaacucgaagcccuuauucaucauagcacaccacagcauagcacagcaucaucagggaguggagaaugagagguucugccuuaggcccuucacuaaagugcucgcucuuaacacuguguugagaauccccuucucagaaugguuacuuggcaaauguugaauuauuucuuucauuuuuguuucuauguuuuuccagugaaagaaauuuaaaaaaaagaaaaaggaaugaacuuaaaaucuugacuggaggguaaugaaccugccucucaagggccugccuuccuuugcauucagaaaacuacucaagguuacaaaaaaccaauacaucccacugguuccuuguaagaaauucuccaaauaucaggaaauauugugggaaaggaaugcaucucucucucucucuuuuuuuuuuuuuuuuuuuuuugagacggagucucgcuuugucacccaggcugaaguacaguggcgcgaucucggcucacugcaagcuccaccuuccgaguucacgccauccucccgccucagccucccgaguagcugggacuacaggcacccaccaucaugcccggcuaauuuuguuuuuguauuuuuaguagagacggaguuucaccgaguuagccaggauggucucgaucuccugaccucgugauccgccugccucggacucccaaagugcugggauuacaggcaugagccacgaugccuggcuggaaugcaucucuuugacaaugcauguugccacuuaauacugccauuuguuacuuuuaaaccguguuauacauagagccaauucaugggaaaaagcccugguuagcuucaaauuuuggucaccuguccugucagcagaugcauauacauuuuauaauuguuuucaaacucccgauuaaacaacauuacaguaaaggagggcucagcucuuaaucacuguuccuugccugguguccagccacaaggucauugcuuagcaaauguugauuuaaaugaguaguagaauccaaaaaagaaaaaaucuccuacuauucuuacucuccaguccauuaaguuuguaaauucuuuguuuccuuuuaguuuucaucuagauacagaugugauuuuuauuuauuuuuauuuuuuugagacagagucucacucuuguccaggcuggcgcgccauggccagauccuagcucacugcagccucaaccuuccaggcucaagcaauccucccaccuuggccucucgaguagcaaggaccacaggugcaugccaccuaauuuuuuaauuuuuguagagacaggggucucacuguguugcccagguuagucccaaacuccugggcucaaguaauccucccaucuuggccucccaaagugcugagauuacaggcagauaugauuuuuaaaucuguacauuaauuuuucugaaaauucuguacaucuaauacuauguugucuucauuauuaucuuacuguggugacauuacaucccauaaauuaugcacauuguuuuuauuauauagucuuugggggaacuuuuuuuuucuuucuaaguuuucacaguuuagaggaggacuacuugaagauuucaucauauaaaguuacuacuuuggcugggugcaguggcuuacgccuguaauccuagcauuuugggaguccgaggcgggcggaucaugacgucaagaguucaagaccaggccaggcgcaguggcucacgccuguaaucccagcacuuugggaggccgaggugggcggaucacaaggucaggaguucgagaccagccuggccaauauggugaaacccuaucucuacuaaaaauaccaaaauuagccgggagugguggcggacgccuguagucccagcuacucggggggcugaggcaggagaaucacuugaaccagggagguggagguuguagugagccgagaucgagaucgggccacugcacuccagccugggagacagagcgauacucugucucaaaaaaaaaaaaaaaaaaaaagaguucaagaccagccuggccaacaugaugaaaccucgucucuacuaaaaguacaaaaauuagccagacaugguggcgggcgccuguaauccgagcuccuugggaggcugaggcaggagaaucgcuugaaccugggaggcagagauugcagugagcugagaucgcaccacugcacucuagccugggcaacagugcaagacucugucucaagaaaaaaaaaauuacuacuuugagguuauuuccucggggucuguuugaaaaaugaaauugugggggaaggacauaacggagcuugggcauugucucauugccagaccgcuuccccccaaauuugagccaauuugcagcauggccagaauguguuugcccaaguuggguuuagagcugguuuacuuggcugauuuugcuguuguauucaucaccaauaagauggaugaugauucuguuuucuuacuauaaauuaguugcauauaucccuuaacucucagucauuucauuccuugcaguguaucuuuguucuguaccugcucauauggagaaguucaaaaaauacauuaguacuuucugccccacuuugucacuaucuaguucacuaauuuuccuaaaggaauugacuuagcucauguugcuucaucauuuauaaacauauaaaugaggcagagguugcauugagcgaagaucaugccacugcacuccagcaugggcaacagagcgggacccugucucaaaaaauaaaugaauaggcuggguggcagagguggguggguuacuugaguuggauccaggaguuugagaccagccuggacaacauagugagacccugucucuacuaaaaauacaaaaauuagcugggcaugguugugcaugccuguaaucccaacuaccugggggacugagucaggaggaaguccuggcugcagugagccaagauugugccucuacacgccagccugggugacaaagugagaccccugucugaauaaaaaauaaauuaauauagcuuuggaauuuuuuuucacuuauuuuucuaguuucaguucagcaucauguaguuugaaugauuuguuguuuuauaguauuguauuucaucuuaauuuaguaacucuuugauguguuuaagcaccuaauccuuuucauaauaagaacgaucaaauguccuuuauaaguugccuugcaauuugaaguaaaacugugugagugaauuucuguguagagaacaauacuugucaucugguaggcacaugagucacucugagucacuucaagaaugaauuuagaauuaauuuagcuuaagguuucuauagucuacuggauacuuaaaaaaaaauuuaacuuacgaggcaucuuaucuauuugaaacuagcaacagccauucuaagugaggguuuguaaagucaggcgugagauauacauggggccauauguaaguuuuaacauaauucucugacaaaaugaaauucuagggcgugggagauacucaagagaaaagguggauuugaaaugcccccugcuuccccaaguuucugacaggucacuucucaguugugcauuugguacagaggaaugaaauagguauagaggcucuuuuugguuuuucucaaaaaaagugauacccacugggggagacuccagccgaguguucugaaagccagaguccucagccgagagaacuccacagucuucaggccguucccagcuggaauucucugugaaacagcagcaacagccagcagcuuuuuggugucugggguaguuucugacccaucacaguucccuucauugcuaugacaacagggagaauaauuauucagguucuguuugauucuagauccagaaaaagguuuaggcucuuuguucaaagagcaaaagaauuguccguuucuuuguacauagaagagggaaaaaaaauccuuaugauucaagagaaaaaugggugcgucuguccuuuuuccuuucuuucacguaaauuauaagucuugguucuagccaccacaccuuuuaagaaaaggucugggacugaugugagacucuguaccacagcgacacccuacccuggccgacaguggcaaaagaacaaaaggaaggaaguuucccuuuuaaauccccaggaauuuuuugaugagauaauauuacagagugaaaugucucguccuccuauuaguuuaguauuuggcuucuguguaacaguaacccacuuagaagcaggcggcucuuuugaaguuauuuuaaacucucagccuaguguagagauuuguaaccuuggauaaaagcaccacuagcccuaguuucaguuuugcccuuucagacauguggaaagugcaccaguauaucucaaggauuuuguacugaaagcuucuuaaagagcuggucuugguuucaaaguuuggcuugauguaccauacucaagggaacauaguucuuuuucuccagauauuuaaccuugucugacaucgucuuuuggcuucgaaguuccccuagcuucuuuguccauuaacaaaacaugaaaccacaugaaaccaugauagucagucucacugggcucugaggaaguugaagaaaguucaucuucauauuuaaacauaaaaccaguuguuugauaccugguaccagagauggccagguauaugcauugcuuguugguagcauuuugccuuaguaacuauucagaaaugcaaguggaauguugaguuccucuucuagagguuauaucuguaucugggagaaaauuggagcuucucagaacaaucacccugguuauugugucugccgucucuguaacacccaaaucuauaucacacucugaugccaccugggagcuauuuuugguugcgaaggguggugaaagcugcugguucuuucucuuaccgugugucccugagucauccccagcccacguccuggauggcucccagaacagccgucucagacgaagucucccuucagauguccacuccucagugcagggggccuguggggucucucuugguccugaugaaauccuucucugccuuuuccagugagaaggacccauagaaucugcuggaacacuuggagaaagggacuuauuuccagcagugcauaaaauuuuugauuaaaauaauucacgugucuguuuauaaaaagacaaagcguacaucaugguuuauaauaaaaaagagcauuaucuuguuucaccuucaccaccccugauugcuauucccagaggcaaccauuuucaauucuuuaguggcuucuuuugucuucaucucugugauucuuucuaaauuucuguaacucuuauagucaauugcagaauaauuuauugaccuccuccuguagaaaaagauuuugcuuuucacuccccucuucucauuccugcauucuuccaauguaguuauaucacauaggucauacccugauuauggguuccaauccugguguaaguuuuuguuuuuuuucuggaguuaaucauugcuccccucacccuggcccuccauuacuuuaguuugcuguaacuaucacgugucauccucuuguucagaacuauaaaacucuccucaguaccaucuaacccacuggguaaugagucauauuuuuguuguuauuuguuuggcuguccuguagccucauccuucuggccccaucuggaccugucauucaacaggcugguugcaaagccaucguccugggauuucucuuuauuucucuaaucugugggagucccugugcuuggaucccaugccugccuuuuccuuaguuuuauuucuuuguuuuguuguugcugacagcaacuccugagguuggacguggaugggaaaauuugagacuugcuuuuuuggggaggacaucuucuauucuccuuccccuucuacuguccuuucaaggugcugucauggugaagggcaccaguguuguggucucuguguauagaaagcaguagccaccccagcguucuugggcugcuguggccccacagcaaggccaaggaggagcagccuuugcuccuauaccauugccaguaaaucuuuuuuguccuggaaaugucuuugaugacucaguaaucaauaacuguaagagcuaggucuuucaaaguucaugcagcaaguuaauuaaauccugaccuauuugcccuggucccucacuuagcagagcagagacccaaguggcucagcaaaaacagcaagagacauggcagcaggccugccuccaggccagaggucauuuguucagccagcagucauuuauugagcaccuguugggugcaaagcucuguguagggugaaaggggacuucugaauaagacugucuuucuagaagcaggugcccaucuuagaggggaggcuguaggaaccaguaagcaccauacaaagcauuugagaaucaaaaaguauuaguucauucaagaaagcuccguggaaggggugauauuuaaguuggucuugaagggcaaagcauucaaggcaaaggcauaaaaugcaaauggacaugacaggucuagagaaggugaaggagagagcuuucccauugauggaacgucuacugguguuacuauguugauguauuuuaucucauuuaauccuuaacgaugucuguauuuguccauaucaguuaagacagaugcuacagucuccauuuuacagauaagaaaauccauauggaaaacagauaggggcauagaguguggaaguacaggcauuggagacucagaaggguggguggagggggggaaggggaauggauuaugggaaauuacuuaauggguaccauuuacauuauucaggugauagauacacuaaaagcccagauuuccccacuaaacaauauagccauguaacaaaaucacacuucaauauauacaaauaauuuuaaaaaucaagguuuauagaaaucaacucaucugccuaggugaugugccucauaaaaggcagaagugagauuucaacacaagauugcaugaucucaaaucucauuccuuccuucccaaaauaucccuuggaacaaaauaaggagugagaggguaagagccacaguuucauaauaaugucaaacucuugauaaaggagugaguaggcauuuuccuucaguugacuuaagcaagaugucaaguaucccaaaguuauugcacaaagagcaaaaguaaaacaaaaucaaaguuauaacccaggacauauuuucuguuauauccuugcacuuucauuguagcuuauuaauuauuugcaugaaguucuucugugaaucugccccagaaguuuuucuugucuucucauuucaagccauccuuccccuuaguauucucuauuggauggagucuugguuccagucuaggguuuccaugucuauuugauuuuuuucuuuacguuuucauuaguaguucuugaguucuuacacacaauucagcuguuuuuaaucuucuuaaaaauaauaaggcaaaaacauaaaugucaagcaucugacuaggaaagcccuacccauccaaauauuuuaagaaaauaaacucagaaaugccuauaacuuuuaaaugcuuauaugcuacauuaaguucaaaguuaacaugcuuaacaccauacacggaaguauccuacgaugaauuuucaaugauuaggcguucagaaccacacaggucuuauauguagucagugccuauaugucgcuggcuaguguuagcaugugugaauaacacgccugguuuuuaccugaugacugcagggaugguguggaaguagugucuagcugaaacuuugggagaguuuaggaauuucuuacagagaagguucuuauucucuacagaugauuguuauccagauaaggaccuugggaucuuuuaaaaucagaggcuaauaauucuuuuuuaucuuuuuaaaaaaauugagaugcagucuugcuauguuggccaggcuggucucgaacuccuggguucaaaccauccucccaccucagccucccaguagcuaggauuauaggugugugucacuaugccugguuuagggccuaguauuucuuaggagaaaguagaaauaaagguuucauuggggcuauaucuuaaaaaauaaaaaugaaaguaaugguuuauauuuaaauuauaauugcagcuuuguacugauuuuugagaauaaacaaagauugaaucucuugugggccaugcggggauauucucagcaaaacuguauaagacugugcauauagcauccuucacuuagguuugaguucagccgggugcgauggcucaugccuguaaucccagcguuuugggaguccaaggcggguggaucaccugaggucaggaauuugagaccagccuggccaacauggugaaacccugacucuacuaaaaauacaaaaauuagcugagcgugguggcgggcgccucuaaucccagcuacucaagaggcugaggcaagagaauugcuugaacccgggaagcagagguugcagugagccgagaucgcgccacugugcuccagccugggcaauggagacuccgucuaaaaaaaaaaaguuguuuuccaacugagaggacucucacuuuuuccaaaggucucucuuaauccuuugaucauucucuguggaagcucccaugcguguuucuucuucuuuaauccuuaacuagauuguuugccauuggcuuugaguggaauccaguuguugacuaauaggacuuucauggacucuguuaaauucugcauugguugcugauuugcaguucuaguuugcaacuuauuuacauaguuuagucacuauaucaucugauauuccaacaauuagcaggaguucacuguuggauuaaauaagagauuaaaauguguaaaccggucaggugcagcagcucacaccuguaauuccagcacuuugggaggcugaggcggaaggauugcuugcgccuaggaguucaagaccagccugggcgacauugugagaccugucucuacaaaaaaaaaaaaaaaaaaaaaaagucaauaaaugagguggcaagauugcuugagccuagggggucgagguugcaguaagcugugaucacgccacugcacucucaucugggugacagaacaagacccugccuuuaaaaaaaaaaaaaaaaaguguuaacauugcagauguccaguuaauaggaaaggccucuguuucacuuuucccauaaaaugcaaaugaaaugguauguucauuugcauuuuaugccuuugccuagaauacuccauccuugggacaggucaguucccuaagaauauuuucacauaaugacuacuucugcuucucuauaaaaacaucuccugagcucguaacuuggagcccuugggaaaagagaaccucaggguggaaauggcuggaggccuaggguggccgaugcugucgucaggggccagcugacagagaccugaaucguauaauaugauauucaauaggugggucaaaggagccuguuagauugaauuaacagacuugcacuggagauguaaacuggaauaaggagcucaggagagagggaacuuaggguggaagugggaagguggaauggauggugagguaaguuuucuauccucugagaugugaucucaguggcuucuuuacccuccacaagaggguaaagcgucccucccacuggcacuuuagaaaaauuccuuuuaguuuuaaaggcuuucauuccuguucagaagucaaugcccuugacggggcugauguguugagcugcuaacagucacccaucccagugucaggaagauuugauagaggaguuuggaggagagugggaaggaaugacugcuuaggaggggagagagccuggcaaugaaauguggcccagggcaccagccugacagccccgagggaccccuggguguguuugaggcuuucauaguucagauuucugcaugcccggacacgcucuccacaugccuuuccugaggccguguguucugcuccuccaagagaguaagccucuggccuggucaggcccacuuccaccucacuggcugcagugggucaggccucggcuuuggcuucagcugccucuugguuuccauuccuugucuucuccccguccuccacaucugccgcucucccaagccuugucuuuucuccagcugcccucgacugucccuccauuucuuucuaccauggccuuaagucuuugcgucauggauguucagcauuugcagacauuuagcuuuaccucaugucauauuuacuguagguuuauugccaugcguguguauguguucucccuaacuuagcaucucucaacgugugucccaugaaauagugugaucagauuaaaugcaaaacaaguuuauaaacaaaggguaggaaauggugguuuuagcaaagguuaaaagccuuuuuaaaccauuggccacugcagagcuuuaauucacacauguagauccugagucccugugaagaguuucucaguguuauuuacuugugcaagaaccuguuuuucaucuugugguagguaguauucugcaggacccaguuuccugaagggcugcuggaauucacuuaggcucuggaaggguagaaaccacauuguccuucacugugggauccccguguuagcugagggcagugcuaggcagggcguaagucauuccugaguaagcucuuaggacaguugcuuguuuuuuuuuuuuaaaaaaaaccuuuuaauugugaaauucauauaaaauucaccauuuuaaucauuuuaaagcaugaaauuaaguggcauuuaauauguucacaguguugugcaaucuucaccaccaucuaguuccagaacguuuucaucacccagaaggaagcccuguacccauugaacagucacuccuuauuugccccucccugcugcccuuggcaaccacuagucuucuuucugucucaaugguuuugccucuucuggacauguaauggaaucauacaauaugcgguguuuugugccuggcuucuuucuuuaguaaaguuuugauauagaugcaaagucuuagacccagaugauaccuaugcuccuccaaagcaacucuuuaucauuggccaaaccccauaaauguauaaguaaccaaaagcagccauucaucuggaaaccuccaaguuguguggccagguuaaaaauaccuuggaauacugguugccguuaccaugauuugaccugggacuucaggaagcuggcugagcugugcuggagugagccgggucuugagcccuuuccuggaggucagaggugccugagcuguugacauaauuggcucaucccucuugcucauccuuuuucuaguuggaggucucagcauuucagacuacucauuguuuaauaacuguagaacauucuagagugggcugaauccugcacgggcacccuggaggaaagguugccccacccauggcaccgcagaaccuccauuggcccuucaggcaaauuccaugagccugaaaguuugugcaaaguuagaucccagggcccucuaucucauaucuuggaauucccaaggggugggauaucucucacccacuauaaagacagcugcuggccgcccugugcucagcaguggugaccucucaccugccuuaugagcuugugcaaccccuuuccuguuguuucauugaauugucaaggaacucucauuuuuggccugcacccuuugcccuccacucguugcugucucuggaguccaagaauaccacugcuccaagagguuaccugccugccuaaaauaacuucuuucagugcacaaucuucugccuaaggaccuguaaugcugucuugguguccagacuccauccugguuuuugagcccuucucuuuccuucucaguguagacagugacccuuccuacucaucagacuggaugcauccuuuucuccccucuauaucaucucuuagcaacuccuccccgggcuuggaacugaccucucucucucguuuugcccugaucagucuaacucuuccuucuaagcucacucgaggcucagcagcugcgcaaagccuccccaaacauucuagcaacucuugcugccugcaccaaacucauguuacgcuugaauaccacaggauuuagagcuggaaacuuuuuuucuaaggauuuuaucucuuagucuuucccugucagauggucagcucucagaggaagggaagauaaaguaagcaagugguggagugggaaggcacuggauugugaauccaagggccuggucaccucugggugugccacauacuggcugugucuuggaaaagccacuuaucuuggauuucuguucucaucuguaaaacaaguaggggauaauguggguguauuaguuuccuauuugcugcuguaacaaguuucuacaaacuuaguggcuuaaagcaacacaaauucauucucuuacaguucuggaggucagaagucccaaacaggucuucagggcuacauucuuucuggaagcuugaggggagaauccauuuuucaucuuugucagcuucuagaggccaucgucauuucuugauuaacggcccccuccuccaccuucaaagcacaucagccucugcuucugucaucacaucuguucuccaucuuucucaugcuucccugcuucccuuauaaggaccuuugugauugcacuggaccaacccagauaauucaguaaucuguccaucucaaacucaaucacaucugcaaagucucuugcuguguaagguaacuuaugcacagguucuggagauuaggacauagauaucuugggggccauauucugucuagagugcauucuuaggucucuuguguuucuaacuugucaugaaucuaaagacguauuucuuccacuuauuuaagagcuuagcacacacagugcuaggcuuaucagcuucuugauaaguuauguuuaucccugaggauuuccucuucucagauuguuauuagggauucuagggccugguaccacucagugauagaacugugagcacaaaccuuaggguuguucugguuugacugcacuuucacacacagaaauuugacacugcuuaucugcccaucuuugauuuugugcuuugcaaauuuugaaaagaccucaaagaauuuuaucuguuucccaguaaccagggguagccuuuaaacagccuguuaauuacacuggugauuucuguggucucugcauagaguccgggauguguuuccagauccucuugcguaaguugaaguagacauguuguugaagucuagaagccaaacaaucuuggauacuaacauagcuagucucgucuguaauugcuacuuaguguuaaauuuaugguauuucacagcaauuuagauuggcauuuauaugggaauugugcuguuuucuuucccuagauccuauugggcaguuuccaccuuggaucaccaucacuuacaaggcaguaaaaaagcaugcauaacauacauuuauaauggcucuauaguguucuccccagugcucagcucauugugcugaaauaaaauuccccuuggguugaaaaacuguccccacucuuaaaauuuuaaguuuugacguuacuuuuggcuauagcaucugagaaauacacaauaugagucaagcaaauguguagcuugccugcugaaguuuucuuuccauuuuauuuccuagaugcacccacugggccuauguaauaacaaugacgaagaggacuuguaugaauauggcuggguaggaguggugaagcuggaacagccagaauuggacccgaaaccaugccucacuguccuaggcaagguaagcaccaggcccuuggaaucacuguguuucugguugguguuuuccacucuuccauuucagcauuccucaaauaguugauuauggagaagagccaugcuggcacagugcuccuucccggcugaaguugcaugagguggggacugagacaugccuugcaguggcccaccaguguuuacaagcccagacugaaagagacugccagucucagagcgggcucuacccucuuguccauuguguggccuugggcaaguugcuuccccucaaggagucuuagucucuugucugugaaaugggcuaauaauagagauucacaauacuuuaucuuacacccuugggccagauguuucagaauucugagauuugggggguuuagaaaggcauuaagggguauagauuuuauauuaaguaaccuccaagagacauggggaggcacucaguaaccaaacacauucacauuuguauagcaaaccauagagaucuucacauuaagugggauaacuaaaaucuaaauagccucguguuaguucacggcagcuuugccuccagaugaguucagguccauuaaguuuugcugccaaguaaguuaugggaaaauguuucgguuuuagagcuuuuuuugguuucagaauggcagacagcaauuaugguccuguauuagaacuuaccucauaggugguuaggaggugagaugagaugcaaacgccucacacaagaguaagcccucaauaaacguuugcugccauuggcuaccaucacuccauuuagaaguacuaaaaaagacuuuuuagccaagagggucagcauuacuuugacugcaguauaagauagaaauaaauuuacuuuggaaagccacucaucaacaaucuuaaaauaugacagguaacaaccuguuuuaaacuggauuuuguuuagacugcaucauuuuguuaaaaggagagguucagagaaggugauuugaauuuuggcugggagaaagguagucuguccuaaggauagugguacugacuggauaucuuuuauauucucaaaagcugccauucuagguaccauggggagagagcuggggcaaaaaacuguccugguuccuaaccucuugaggcucucuugagaaauccaggagagacaaggggugguuuugaagcagggugcuagagagggaagacuuuccagacuuaaaguagccccugccagugucuccugaaagaccuuuggcuccagguacccucacaggucuaaucuuuuugugguuuuugcaucccucuugucuucugaauaacuucaagucacuugucaaguucuccugcccuuuaguuggaaaaaauaaccccacaggaauuauuagcuguuugcuuuacaguucacaaaguugaaucgagguguuuuagguggcucaggcccugauacuucaucauuuaaauaauuggccagagcugcuuaguggugguaggagagcaaugacccccuugagaauauuuuaguguuuucuuaggagaaaugccagcuacaucuacaggguaggaacagugcuuuccuuguagguguuacgcuccuaauacaacauuuucucuuguacuuuaugcaggaauuggcuccuugacuucauuugcuuugccccggucugguggggcuccaucuuugugucucucgcaucuauaaauggguuggaacagggauuacagggucacccuauaguucucccaugguuuagcgguggggaaacuugcugaagucacucagagaacccaacuauuuccuccucugccuggaacaaccauguagugguuuuacuuggagaguuuuguaugauuuggccugcuagccugugaugccagggggaauaaaaaacccuaggcauauauugaaucauuaagugcuucuuaaguuuauucacucaccaaauauuuauuggaugcaggggcccagaagcugagcaugugguucuaccugcuugcaagcagcagcccccacguuucucuggagaggcugguggcgggcagcauuugcacaugguuagucauugcaguuuggcuuugaguuuacaccugaauaaaaucauuagcacagaagcuugggccaaagaaagacaguuuugcauuuguuuaaagccugggccaguguaggaggugcgaugagucaagaucucucucucuuccucccucucucuccugccgccccucuuucucucaucaucuucuuaaagugugguuguucucagucucaauuucauuaacuuugacaacugcguuuucuuguuuuaugagccccccgggggcugguagcaaaaaaauagguuaaaggaaggcaaaguuauccccuugggcagcuuagucccugcagaauucaugauuuuccauccauuucuuggcucugaagaagcaggcaguggacagaggcagaaaaggcauaggaggaaaacagccaagcuagcuugggggugggagcuccuuccuguggauguugaaacuuguugaaaacccacgaagggaggacucuguccgcugcaggcgggccaggcauucggaaaagccugugggagaagagggguggccuagacacaggcuaacccccuccccaccacccacccucuucaccuacccgcguacuuacagacaaugccacagggugaaaccuugaaauaagagaggauguccuaaauuaaaacacguaaaugccucuccaagaguucaaauaaaauuucauuuuaaaagcaaaaggcauaaacuugucaccucaguuuauuacugagugcuuuugaacuucucagaaaagaacucuauaaacucaugagagaaauaugauuuaugauccccuccuucucuucuuuuccauucugugggaggagguacagucaggaucagcuagggaggcagcguugggaugagggcaagaccccacaggggagcagcaggccagggcgccaggccaggcccagccucagaccaggcaugggcgcaucucuccagcuuucugagccucucuccuguacuuaauguggagaggcuguuguggguuccuuguucuucuaauauuuugagcuucuguaucauauuuaaaaucuuucuuugauauucuaguucggagagauucuaguuacagcauugaaaaacaggcucuguuaccuguggcaguuuaaguccuaagaaguuaaaauagaauaaaauugacauuucuuagaguuugcuauuaaguaagggucuuggccaggcacgguggcucacacuuguaaucccagcacuuugggaggccgugccgggcagaucacuugaggccaggaguuugaaaccagccuggccaauauggcgaaaucccaucucuacuaaaaauacaaaauuagcugggagugguggcaugcaccuguaguuccaucugcuugggagucugaggcaggagaauugcuggagguggagguuggagugugcugugaucgcaccacuguacucuaggcugggcgacagaggaagacccugucuccagucaaucaaucagucaaucagucaaucaauguaagggucuuaaaccauccccaaagcaaaggagucuauguuuaugucccgggcaucuuaacccuccaauucaaucaguguuuauuaagcaucuuauagagcuaagaauuuugaagguugacuuuaauagcuuuaccuguggagagucucauggcagggaacaugagaggugcuggcguuucuagcaaagccugguuggcccugauucuguaacucaaggcagaauaaaugccccauaaccaccaccccauguuagagaagauucuuagggagagguuuggaaaacagcaugggccaggcgugguggcucacgccuguaauccuaguacugugggaggcugaggcgcgccgauugcaugagcucagggauuugagaccagccugggcaacauggcaaaacaccaucucuacaaaaaacacaaaaauuagccagucaugguggugcaugccugugguuucagcuacucgggaggcugaggugggaggauugcuugagcccaggaggucaaggcugcagcgagcugagauugugccacugcccuccagccuggccaacagagagacccucucucaaaaaaaaaaaaaaaaaaaaaaaaaaaaaaaagaagaacaguauggucaauaggcauggccuuagcucucuccaaggcuuaauaguacaauguggggaaauugagaaaaagauaagaaagggaguuucaugucacagagacccagccuuggcugacugaccucagaaaggguacuucauucaguucucggugcauucuccucugugcagcagggcuaaugcugccugugucauuguagugggggcucugugagauauuuguagagcacuuagcucagagccuggcuuaugggaaauguuggaugaccauguagaagucagccaucacauguugggugcucgccgagugcugagagcuuuaccuauagcgucuccuuuaauuaaugcuaauuugacauccuauccagauucccauuuuaccauaagcaaaucgaguccuagagaguucucuacauaaccugaaauugaacagcuuacaagagccaagaucugaaauaagacccuucugcuucaucaauguugguuucuucucuuugccuccuuuugucuucgccaguuuuucuagauaaaaaucagaugcucaccugggcacgguggcucacaccuauaaucucaacacuuugagaggcugagucaggagagcugcuugaggccagaaguucaagaccaguuugggcaacauagugagaccuccuguccacaaaagaauaaaaaaaaaaaaauaauaagcugggcaugguggcacgagccuguaguacuagcuacucgggaggcugaggcaagaggauggcuugagccaaagaguucgagccuacagugagccaugaucaugccacugcucucuagccugggauauagagugagacccuaucucucucccucuuccccccaaccccccgccccggccccgcacaccaccccccaccccccggaaaaacgaaaaagaaaucagaugccuuuuaguagucaaaggcuugguuaaaacuguuaguuccacauaauagaaacucagccugagcucuguugagcagaaagaggaauuugcucugaggauucugggcuaugucacagaacccaugacaggggugcugaugcccuuccacagcaccugacuccagggcuuggaugccagcggcccccuccucaacucuucuccauccacgcaucugcuuuauucucucacuccccauuugguaggagacgcagccccccagucucccugggcaugaacucucuggguuuugagucugaaaaauuccagaaaagggauucauuggcccaucuuggaucaggggcucacacuuaggcuagucagcuguacccugggggcuguccugccauagguggggagcaaggggaagauguguucuccagaagagagcugguggggggcagugcugggcugucauccucauagcaggccccugcagucacuaaaucauauaugugaucaugagcuugugggugauguccucagucuauccugagucauucagagaagguucagcuggaagaaacucauggucuauguguacuacauagaaucaaauccucuucuuccccugaacacagagagugauuguggugagugaaaagugaguccacguggacuggaggaguugggcagguuuuacagaguggggguuguguaagacagacguacgaggagacaggaugagguaggaaaagaaucuccagaacagggcagaagaaaagggagcaagauguucuucaaggagcauugaaaguugcugcugaaggaagaggcucucaagugaaagaguuuggucuucauucucuaaagagcugggagccacugaaggcuucugacaaaagagcagguguuguagaaucuguauucugggaauguucacuuggcaguggcaucuauucugguuggagagagaucaaguuacccugccacuagauguuuugaggaacccaguggaaccaggcaucuguuauuuuaaaugcuuuaguggggcucaagcccggaaauuacugagggcucuucauguuugccaucucuccuuucuguuugcacauuuaagcaaaugugaaauguaggagcaacauguccaacagcaugggaagguggaaaacuauguugaaagggaggagagcugguuuuuaauccuggcucuucugauaagcagcggggaaaccaagguacgagagguggguggaaaauugaaccauauggucagcccacuaacccacguccagcccucagugucuugggaacuucuuugcaaagcacaaauacagacucugguaaccaaaaugaccagaagacagagaaccgagucaaaggaaccuugacuuuucaaagugauugggagagggggagcauguaaggguuaagacuuggguuuagucaucauacuaacacagguuucaaccccaguucuaacccuuuucugagacagggucuugcucuguugcccaggcuggagugcaguggcacaaucauggcucacuucagccucaaacucccgggcucaaguaauccucccacuucagccucccaaguagcugggacuacaggugugugccaccacaccuagcuaguuuuuaauuuuuuuguagagacagagucucaauauauuacccaggcaacaggcuccuagacucaagcgauccuccugccucccaaagugcugggauuacaggcgugagccaccgcacucagccccaagccuucuaagcucugugagcuccugcagucacuuaacgcgucuguguguuuagaugggaauagccccuaaaggagauaauguauaucaaguguugaucacauuccuggcacaaccaaaagcacuaaaccagguguugacucuuauuguccaucuucucuuccuuucucucucccuccuuuauuguccuucaguuccuuucuuuuuuuuuuuuuuuuuuuuuuuuuuugagauggaauuucacucuuguugcccaggcuggagugcaauagugugaucuuggcucacugcaaccuccgccucccggguucaagugauuguccugccucagccuccugaguagcugggauuacaggcaugcaccaccacgccuggauaauuuauuuuauauuuuuuauuuuuaguagagacgggguuucuccaugguggucgggcuggucucaaacucaggugauccacccaccucagccucccaaagugcugggauuacaggcaugagccaccgcucccggcuccuucguuccuuuuaucacucaaagugguauuacuuaaggagucaaauccguagagacagaaaguagaauggugguugcuggggugggguauggggcaaggggaguuguuuaauggguaugaagcuuccauuugagaagaugaaaaaguacuggagaugagugguggucaugguuggaugacagcgugaauaugcuuaaugccacugaacugugcacuuaaaaaugauuacaguggcaaauuucauguuauguauauuuuaccacaguuaaaaaaacaaugguauuacuuaaaucauuucauaauauauggaaguugagagcaguggguauaaaaaaaauaagcaauuuuuuccuuaagcgauggagcauaguugcuccaggaaagaagugggugacugauguuacugaauccuggggcaaagcaaacccgcaucccauagaauguuauucccaaggaguguucuggacaaucuagguacaaugaggacagagaccaaacccuucuuugugcaucaggaugcccuggggaaauuuucuacuuacuuuugaagaacaacucccaaaauagagaauuucggggaagggaagacagacuuauuuguuauccucucuucaugacaaaguggauggaggauaggaaaaucaaacuaauugaaauccaaggcugggcgggguggcucacgccuguaaucccagcacuuugggaggcugaggcggguggaucacgaggucaggagagccagaccauccuggcuaacacggugaaaccccaucucuacuaaaaauacaaaaaaauuagccuggugugguggcgggcgccuguaaucccagcuacucaggaggcugaggcaggagaauggcgugagcccaggagcuugcagugagccgagaucacgcuacugcacuccaaacugggcgacagagcgagaauccaucucaaaaaaaaaagaagaaauccaaagauguuugaauuucuucacuaaauauuagccagaaccugauauguaccacagugauggagugugguugguacuuaaaggaaaaagaacucaggaagaauccaggaagggggcagucaccuuaugaugaugaauggguuuugccaaaccucucagaauuugggcuuuuguuuucugaccauugucucacugaguucucugaugaaagucaaagcucguaaaauuacaguguagguguuaaucuagcacagcaguucucaaaguguggcugggggcugguagggauucucaaggucuuuucuaggagcacccacaggaucaaaacugccuuuuuuuuuuuuuuccaagacaggaucucacucugucacccaggcuagagugcagugacacuaucuuggcucacugcaaccucugugccccaggcucaggugauccucccaccucagccacccgaguaacugugacuauaggcacaugccaugaugcccagcuaauuuuucuauuuuuaauagagaugugguuuugccauguugcccaggcuggucuugaacuccagggcucaagcaauccaccuuccuuggccucccaaagugcugggauuacaggcgugagccacugugccuggccaaaacuguuuucauguaauauuauuuugaaauuauuuuuauuuuuucgaggcagggucuuacuauguugcccaggcuggucucaaacuccuggcuucaagccauccuccuuccuuagccucccaaagugcugggauuauaggcaucagccacuguucccagccuguuuucaugguaauauugaagugacauuugcccuuuucacucuuauucucucacaaauguauggugagguuuuccagggacaucauuguguguagugacuucaucacucugacaacuaauggaaugugugcuugcauauucuguguuuuaaagauuucucagauuauaauuccuaauuugguaaauaucaauagauauaaccaaaucagaaguucuugggguucuuaaucauuuuugagaaugugaaggaggucuguaaucugaguucauugagcuggcauuauggccccacuguaaagaucaucucagagagcuuagcuggguuagagaaacccuucuauaaaaucaguggaaaugaacagaaacuagaggacaauacagggaguaaaggugaacuauucuguucugcaguacuggggccaaaagaauguugguucugaaguguuaguaauuugaguaaaaccaauggguugcaguuuuccacauuuaauaacaaacaaccagacagugaauuugaagaaccucagcgaagaagaucugaauaucuuugcugcuugcauugggauauaaccuucaaccuugacguagaacagggcuuaccuggaugggucuuuacuugagacaggaacuuggguaaagcuacagaguuuuuuauaagccauguagauauuguggggaugaggggccuuauccuuccgcaugccauccucauugggguuuugaucacagaucuguauuuccugggauaccugagugcccucggcuuuaacccaaguucagcuuagcacuccugaguggugagauucucaacuuaagagggacgguugggccggaauccuugggucugauuugcugugggaaggggaggaggcuaacugucccauggaccuggucacagcuguuccacaucauaggucuuggccucaccaggccuucucuggucagugaaacaaguagguauuugucauguaccugagcacggggcauacugacuauugcuuauugccauggcaucccuggaagcacgcugcaacuauuugggacugacgguaucguaccuucccugguccucuuaucacauuguuuccaaacgggggcaauuuucaccccaggggauacuuggcaaugucuggaaacauuuuuggucuucaaaaaugucaggguuggggggugggagugggggugcuuacugguaucuaguggaguuccccuuccuccuucauuccuuucucugccccauugccugccaugaacaacagguuccugguagccuuugugcuaugguucuguugggaauuggugcucuggcacauuccucucuccaucugaggagugugaagagccuagaucuuaaagcugaacagcugaggugcaagugaucguucuguucaguaacagcuggguuacuuugggcuguuuaaccucucugccuccguuucuccauaccgccucuguaaagugaauucugauaauuaaaaaaagaauaaaguggcuggguacaguggcucacaccuauaaucccagcacuuugggaggcgagaggauaacuugaagucaggaguuccagaccagccugggcaacaagcgagaacucauuucaacaaaaaaacaaaaaaauagcugggcaugguggcacacacuguagucucagcuacucagaagguuaacaugggaggaucauuugagcccaggaguucaaggcuguagugagcuauaaucacacaacugagagugagacccuggcucuuuaaaaaaaaaaaaaaaaaaaaaaaaguaugacccaggcacgguggcucacgccuguaauccuagcacuuugggaggcugaggcgagcggaucaccugaggucaggaguccgagacagccuggccaacauggugaaaucucgucucuaguaaaaauacauaaauuagccgggcaugguggcgggcaccuguaaucccagcuacucgggaggcugaggcaggagaaucgcuggaaucagagaggcaaagguugcagugagccaagaucgcaccacugcauuccagccugggcgacagagcgagacuccgucaaaaaaaaaaaaguauguaaaguucuuggaauaugugaauacucaacaaauaucacuaucaauuucuaaacauacugcuaccaagcagauggaagucccuuuucuaaggugagcaagauggguuucuuguugaggaggaaguuuggaaagcucuucauauuuauuuuaaggagcacuuggguagcuaucuccuacauuugauuaaaaccggaugcaagcaagaaacuuaguaaaggaaaucagaucagaaagaaaagauuggcaugauguaaguggaaaaacucagggaauacaaguuuucuucuaaggucauauguaugauuugaaagucacaaaauuuuaauuugaugcuuuucaucuacaccaccuaaaucuuccaugaaccucuugguuaaaaggcuauauuaagcacaauacuuuuaaaaaacuagaucagagacauuuuuagcuauaaaaggcuaacugaaaccauuauuugagauccacugggaggcuuaagagaguuuugaagauagagugaguuaacagaacaaauaaugugucugucaagccaaggagcacaggcggcuggccaccucccaggacugggggaagccuagcucuagacacuccucccugccacuguccccauccauugaaccaggcucuugaugcaacaagggucacaaaugaggcuaaaucagagaacuagagaugguaugacuggccagcugaaaagcccaucaaaaauagcuacugaagccgggugcgguggcucaugccuguaaucccaacacuuugagaggcagaggugggcggaucacuugaggucaggaguuugaaaccagccuggccaacauggugaaaccucaucucuaauaaaaauacaaaaaaaaaaaaaaaaaaaaauuagccaggcaugguggugggugccuguaaucccagcuacucagaaggcugaggcaggagaauugcuugaaccugggagguggggguugcagugagccaagauggugccacugcacuucagccugggcgacagaacaagacucugucuccaaaaaaaaagcuauugaaaaaaaauuagcugggcaugguuagcuacuugggaggcugaggugggaggaucacuugaggcugcaaugagcuaugauugugccacuguacucuagucugggugauagagcgagaccccugacucucaaagaaagcuacugaacuugucuaccuuugagaggccauuuugaaggauagaggaaguaccaguaucgggucaguuggccagaaucucucauuccuggagacaagcccaaaagucccaucugcuuuuuguucucaaauagagaggccucauauacaucuggccaugcacauacguuaugccagccacaacagugggcagucacucgagugcguugcagguugcuggggcuaccaugacagugacugcacaugauugguuuucugucuacgaagcucccagaaaaccuggacauuucuggaguucccccucccuuucaguguacuuguauagcaccugugcaggagagcaccacaccccuaaccucggugacauaaauucucacugaauguagagacagaaggaaaggggacggcagagaaagcuugucugugagccuuggucacaagaccucagacugcagagacaugcaauuacuuuucuucuguccuuuguguuuccaaaagcaccauauuuuauuugauaaaagguacaggggaccauucugcuuuugugauguuguuuuccaaaucaagcaucaggcucucuggucugaguaaugcuuuuugugcugaguauuaaguuugagacagucuaaacaauuccuuuggggguacugaaauacuuuaaauuuugcaucauuuuugcuaguuauaaaaauaauaaaagaguuucaacacauuccauuuguucuaagcacuguuggauuaaauaaaauucuggucagccugaagaacgugggcuauuucuugugcuauauauaaagguauguggucuuuacuauuucacauuaaccuguugcuagagguuuucacaaauguaucaauucacaaaagaaccucagagaaaagaaugugaaauaugcuaggaauuuuuguuaaccuuggcuugauuuuuagaaguuaaauuuuaaaauguuuuagcuuuagaagguucuuuuuucauuucuuaguaaacauagucauuuucuugguguuuucuaauuuuuuaaguuuuaauugaugaaaucuuaacaucuuuuagaaccuaacuguaaagguguaguuacaauuuacaauuuauagcaucaacuuaaucuuacuauuucaguuacuguauuauuccauuugcauuacucuaaggaauaccugagacugggaaauuuauaaagaaagagguugaauugacuuaugguucugcaagguguacaggaaguguguugccagcaucugguucuagugagggccucaggaagcuuacaaucaccacagaaggcaaagggggagcugguguaucacacggcgagagugggaaugagaugggggugggaugcuucuaggcuggggugcagugaugcaaccauggcuuacugcagcuucaaccucccgggaucaggcgauccucccaccucagccuccugaguagcugggacuauaggcacgcccaccacacccagcucauuuuuagauuauuuuuuguagagagaaggucuuguucuguugcccagguuggucaccaacuccuggccucaugauccuccugccuuggccucccaaagcuuugccuuuuuuuuuuuuuuuuuuuuuuuuuuugagauggagucucagucuguugcccaggcuggagugcaguggcgcgauuucagcucacugcaagcuccgccuccuggguucacaccauucuccugccucagccucccgaguagcugggacuacagaugccugccaccacacccggcuaauuuuuuuguauuuuuaguagagacaggguuucaccauguuaaccaggauggagcuuuaccuauuuuuuuaauuggcgaauuuuuccuuuuauuauugaguuuauugaguuaugagaguucuuuacucuagacauaagucccuuauuagauacauuauuuguaaguauuuucucccauucugugggauaucuuuucacuuucuugaugauaaccuuugcaacccaagauuuuuuaaacuuuuuuuuuuuuuuuuugagauggagucucgcucuguugcccaggcuggagugcaguggcaugaucuuggcucacugcaaccuccaccuccuguguucaagcgauucuccugccucagccuuccgaguagcugggauuauaggcacacgccaucacgcccagcuaauuuuuuuauuuuucaguagaggcgggguuucgccuuguuggccaggcuggucucgaacuccugaccucaagugaucugcccaccuuggccucccaaagugcugggauuacagugagccaccgcgcccagccaaaaguuuuuaaucuugaugaagucugguuuaucuauuuuuuucuuugguugcuugugcuuuuugugucauaucuaagaaaccauuggaaggcacauucugucacugagauuugccaguuguccuuacuguaguauuuuacaugggucauauauuuaagguccuucugagauuccuaaaaauaauuaauucccuuuucucuucaaaagcuuuuaaguuaauagagggucuagaaguguuccucucucuucaucacuuguccuuauccugaccugccuuaaagcaugaucccuugauuuuaucugggacaucugagccacaaaagucucuauauauauccauuggcaagaggaugguagauccuuauguaugucgauggucaggauuccuucaauuucagcucaauagcagaguggcugguuaaaaauguggaaagaugggagagccacugccaaaucuccucccauuuuuagcuaaugaugguucuggaagggacuggccugcuauuucuuacaauuccagaaaguauccaugaauguacaugcugcugcugaccagccuuagggagggccugauuucuuaugggcuuaaaguuauaguccaucaaaucuaaguuagggcagauaaaagacagcuuaucaaaauaaagguacaagaggugccauuuugaaaccuaaugcuguagaaaggauguaggcaaguaacagcugucaguaagcuucccaccccugcugcgcuuucgguguguuugaaaagagaacaacuccaaguuccauuuuagaauguuaaagaucuaaaaaauguuuccaaauuaauuuuucucucaaagguuugcugaugcgcaccagacuguaaauaauugcccuaacugauggccaggcccuuauucucagaaggggauauaggugucuuugugggauggguauccuuaagcaggaucugugcuccuaagaacagcagcaacaggcagugcagggaccuucuguugaauucuaccuguaaaccacagccugucuggaaggucugacuccaggccacucagccuuggcaagcauguacuuccgaaagcgccuggcagaaaugggagcugauagacaggcgcacauggcagggggagauccuugugcaguggcuugacacuaacuagaccagagaccauuucccauguucuuuuucauaacaccagaagcaccaaggaaagagaagaaaaaaauuuugcacuuauuuuugggucuuuucuaucacaugaaauucaucugaaacaguucaaauuuuguuugauguuuuagcaccccauuuuuccuguuauaagauauucagucucucugcagauauaaugcaauuggcuuuuauaucaugauuauguuuuuaaaaauaaaauaaauggaguugacuaccacacagaaguuuuacuugggauggaaauugacucuucacuaaaggucaaaauagaauccauuuguuuuggcugggcgcaguggcucaugucuguaaucccagcacuuugggaggccaaggugggcggaucacgagggcaggagauagagaccauccugguuaacacgaugaaacuccaucucuacuuaaaaaaauacaaaaaaauuagccaggcgugguggcgggcgccuguagucccagcuacucaggaggcaggagaauggcuugaacccgggagguggagcuugcagugagccgagaucgcgccacugcacuccagucugggugacagagcaagacuccgacucaaaaaaaaaaaaaaagaauccauuugaugugcacgcaucucuuaagaagugacugaaggcucgugccuguaaucccaacacuuugggaagucaaggcaggaggauugcuugagcucaagaguuggagaccagccucggcaacauagugagacccugucucuacaaaacauuaaaaaauuagccagaugugguggugcaugccuguggucccagcuacucgggaggcuggagcgggaggcuugagccugggagguggaggcuacaguggguggugauccugcuacuccaaccugggugacagagcaagacccugucucaaaaaaaaagaagugacugaauuacauaaagcuggaucucuuaccagcccccugcauaccccaaucccucugucuuugcuuagguugggcuuucuuuuaugaauaauagaaaauaagaaaauugccuguuuugggcaauccagguguguuucagagauuuggaguuaaaaagucaaguaaauauuuuggcaacccaacaaagguaagaaaagaagcaugcaccuaacgggcuucucgaauuacaggcuuguccaaacacugccuuccucaagagacgcuggucagggacaaagccugcccugcugucaacagcaaggcccggcugagaagugggcuugcuucucuugcugguccuggcccugagccagauaggacgccauuugacuuugauucagucugacccaagagaaaauauaccaucagcaaguggaggaucuuuccuccuuaacagacuuuagucauauugcuucuucuuccuugcugaaaaaaagcccagguagauuuuucucucccguuaaauuggaacccugaaguuaggaggcacaguaucucagauacugucagauaacaagagccaccuuuucagucucuguaacuucaucuaucucgaggguugggaggcagacagcuaugaaagaagacccaaaagcagcagaaucugggcaucccaaguguacccgaagcacgccagucuagguggccccucugucaccugguuuaagaacagacaucuuagaaggaaggagcucugaccagcuaguggcaugucuccuuucaagcugugcuuugugucucuucaacagaaaggcagacaucagagaacugccucucuuccucgcccucccccaguggcuuccccuggaucaccuuggcagggccucauccugaggaggguggguggaggagggaggagggcggguggcggcugcaguggcggcuccuuugaucaccucccgcccgguuccagucccugcugccagcaggccagccaaaggcccgacucuacugaucugaugaggugcugaauaggacccgaagggcagggacagagcaagaagaaagcuucgggaaugaaaaggaaaccccgugaaccugcucggcuucauuggccggauuuuccuaccagggagccgcucaguuccugccagccagggacugccugccccucacucuggccccucuugucuccgcuuuucagaccuuuguguguguuuuguguuugaaucacggcugcucucccugguucucaggcugggaacccacugcgccuguuuccauggucacugggaagcucuuagcgccaugugcuucaaagggaaccuuuccccucccagcacucgcugcugccugccccagccaggcucacaauaagcggcuccuccaagccaggccucugacccucacuugccaggaggaaaaccuugccuuugccaagcaaggcugugcagccucacagaaauauuccucagcagagcauguggaugcacacacacuuguggcacaucaguccucacgugccuacuuguagauuuuuaugagauauagagcuuauagauuggugagagaguguuaacuuuccucacaucccucuguuuaggaaccuuucugaaauugaagaaaagagcaaagccuaagccccuuguaggaaaagagaugagcuuguuugggguaggaggaaaggaggaagaagacccaugucuuuugggucagcagagaauggaauugaagaacuuagcucugggcuuccucucccugcagcugggguggugagggugguaccuguucacucuuccagggccaaggaugccugagcaguugcccaccaggcuugaaauuuggcuuugcuuauuuguugaauaaugcaggggaaugaagccucucacaucugacuggagagagucaguggucuagugaucuuggagggcugcuacaugaugacacuggaauuaaaaggugacugucaggccaggcgaggugggcggaucaccugaggucgggaguucaagaccagccugaccaacauggagaaaccccgucucuacuaacaauacaaaauuagcugggcgugguggugcaugccuauaaucucagcuaucgggaggcugaggcaggagaaucgcuugaacccuggaggcagagguugcagugagcugagauugcgccauugcacuccagccugggcaacaagagugaaacucugucucaaaaaaaaaaaaagacuguccucugaagagcuuauguuuuagaugcaaagccugcuccccuagcuuggagcucacaauauuaauaucugccuugggcuuauugcacuauauagagccuguaugggaaauuggacauuucuccaguauuaccagugaucaagguucuuaucauccguuucuuuuuuuuuuuuuuuuuuugagacaguuuuguucuucuuguccaggcuaccgugcaauggcacaaucucggcucaccgcaaccuccaccucccggguuaaagcgauucuccugccucagccuccugaguagcuggacuuacaggcguguaccgccacgccuggcuacuuuuguauuuuuaguagagaugggguuucaccauuuggucaggcuggucucgaacuccugaccucaggugaucugccugccucguccuccgaaagugcugggauuacaggugugagccaccgcaccuggcccaguugggcucuuuugacuccugauauugucuuuccuuaucguuccugguuccuuaucagucuccaggcuggcugcuguuggaguguggguggcccccugcagaagacacucucaguaguugugcuccauggcuuucuguguagugaugggaauuucagggccauuucagaugugcccuuuguauuacuagaauaaagugcaccuauuugguauuaacucuaauuucuacuuguaacucaugauucuggaaaagguuucuaaaacuugcagacuugaagcuuccaucauuguaccaaaaucugucuucucuggccacauguagcauuuuaaggguagguuuugauaaagucuuagcccaggagccgcagcaucccaaagaugcuuuucuguuagaacaugcauacacagaccuaaaaguuaguacauuuggcaugccugugaaaagcaaacugaagaagaaugcuggcuaccauaaaacaggugucaugauugcauuccuacuguaugccagguguuuucacacauuaucugaaauccuuacaguauccccggagagaauuguuaucagaugaucauuuugcugcuaaugcagggaggaggggacagaacgacuugaauaacguguguggucaugcagcuggucugggcagaggugggugggagcaaaggccccuggcucuaaugaauggucuucacagggguaccuaccagugguuuugggauuacuuugaacagauucuagggggaaaguuugguuaaauuuagguaacugguuucucaucauuuggguacuugggaaccuaauaaguggacaaaacgucccacugaaauuaucuuguucacgucaugcacgguggcucauaccuguaaucccagcacuuugggaagccaaggcaggggaaucgcuuaaggccaggaguucaagaccagccugggaaacauggcgagacccccaucucuacaaauuuuuuuuuuuuuaaacuagcugggccugguggcacccacuuauagugcagcuacucaggaggcugagacaagaggaucguuugaggcugcagugagcugagcugugaucgcaccauugcacuccagccuggggugacaagaccucaucucuagaaaacaaaucucuccuauagcuuuuaauuugcuccugaucguucccuuuuguaauauuuuuaucauagcuccccuuuuucuuuuaucaguuugccccuuucauagaaauuccauuucuuccuuuuuuuuuuuuuuuuuuuuuugagacagaguuucacucuguugcccaggcuggagugcaauggugcgaucucggcucaccacaaccuccgccucccagguucaagcaauucuccugccucagccucccaaguagcuaggauuacaggcgugcacaaccaugccuggcuaauuuuguauuuuuaguagagaugggguuucuccauguuggucaggcuggucucgaacucccaaucucaggugauccacccaccucggccucccaaagugcugggauuacaggcaugagccacggcgcccggcucagaaauucuauuucuuuccuuuuugcaaaguuaccugaaauuguaccucucucauuuguaugcucaaugaggaaggaaauaagagaggguggcacaauuaaucuguguucaaaaaugucaucaucacugugucucguuugauaagcagauuguauucuuacuagugagaguagaagauccugaauaguucagagucuggccagggcaccacaaccacacauuucagagcacugggccauggcuguggauucccccgaggaacgaguuugcugaugacccuguuugugcucucccugagggugaugguuucacuuauuccaugcucugagccaacucuccuaagauucuuuuaucuaacauggccugcagaaguuaaugguggcaugauuuacuuugacuauuuuagaugccaggcgugugucuugaagagaccagugaagaggggcuugaaguucugauucacucgaacuuuuuuggguuuuaugucuuuccuuucucgucagcaucaaggccaucuaacuucaaggcugaaugaaugaguucuguuuuccuuaauagggagagggaggagauggccuaggacucauucacagcuguguguguggaaagugcauuggugauagaucuugacuuauuuagugauuuuucagaagauuguugguuuuucacugguaagaccaacaacuauccuuguuaaccagcuuuaaccagaaggacuaaggaaguuggacaucucguaccacucgcaauugauuuucuaaugcaguucucuuguuuaaauucuguggcugugauaaucuagguagccaauuacucuuuuuuguuaacuaagaagauuuauacugcuguugugcuaggguuuguaauuuaagguguggacauguccaggauguuaaauuuagcuugugucucaaaacuagagcuauccaaacucuuuuuugcucugguugcccuggucccuugauguucagcaagcagcuuugcagugcccacagcacuccggccucccuccuugguacugcagggccacugugaagagggaaucaggacaggauccuucaggucuuggcuuaggcaucuuuuuuuccuaaaagucuuucuggaccaauagucugucagcagggacggcuucacagaagagaugaaacucaacuuuuaagacuggcuggguuugggggagggaagagaccaagaaggaaauuccagcaguggggcuggcaggagcagaaauaacauguggcguaucccagagccagucaaaaagagcaacuugacugggcgugaugguuuuagcaggcaggagaagguccccuugauaaggaaggcauuuccagggagugcaucaagaggcaugcagaauaaucugucauaagaguagaguuuaaaaaaauaaauucaaaaaaagaggcaugcagaagaguagugcgcgguggagggagggaacaggaugugcuuaggccuagaaauagauugccauucuggucauuuccaugauauugcuguguauuacuguucuguggcaauuuaaguaaaagagaggaauaaaacuuuguaauguauuagagaccuuaaaacuuaaaauccaagaagauuuuuauauaccugaauuaaaaagugggacuugguagaaguuacccaggaaacauaaaaaaaugaacagccuucucauuuccccacuucugugguccuaauucuuugaccuugaaucuucucucucucuuuaaaauggugguaacuauauacaucauauaagcuucaccauuaaguguacgaguucaguggcauuaauuaagcacauucacucugcugugcacccaucaucacugaccaucuccagaacuuuuuccucuuuuuuuuuuuuuuuuuuugagacagugucucgcucuguuucccaggcuggaguccaguggcucaaucucggcucacugcaagcuccgccuccuggguucaugccauucuccugccucagccucccgaguagcugggacuacaggcaucugccaccacgccuggcuaauuuuuuuuuguauuuuuaguagagaugggguuucaccgugucugccaggauggucucgaucuccugaccucgugauccacccgccucggccgcccaaagugcugggauuacagacaugagccaccgcacccagccccucuucuuaaacugaaacuccauaccuauuaaacccaggcuccucacuucugccuccccacagccccuggcaaccaccauuccacuuucugucucuaggaauuugaccacuccaggucuuuugugaguggagucguguauuuguccuuuugugacuggcuucuuucacguggcauaaugccuucaagguucgcucuuguuguagcauguaucagaauuuuauuccuuuuuaugauggaauuauauauaucccauuguaucuacauaccacguuuugguuauucauucaucuaucuauggacacuuagguuguuuccaccuuuugauuacuguaaauaaugcuaccauauauauucuguauauugaucccuuaccugauauacaugaaauagucuuucucauccuguggcuugccuuuucauccuauugauaguauccuuugauacacaaaaguuuuuucucauuuuuguuuguuuguuugagacagagucucacucugcacccaggcuggagugcaaugcuaccaucucaacucacugcaaccuccgccucccagguucaagcaguucuugugcuucaaccucccaaguagcugggauuacagguguccaccaccaugcccaacuaauuuuucuauuuuuaguagagauggguuucauccuguuggccaggcugaucuccaacugcugaccucaagugauccacccgccucagccucccagagugcugggauuacaggcaugagccaccaugccuggccaaaaguuuugacucuuaaugaagcccacuuuauccauuuuuucuuucgucaccugugcuuucggugucucuucucuuuuuuugugcuugcucuuuaauucaucuucaucuaccuuuuuuuuguuuuaaacacauagaagguuacacaaacauaucuuccuacucagccuugguuuauaauuuacuguugcccuaagaauuucagaaaggaaaagaauucuugcuucccuggcuaggcucuuggggucuugaugugcaagaagaaaugcuguugugaauacaaagaaugaugaggaaguauacaaaaggugcccuaggcuggcugcggggguccagcaggcuggcuacauuauucuguggucaaccucuuacaaauggggugcuccuguccgucuccguggccagcugccaccagcccuauggugugaauggcaaggaaguggggacuggcggcuggccgaacuccaggaugcagccuuggcuggcagagaaccaaaggcagagggggaaaaacacucuugaguaugagagaaauaaugcuagcuccgaaaccuauaauucgcaaguuuaaaaaaauuuaaaaaauaaaaaagauuuuucaaccaaacugugcuuuuaucuuuagguucugaaugggagauuguucacacagcuaagcuggcugcagaagcuaggccaguuaaaacaauaugcaggcagcucuccucuaaguaaccagaaacuguuggcucaaaggagccugaaccgaggaaccaaccugcugggagacguuuuccaaguaacuccaagcaacagccugaauguaaauccucccgcuggggaauggcacuuuggcaaaugaagacccuaauuagagauggaaggguuucuauuuuguuuuucuuuaauccuuacccuggggccuuugcagggccaccaugucucugcuugugugcaaagaaauuuccagcuucucuuuguaacaagauccucuuuugggaaagaagcaacaagccgacaaugugggcccaccacagccgggggacccugcaaccagccuaauccaaaacaaaaaggccuggucugggccggagcagcugggucaccuggauuggccaagucguuugaaguugcuagccaaguuggaucuuauguugccccugccccgugagacacucaaauccgugcuuagagugcaagugaaguuucuuaacuuccaaaggagaacagcagugugaacaaaaugcaaagcaguaagagagaacuguagcucugaggcacuagggccaagguccaauugaauggguguggagcccucuuaucuccucagccuucuauuugggucuucacuauuggaucuaaacagugaagcagagggacuaugcucucuuucaaauugaucaccuuaguucucaaaacauccagaaguaucacauacguggagaaccugcccacgccaguguuguuuuguugugggugcaccauugacuuacccaguauucucaaggucuucgaacugaugauucugcucaauuucauuucucuuuggcccuggaaaggcaguugaguagagcucucugggaccaaaguaucaagcuggucagugaaugauacaaucaauuuuagauaguuguggauaacugaagugaaaacaaagacauaccuuucagcauccuuuacacugguagguguaggaagggcccccaucgagggccguuaacuuacuuguuaaauucgcagcuuacuacaggaugcuugugucuaagugauuucaacuucugaaggggaauuacacauuuuuuagucuuaacauaggaaggaugcuucucccuaaccacgacuccaugcugagucucaggcugggcucuguccagauagaaucaucuuuaauauuuacaacucugugaucugguugguacccugcuuuaaagaugaauacauugagacucaggggaaggggcuaagcuacagacaucagccauggcuccgucccagguuagcuccagaccuccugcucuucucaucaguucuguccuuugaguuacuuaagcguauagaugguaguugauacaguucugcauaacagacugauagguuccugaccaacagucugcuccuacccccucuuuuuugggaagccgagugcuguugaagagccacccauuccugguugccacaugguagacaaauaugucugcugcauuuacuucccagaaguccucagcuugcucaugcugucuaaaguuagcuuucagggaaucccaagauguuucuuuuucagcucucugcuuguggucaggcugcuucaacuuggagaaaaacggcccauucuguuagcugucgggcaaaaugaugacugugaagaguaucccuuccaugcuaguaacuuccccuguuccaacuucucaguuuaauuuucagugaagcuucuagaaaccacuuaaagucauugggaaacagguacaucaaggacuaaaaagaaaacugguuuuguagaugcaacauugaucccucuaaaaagauaaggcaagacgacaccuugcccuuuugucuuugauuuuauuccuuggcuccuuggaacaugugcugauuaaauggcaaaauaugauggcaauuuuuacccuuuguuauuauugaaaaucuuugccaaguuacaguuacagcuaauuuaaagcuguauccaaccaaaaugguguuaagagagggucccugauaauuuggaugucaacuugcacuuguaccuaaugaacagcuugacucauuccuggcuaaauuuaugacaguggcuuuggaaggggacucagauaucaagaaccagauucuaucacagauuuuuagauuacuuguauaggccauaaaagcgugaugauauggaguaaauugaauaauacuggauuuuuggcauugcugcuucauuagcaugaggcacuggauggggcaggcguggaggccugguuaggcugggcgcaaugcucuaacauaagcaaccaugggccucacagaauauuggugguagccuuucccaggauggucuugcauugcuaauaaugcuaaaaaugucuguguucagagaaaaacauuaugaaagucuuaauagucucaauauuauccccuaaauagcuuuucccuggauuuuuuucaucuguccuggucguuucugugucauugcuguaaagucacacagccaaagucacacagccauuccgaguauugcagugacaacagcaaggaucccagccaaaaucuuguccucaggaagagcugagacauguuacucuaauuaucacugaugguuuuauugcuuuggggucaugucucaccccuuacccccucacuuaguggcauauuugauguuguucagucaucugaagucacucauuuauccccugaauguccccacugguucccccaguggcagcagucccccggccugcaggaguuguagugcaggcuugggugaugugauuccugauguaggugagaccccugaaccaagagcaguucagcagcugcagcugcucagaagcuaggcuuacacaccaucucccugccgcuccguguuugacagaaagcagagaugcuucagccuccuagcugcacuuaaagguagccuggaugcagugagcuugacuaaguaucucccuuuuguagcucaguguaaaauacagacucuguuuuuggaauucauucauauguuuauuaagcacugccuguaucccaggcagugugcuagacgcugcagauacaguacuuauuaaaguagacaaguucacugcccccauggggcuccuggucaguagaggagacacagagacaacuagcagcaaguaaacacaaagacaacaaacagggcaacugcagauugugaugcagcugcaaggccaacaaacugggugaguggggcuuuucucugcauaggcugccucgagccaagagcucagagucaagguuccugaaagaagagagggaaagauucccacagcccacuccccacaucagagcuugccugccuccgcuccgucaucuguucuuugacacaucugcaaccuggggugugcucugaugcuuccugucauucugucacuuucuaacccaucaaacagcacuuugcuaccauauaaguauuaguaucugccuccugucugcuaagaaauaaaaugaaggcacucaagucuuacagaaaguuagcuccuuuauuuuagguaucucguuaaauauucucuacuugauuauuaugugacaguugcuuuuaaauccucugaaaguugcauaauaugcuaugugauacgaaaggauguauauauaaaaccuuuauuuuucuaauaauugccuauaacuuaccaguuugaauuguuuuaacgcuuauuguagccuaagaaguccaaaguuuaauugaaauccaguuuuguuuuuuggcuuuggguuaauauucuuccuuccaggcugggcacgguggcucaugccuauaaucccaacacuuugggaggccaaggugggcagaucaccugaggucaggaguucaagaccagccuggccaacauggcgaaacccugucucuacuaaaaauacaaaaauuacccaggcaugguggugcacgccuguagucccagcuacucaggaggcugaggugggaggaucacuugaaccugggaggcagagguuccagugagcugagacugcaccacugcacucccgccugggugacagagugagauucuguuuaaaaaaaaaaaaaaaaaaauccuuccagacuucuuucccucucccgugguuuuaggaagggaaggacagcugggcaugauggcuuaacccuguaaucccagcaguuugggaggccgaggcggguggaucaccugaggucuggaguucgagagcagccugaccaacauggugaaaccccgucucuacuaaaauauaaaauuagcugggcgugguggcacaugccuguaaucccagcuacucaggaggcugaggaaggagaaucgcuugaacccaggaggcugagguugcggugagccaagaucacgccauugcacuccagccugggcaacaagagugaaacugucucaaaaaaaaaaaaaaacaaaaaaacugaaacuggcuuggcugaugaaaguuguaucuuauacugugaacugaauaauguugcaagagauuaagugaucauuacuaaaugaugccccugguacuagugaagguuguugucauaguucaugcagaccugcacaguguaucgaccucauguucacaugaagaucuagauaccugaucaacgaaguguccacucagccccugucaggugcauucugggaggugaagugguaugugacugccuugaaggaaggugaaagccuagagacagauuguaaugguuuagaacuuucucuuuagaaaauagugaauaaggaaacaaggcuuugcuggggcagggggugggagcucuggcaaauaagagguucuucuagaacccacuuccuuuguucuacuaaguaaagucuugcuaacgcugaauaauuauagucaagaaagccugaaugaggccauccuuuuacuuguucaauaaagguuaauuuaaggacccaaugggacuugagauagagcuugaauuuagggauuuuugcaaauuaccuguuaaagccaugaaaacagaaguguauuuguuccuuaauaugugcaugaccucuuacuauuuaagagugauuacugauuaaccagggaguuucaaaggagauguuuucauauucagauuuaaagaaguugcuccagcucagagaacuggcuucuguuggagugagcuaugaacagaguagggcugcucuaucucagagcauuguucauucaccuggagaaacuuccuuccugugucaagcaccuguagcaugcuagggguugugccugcccaguggugcacuaaagccaccucugcaauguuuucauccaagaaacaugaaguaggaaggaaaaguaacacuugccuagaaaggaaaguugucugcucccuauauucucuaugaaauugagacagcuauucuuugcccccacaaauggccuuuaggacagaaccauugagugucaaagacaggcccagccucuggaguauacuugucuauuuccauuuccaaaggugagauguuuuccaggcagagcucugucaguuuuaugaaagccaaaaaugcauuagccacacaggguacacuugugcaguauuuuaaguguaacuugguugccaacacuugaauuggaagguuuaauauaaaaauccacauuucuaccuucucuugaaaaaucagaaggucuggcagugcuggugucccauuucuccugguaaaggaagccccagcugccuagaaguugcccccaucaggcagguguacacuguccagucugccacggcgccugccacucucugcuguccucacacugcagcagcacauccauugccguaaaucuuaaguguggccccuguggacaauugaguuugcaaucuguguugugugauuuuuaaauugcagggaggaagaucauccaggcugucuguggaaaguugagcaaaucaagugugaacgcagaccaauaauuucugacagucaaaccauaaauaugaagagggaccacagagaagcuggauuagcagacuuguauacucugauuuugucaagcacuggaagaccaauuuagggugaccauaucauuugucauccaagcugagacgcuuuugagaauggaagggguuauggugggaggagaaauguaaacuggggcuguccugggcaugcuaggacagaaacuguggacacccuaggccugugaaugggacauggaaacagaaagcuuauauccgucaaccaggaugagugcagaaaagacucauaagaggagcucacauagaggcuacgcugguauagaaauuguucuagaaaaauugggcaagauuuugcagagaaaggaggcuuuuagauguguccuuaagcauugaagcgcuuugagagguaaucaaggguccaggacagcaguugagguaacaugaauaaccuaugcaacagcuggaagaugugcguaugccuuaacuuuucagaaaugggggaacuguguggguggagcaucuggugcuuggagggcagauagugugggaggggagggcggacgggcagaccggauccaaacuggauccaaaggagagucuugaacauuauaaggaauugagacuugaaucugagaaggaugagaagacagcucagggcaucauguauggaaugaacuggaaaaagauuggagacagagaaacugcugcauuacaggguagcagggaugcaaagggagagcccacuugaaaaugauucuuuauggagauuggauguggagagaggaaggggaagggguagugagagaagaggaggaagauuuggguuucuagauuuguaugauggugauucccuuaaccugagacaaguaauguagguuugggagaaacuuggugacuuugacuuugaucaggacuagagcccugacucugacuuugaacuggagcccuuugaacucuagcccugaaaagggucagggcuagagaugaagguugagaagucauuagauaggggaguguguauucaaaccaggaguccagaaugagcuuguccagaaaagaguauagacuaggaagagagaagggguacagcauaggacuuaaaggaaaacaaguaagugaguugggaccauguaagagucagugaagggaacccgaagaccucagagagaagaaaacagaaauaggcugaggagcacaaagcaauguaaacagguugguagaguagcaauaguacagaugacaacacgggugagguagcauggcccugugcauucauuuagcacagguguaucaguuagcuuuugcugcauaacaaacugcccuuaaaacauagcacccuaaaaacaacagucauuuucauugcucaugauucuguggguuagcugagcaguuguucuggucugugccagcuuggcugaucucuguggucagcuagugguuccucugggacugagugaucuaggauggccucacucaaguguuuggggccucaccugggauagccaugcccucucaacauguggucucuuaucauccaguagacuagcccaggcuucuuacaugauaguucucaggguucccagccgcaagagagggcaagcaugaacacccaugaacuauucgauccccucaagcauuuuccaagcuucugcuggcauuguauuugcucaugucccauugaccaaagcaacucauguggccaagcccaaauucaagggguggaaaaauaagcucaauuucuugaugggaggaaucauaaaauauuguggccauuuucuuuacucuaagaggugugaaugucuuguaacacuuggcaggagauauuugauucuuugugucaaucauguaucuuccuucuaguugagcuaguaaagauugaagauuacaacagaacaacuuaaauucugaagacccauuuaauugugauuauuuuaauucuguucccauaugaaagcugaagguaguacagggaaaaacaguaccacuugcauucaugacaugaagcuaaagcgauuacuaaagaaauugauaauacccaguucaaaacucaaacacagguccccucugucaaagcaguacugucugauuugcagcaauuaacaucuuagugccauguuauuuaagacuagaucaaugauuagcaaucauuaauuggcaccuaccauguacccaaacuacaccaagcacuuuacacccaugaacuauuuaauccucucaacaacccuauaaaguacaaucacugucuuaguucuacagaugaggaaacuagggaucaaauauuaagugucuugcccgaggauaucaguaagugugauagaaccagaaauaggaaauagggauuucccucaggccacugggcuccccugacuguaggcagcauuagcaaguaugcaccccaccccacccccaucuugauuauccuuaucuugaugaaauauaguuguccccucacauuugugggaaauugguugcaagaccucccccccaauccccccauggauaccaaaagccacagaugcucaaguaccuuauauaaaauggcgguaguauuugcauauaaccuaugcacauccucccguauacuuuaaaucaucucugauuacuuuaugauaccuaauacaauguaaguacuauguauuaauaaauaguuguuauaaugcaugguucagggaauaaaugacaaggaaaaaaagucauguucaguacagacacaaccauccuuuuuuuuuuuuuuuuuuuuuuuucccccaagacagaguuuugcuuugucacccaggcuggagugcaguggcauaaucucggcucacugcaacuucugccuccuggguucaagcaauucuugugccucagccuccugaguagcugggacuacaggugcaugccaccaugcccagcugauuuuuuguauuuuaguacagacgggcuuucaccaugcugcccaggcuggucuuaaacuccuagacucaggcaauccauccgccucggacucccaaagugguaggauuacaggugugagccaccgugccuggccgcaaccauccuuuuucuuuuccgaguauuuuucauccgugguugguugaaugcacggaugugaaacccacugauaaggagggccgacuguauacucacaucuacugaccuggggucugccugccucccagaguccaggugggcucuguucugcuggucuaacuuacccauucauccagauuucauugagaggggcuuuguuuuuguguguguguggguguguguguguguguguguguguguguguguguguuugagacagagucucgcucuguugcccaggcuggagugcaguggggcgaucuuggcucacugcaagcuccacuuccuggguuuacgccauucuccugccucagccuccugaguagcuaggauuacaggcacccaccaccacgccuggcugauuuuuuguauuuuuaguagagaugggguuucaccguguuagccaggauggucucuaucucuugagcuugugauccgcccaccucggccuuccaaagugcugggauuacaggcgugagccacugcacucggccuguuuuaaaaauacuguaaucccggcuacucagaaggcugagggaggagaaucacuugaacccaggaggcggagguugcaaugagccaagguugugccaucgcacuccagcuggggaaacgagcgaaacucugucucaaaaaaaauaaauaaauaaauaaauaaaaauaaaauaaaauacugagccaguuuuaguagauagcagaaggagguauuauguugcucgaucugcauaauuuuuaaaacuggcuuuggaauuuuccuauauuaacuaaaauuaaaugcauucacauggugaaagguugucugugucaaaauaguuuugcuuugaaguaauaagaggcaauaauggaaaaagaauaguugcagauucuccccucacuccuuguuuuaaucuuuuuuuuuuuuuuggagacagagucucguucugucccccaggcuggagugcaguggcgagaucucggcucacugcaaccuccgccucccagguucuagagauucuucuaccucagccucccaaguagcugggauuacaggcacgcgccaccaugcccggcuaauuuuuguauauuuaguagaggcgggguuucaccauguuggcuaggcuggucucgaacuccugaccucaaaugacccacccaccucgaccucccaaagugcugggauuacaggcguaagccaccgugcccggccuuguuuuaaucuuuauugaaguauaauagacaugugauaaacagcacauauuuaaagugcacaauuuguuaagguuugaccuauaugcacacacacauacacacacacacaugcacacacacacacccauuaaaccaucaccacaaucaagaugaacauauaugucacuccccccacauucccucaauuccccuuuaaaaucccucccucccuuuccuggcuucccugccaaacaccagacaacuacugaucugcuuucuccuacuguagacaaguuugcauuuuauagaauuuaacacgaauggaaucaugcaguauauacugcuuauucuggccucuuugacgcagcauaauuauuuugagauacauucauguggauuguguauaacaguaguucauuucuuuuuauuacuuuuuaagaaaagagaacgcugcuuuuuuuacucugaacuugggccaggaugauugaaguuaccuacgaauuguacauuaaccaacuaauggcagugaagaguuaaucuguaacuucaucuguuagcuguuaacgugacccccaaaccuaaccuccucuugacugucagauccugaucccagacacacuuucucuaaaggcuaaaacugaaguaggacuggagacuuggggagccugguauuucugagucuugguuggucccugcccaucacuggaucuugguguagcauggucucaugauagugugagaacaggguuagguaugugacugugugaccagcaguacucuguuaaaaaccuugacuuuaaauuacuucaugaaguuucagaugggggaaaaagaacccacaacccugacuuuugucagcuguccgucuuacaagucugaguuacgcagauguccuaauccuuuuagaagcaaucucaguagguuggagaauuuauuguuguuacagauacucacuuuaaaauguauuaagugaacucaauugguauauuugaaaauacuuuaauuuacccuucuuuucaagauuccaucucccuuauaagcuaccauacacuugccugcuagcagguccuuuauagucaacuucccuguaacaaaugagaguuuuuuggguauaaauguaugggguacaaguauaauuugguuacauggguauauugcauaguggaaaagucagggcuuuuaguguagccauuaccugaauuauguauauuguacccauuaaguaauuucucaucguccaccccccucccaccuccaacaaauugguuuuuaaaaaauucuuuccuuaaaugcuuggcuucaaauuuccugguacaggaauucuguaauucugauaaaaaauugcuugaaauaauacacaaaaugucuauguguuuacuaauagauccugauuaaaguuauuauugagaaacuaacauuggaguccucuaaauucugauuucccagaaaacaaaaaaucuucaauauuauaaaacuuaauggacucuacagaagucggggcaggguugacaggaagcaguuggcucugauggaacacccucccccgcugccagcacacucugaccucaggaaagucaugccuccuuugcaaaucuuggacaugggacuaggugugcuuucaucccacuccaggacugagggacacuugauucagauagaccauagucaagguccauguugccuaagagacccucuuugucccccagcaugaggacugcagugacuuucaaguggcucccaggaguggagaagcaggcugcuucccuugcaugggauccauuaacucccaggcauggagaagcaggcucaguucccuacggugggcuauauuagcucccacaaauggagaagcaggcucagucucuccuugggugugcugcauugucucccaggaauagagaaguaggaucagucauuuauuccauguggggcugucuggccagaacucuucccuccaaagggagugguuuguggucccucuucuggauuuggcucaucagucuuuccaaaugucccagccaccugguagguaugcaguuugauuuguuuagcccccaaaugccagccaguuccccaugccugccugauagcugggugccucuugagccaaugucggcauauucuacaauuaccugcuuauuuguggggguuacauagugcuuguaguuauagcucucuccacuuacccacaaaccagacugccaaacuccuggaucauaaaacaaaguguaagcacccuggaucaugacccagcucuuuuccuguucuucuuuugagacuuuccuaacaggaaaggcucuggguaauugauagagauuaucccugauucccuuaauguaaccuuuuuacucuuuccuuuuccugggauuaagcuguucuuuugcaagaaguccuuuucuuaaugacagucauucaccuguuauugaccaaaggaagcgauccggcccaacuccaccuuucugugguucagucucucgagucucuuucauuauaaugacuuucaaaggcauuaacuguuuuuuuuuuuuugcuuucaauuuucugcacuguuaaaggcugucaaacuauacuuuaaucugccuuccugaaacaauaauugccccuguauuuguuggugaauaugaguguuaauauugaguagauguuuuaauauuugcugaggguucccaggcagcgugcguugcuacugaggucugcuguucacaagauaacaaguugauauaaaguggagacacauaggcucagucagcagugccuuucuucuucuugcaguccugugauauuucucuucuucagggcacuuaccucucacugugcauguagggucccuaguauaacuacuagaacaccaugagaagaggcacuagaucuuuuaggacuagguucuuuuggcauaugauuguaccuucaugguauaugcucaauaaguauuuguuaaauuaaugaauauuuugucuggaagcacauugccacaggacugggccuugguguagggauuagggaaccccuuccagaaaaaauaaaauuucagguagugacccaaaaaugucaguaaaccauagugacugcuuggaugcuguguuccagaaacuaaacugugggcaugccagcugccaccaacagaaaggguaaucacuaaauaguuguuaaguuuauacaauggccaugugaguggauaauaauacccaaccaugcaacccugugcuacuuuuuuuuuuuuuuuuuuuuuugaagacagaaucucgcucugucgcccaggcuggagugcaguggugccaucuucgcucacuacaaccuccacaucccagguucaagcaauucuccugccucagccuccugaauagcugggauuacaggugcccaccaccacaccuggcuaauuuuuguauuuuuaguagagacgggguuucaccauguuggccaggcugaucucgaacuccugaccucaagugauccacccgccucggccucccaaagugcugggauuacagaugugagccaccauacccagccucuaugccaccuuuugcuaaccucuccccuauacuuggugugucugcugccuccaccagcaccuuugauauccagcugcuggcuggccuucucuuccucuucauucuggcagcuuggccuccaugaagucuuuccugaccacaccagccuauggcacacaucacccccauccaggaugcuccauugcagaaguguauugagcauccuucaaaauaaucccacccaauuaaacucuuaauccauuuguuucccuuguuggucuaguuccauuucucuuucuuucuuuuuuuuuuuugagacggagucuugcucugucacccagccuggaauacaagcgcaugaucuaggcucacggcagccuccugaguaccugggauuacaggugcaggccaacaugcccggcuaauuuuuuguauuuuuaguagagacgggguuucaccauauuggccaggcuggucucaaacuccggaccgcaggugaucugccugccucagccucccaaagugcugggauuauaggcaugagccaccgcguccagccucuaguuccauuucuuuaaccuaguggauugcaagccccucacugcuuuccagcccgaaaggggcauugaugggauugugaacacaggacagaaaguaguauuaaugauuauuguuacaccccggaugcgugguagggaugcuugggagcaccuuuauucuccagcuagcauuagcugucgggcugaggaaggcuagcuugaugacucugccacuuuucuccuucccccuccaucaucagcaccauugugaugacuauuuauugaguaccaggacuggaacgcauuugggagaaauaaaagcauagauuugacacagccuucauucuguuagccuauggaaaggugauuauagcacuuguuacuugaauuagacccgaaaauauagcacauuuuagggucuaauucaauauaggacacucugcguuuaacuuauguuuuacagccuaacucaugacugcuauggccaauaucccuucuccacacccccagaccccaucacuaaaauuccuucuaguggcagaaccgucaccacuuaucacagauaaguggauauuaguugggcaguugacauacaaguucugugacuugguuagcucaguucagaguauguuugagggcuuacuucaagaaagcauguguuucauuuuuuaaaaauaggucuuaaaccugaaaaugguguccuugagauucucaucguucucuauuuuuauccuguuaucgcagaagacccaucuggaacuugcauuccauugcugucuccuacucaaggcagaggcuccuaugcaagacccugggacuccuguggcauggaggccaaaggccuggacccaaaagucaggaggacuucugccacaaaccccaaaagcuugccccguauaaaugguugcucuugugcccauggcuguguccacccagcauuuuugugccugcuggguuccaggugccaugccaagaccuggugaccagaggaugucugugaucauuguuguuuggaggcuuuugauugugagggacccagacuucugcuuuggggguaucuuuccccagacaucacaaaaagcucaauuguuuauugccucgaagacacauuuucucuucaacaagcgcuuuccuuaagucugagguagaguagcauaaguggguuucuugaaaaccagaaauguagcugagaaagcaguugggccauucuaggagggaaagaacaagggcuugaugaguuagguuaagaagcacauucccagcucaccaucucucccucucuuaccuccuuagcaucuuggucugugguuacgcaucuuggcugcaccuaagaguuggccugaggagcuuucaaaccuacaaaggcuagaucuaccuccagcccgguucccauuagucaaucuccaggaaggagucuaccccucuauuuuuuauuuaauuuuauuuauuuauuuauuuauuuuugagaugaagucucacucuugucccccaggcuggagugcaauggcgcgaucuuggcucacugcaaccuccgccucccggguucaagugauucuccugccucagccucccgaguaguugggauuacaggugccugccaccaugcccagcuaauuuuuguauuuguaguagagacgggguuucaccauguuggccaggcuggucucgaacuccugaccucagguuaucugcccgccucggccucuugaagugcugggauuacaggcgugagccaccaugccuggcccccucuauuauuuaauaagcucccccaggcauuccgacauaccacugggcugacagccacugaccacccucugccagacucaugcugugucaucauuucuuggccuaaacugggacgucccugcauguauaugaaguguaacauggucaugucaacuuccagaagccuucaggagauagauucagugucauccccauugugcagaugaaauaaaacagaaaauucaucacaugcucacagucacagagcugggaaggugagcuaggauuucaguccaagcagugugagauacccccuuuucuuccugcucuuccacuauagcagugcuaaaaagagccuggguuggccagccuggcuuugguagggugucaucaaacugacugcacccagauaagaauaacauggcugaggggggccauguaacugcccuucucuagagaaagggauuugauucuguagcuguuauaaaugauuuugguuuaaggugaagagauaaugaaauuuucuuaaacucuacuaauacaaaaucacguaaaaggagucaauaucauaggguacacaggggaccauuuugaaacaacuuagauccuuaagaauaaaggaugaaaguuguaguguuugugaacuugcauuggcuacaauggcaaugaauauaacgccuuuggaugaaauagucuuugacuaaauaggccugaguuuuuaagcagguaacccuguacaaaaguaggaaaauguuccacccugccaccucucagggagggccagaugugaugcaaugagugugauaggcagcaaggggagaaaaaaaaucccuccuuauguugacuacaugagcugcacgacauuuguaaagggaaauuucaagagaagggagaccaaguggguuaggauaagagcuaucuggaauuuccuuguguuaccaggaaauauaauacuuacauaagcuauuaauggaauauuuggagguucagcauucacauugauauauguguacguaucuccauuacacuugauuuuagaacccccugggacaacaugaguauuucucuggccugggauuauggagagaggcuuaggucaaaugucagcucuccacuuuguggcugaguauccaugggcaaguuacguaaccuuugagccuccagcuguaaaauggggaucaacaccaccucccuugcagaguugcucugcagauucaguaucauuugaaagcacucggugccuugccuggaacauuaauagguacuuuccuuacuuucccucuuggagucucaguaccacucuaugaccaagcaggggggccgugcuuuaaggccccucuuuuaaaccuucuggccacagggugaggaguccaaggggaagccccuguccaaaccauucccagcaucccuaaacuccccuaagaugaccuuguguugguuucuagcccuuacagaccucucuucuaggaccauccuccuggaggcacagugcacuggcagcaugccccucuucccaaggauguagacacagcuuggccucaaagccuaggguguucaccugccuguguacaacccccucaaagugcaggguggaccaggggucagcugucuccacacugacaugcucuggcaaggagcuccaaggaguuggaaagcucaccuggaaccuauguuucaaguucuuaugaagguacauaugucaagauagaagaguaagaucuauuuuauuuacuaguuuguuagcccuuguccccugucccacgaauguuagaagcaagcaaaaaugcuuucauccaaauuaccuuccucuucauaaaaauaagaaaaucauguaaucaaaauaaucuucugccuucucaaugaguuuaccaccugauucagcaauuuucuaacaccuucauuugccucauuguaaguagucccagugcaugcugguuagauggccucugggucuacaucaguccaacugaaucaggagaggagcuccagaaggugcacuggacagucaugccagaggccgugugcaauuuuagguuagaucagugguucucugcccuaucugaauuuuaaaauaacugcgaaacuucuaaaaaauauauugcugcugggguuuuaucuauauagaucaaaucaucucuagggguagguccugggcucgaguuuuuuuguuuuuguuuuuguguuuuuuaaucuccccaguugccuccuccgugagcgaagguugagaagcauagcugccccugugaggaacucagccuucagagagagccugcccgccgccucucauccuccagagaggcuguaggguguccagacuuugcaggcacuguuguuccucguuaagccugaugcugccaccuaauuaacacuuguuuauauuaauuaguugccauaugcauugaaggggagugguccuuuuugaaguuucuaguugcugacuauauaagauuuggccugaagugggacuucuggaaacucaaccaagauaacgacuuccagguucuuccaaaagcuuaucuuccaggcauaggcagguaaugaaacaacccaacugcgguuuuuuccauaacaucuuucaccccacaguaucgauggagcaggaggguguggacaggcuuuccuggguuuuuggugcuccuugucagguguuaaaacaaagaggaucauuguguuucuuggaacuggccuaaacgucuauguuuaagauuaagaucuagggaaaugcauuuccguuugacacccacuaguuucugauugugaaaaggguaccaaccugugcaauggcgccgcgacccggccgcggacuccagccucuaaagucggguaccuuuaauuaggagaaauuaaguggggcugcuacauauuuugagaauaaguaacacuauuuaaacuuaggcagccuuaaccacuaacuuaaccgcugaauucucgcugcuacaugucuccuaaauagaucagcauaaucuuaacuaggacuuaaaaugcaucaucuucguuccggaacucagaaccugcagccgacgggagccuuuggaggcuuaaugacuuuaauuauggcgagaaauaucuucucccgguggggaggggcgcggccgguggcgaggagggcacuuucccgggucggagaaggccggauggcagcccgccccgaaagucccggcccgcuggauuggggguucggggguggggggaacauagagaagcagggcugguggaggggaggagggacccugcagggcgguacacgacgggugggaguggggaggaggagggcuccuggcgcggggaggagccgcgggaggggggauguuggccgcagggccucggaguucugagcuguguuuguggcuucagcgcuuugaucuccugccagggaaaccuggaaggucaggccgggcugcagccaagcccuggagcgaggagccggcggguggagcuggcagcacugcgccacccacccucaccucccaaccccccaagcagugaagcccgccuggccgcccuggccucucgcccccgcuccugccgcugccccugccccugccccucuuuaccuccuguguguuggucuccuguaggccguagauuaaggggcuccaagucuugaaaguaagcuagccaaaugcccugcaaguuuggcuuaguaaaaucauguauguuguauauacuuuaaaagaaaccagauauuuuuuuaaagcugugugcgucccuuuccuccacccuccucauccccacccuaguacaaauuacccaagaaccacaggugauucccccugcugguucgugaguguuagggucuaguuugccucuccucuucuaccaccaccaccacccccguuccuggcaccaggauuuucucaccgguuacccgugugcucuuggugugugaccucauuuccuauggaaugaaaaguuucugucggaaaacagggcccuuggugaggcaggccuugggagcccccuugcccagcgagaauguccugugucaugcagugacucaugcuucagagaacagcagcugaccagaauguucaagagccuggugccuggguggucacuacuaagugaagaacucgaggaggaggaaaggaaaaagugaggaguaaggauuuaaaauccacuuaguggccuccagagggagggggauaacaggacucaaagagccugggcucucuggccugggguaggacccgccaagagggaccugugggcgucaggcguggccagucccuaggaccggcugggugcucuccaucguguuaaccgcccuuuuccccucccugaccacaggagcaggccugguggcggcaacagaaacagggcugguuccugccgcccugcauuucagcagugacguguuccaggcuccggcuuuagauggcugugucucucaagccuucaagccuaugcuuaagucucuuguuaccccaaauuagggcaccauugaguuggggauuuugaagcugugguagaauuugccaccaguucacccagagagccaaggcgccagagcuucgcaccagguggggaaagcagccaaaccugcacuuuccugggguugggccgcuguaugguguggccauauuucuccgcagguugcaggaugaacuccaucagucuuuuaggcuggaggaaaggcaaggcccccuagugauaaugggaggaggcuguaaaaauucacauacagccuguucuuguggacauggccaaggguagucaucuggccagcuuucuuuugguaaagguacuaagggaggcucccauuccugcagaauggauggaacaaacacugcaagugguugggcuuguuuucagagagcuuugauauccagagaugagcacacgcaggggcuggggccugauacagauccacaacaaggccaagccacuuuuagugccuggggucaagguuggccggaggagacacgaugucugcauucgaacugacaaccaguaaaaaggcugucaggaaaugcaacagcagaagauggcaccaguaauaagaaaccgaauccugagaaucuuaaagugcgaagaauauuauguuccaagaaaauuugguagagaacagaccuuucuaaaaagucaaagggaggagauagguggccuagagugagcugcaaucagugcuuucaguagcagggcccaugguguuugaugcuaaccccuagggcaaaagcugaucuuuuagguuaaucaacaaacauuuuuuggccauuuacccugugccaggccuuuugccggguucugggaauucagcaggaaagaagucugacacacuggcugcccuuuagugaaggaggcauuuuaaguaaacaaugacagugugaugucauaagugccacagugguggagcacagcauaaggccacugggcaccgcagccugagggaauaauaccugaacagagagagaagcaguaaaugaacccuguggcaggggguggguaaugugcuccucauuguuggucuccuguuaccccacauguggccaccauugaguuugggauuuugaagagaacuaaaagaagcucagucuaggccgggugugguggcucaggccuguaaucccagcacuuugggaggccaaggaggguggaucaccugaggccaggaguucaagaccagccuggccaacauggcgaaacccugucucuacuaaaaguagaaaaaauuagccgggcaugauggugcacaccuguaaucccaacuacucgggaggcuaaggcaggauaaucgcuugaacccaggagguggaggcugcagugagcuaagauugugccacugcacuccagcaugggcgacagagugagacuccaucucaaaaaaaaaaaaaaaaaaaaaaggcucaauauaguucaacuuaggaguuugaguguuguguucagaaacaauaagcaggaggaggucacaucuuacccuaagagcagcacagucauuggagaaggguggugcaggucagauccaugauugagaacggucccucugcuacugcauggagaccguguuggggagggggcaggggcgugcaaggugggcugggcugaggagcccccagaagagaauguuguugggacuugugagaaaucugguguccuggccaggguggcagcaguggggaugaaaaaacgauggauggauuuggaagucagaaucagcaaaauuugguaagccauugggcauaggugaaaaggcaaagggcugcaguuuugacuuugccccauggguggaggaaugggggagaugggguaccuccuugaggagggagcccagguuugggggaaguaaggauuguaugaagagcaggcccauggcaagaccccuugcaccuacauccacccgagcaagaaaugacccagaaauguccgggacagugugcugugcucugcgaauagcugcagaaguaacuuggggacccaaaauaaagcagaaugcuaaugucaaguccugagaaccaagcccugggacucuggugccauuuuggauucuccaugagcaugguuucugcccccuucggucacacuacuuauauguaagucugucagagaagaggcccaagugaacacucacuuggauaagaaggggagagaccucagugucuucaugcugcugcuugcuaagcaaggucucuucacccaggacagcagcaaguguguuaugacagacaauuccagaagguccuggauugugucuuccuugggaugccuggcacccaguuggcccucuucaguaguugucagauggaacuguauacucgaauguuuccauacugauaaccaucucauuuaaauuaugggugccauuuaguaauugguuuccagaucaaaauguaggucuucugucauauccuucagccuuccaccugugaguuaaagugauggggaguggguuaaggggaugauacuccucucaccuugacauaccaugagccauggagcagaguccucaagcgugcuccauggaagggagaguguuaacaggaguugcugcaaacaggcuuuguguucaaaaaaguuugggaugcuggguaaaauaggagccucuagcauguuagugauguauaugucagggauagcucuggaaugugcagcauuucucaaaggacaccgaccaggaaaaucauucccuuaguagaugcacuuugggaaaggcuacuauagagauaugaggcaagugaagccauguucuuaauuucuuacccauuugcccuuggaacuaaauguacaugcucuuccuuauugacucuccuggacucuucagagagggaucugccagcaccaugggcaggaugugugcuuggugaggacaggggucugugaccacgcuugcugccggcugcuguaugaguccccagggucuagaacacauaguaaccaguuaauaacuaccguggaacaacuaaauuaauacaugguuaaugcaaauagaauuugacugugaaccaugcccagggcagucugcuuuguuagaccuuuuuuuuuuuuuuuuuuuuuuaauagacacacggagucuugcuauauuggccaggcuggucucaaacuccuggccucaagugauccgcccaccucagccucccaaagugcugggauuacaggcaugagccaacgcgcucagccauguuaggcuuuauggggcauaccaauguggucgguaaggucuaccuccuggcuccugggaguuucuguuaaucuccaaggguaugccuggcacccaagcgaggccuuuauguauaggacaucuauacccuuugacucagcagaaccacucauggcuauuaaggacagaugccuccagaauaugaguacaaggauaugaauacagcacuguuuauaacagagaaaauauagaaaucugcuacgugccucuuagggagauggucauuaaaggagcucugaauaaccauacaauggaaugauauguguagcugguaagaagaaugaauauuuuuccacaucaaugcauauaaauauuguugaguaaauuguugaguuaagggggaaguagaguacagaacaguguauguccaauauguccagucuauuuauuuuaaaauuuuuuuucuuuuugagacggagucucgcucugucgcccaggcuggagugcaguggcgugaucuuggcucacugcaagcuccgccuccuggguucaagcaauucuccugccucagccuccugaguagcugggacuacaggggcacgcugccacgcccagcuaaauuuuuuuuuuuauuuuauuagaggugggauuucaccguguuaccgaggcugcucucgaacuccugaacuaaggcaauccacccuccuuggccucccaaagugcucggauuacaggugugagccacugcgcccggccuuaaacgauuuuuaacagcuggggucuauguugcccaggcuggccucaagcuccugggcucgagcgauccucccuccucagccucccaaguagcugggauuauagguacuaauccagcauauuuuaaacuacauuuuggugggcgugugucuguaacacaugcauuuuauucuugccaauauguggguuaaaaaaacaauggaggcuauaaaccacaccauuauguuaaaaugcugggauauaggggguaacagaugaguuauuuuuugcuuucaauuucugaguuauuuuaaauuguucauaucaugcacauauuacccuuauaaauagcaaaaacucuaaagaugaucguauuuucagggaaaauguauuacagaagugguaaacaacaagagaaacccuaagauauuagagcucagagagagguaucuuaucuguccuuuggcuaaggagaagcaccauuaguuuuauggaaaagguuacacaggaacuggaccuugaaggauuaguaauguuaguauuaauaugaucaacucauuauauuugacucuaaagugucuuucugcaugugaaguaucaucaucuagagaguuacucucaaacucacuucuuucucccuuccacccagcucaucaacagaccgccuaacccagaaauuaaaucuguugacaaauuugccuguauugucugugccagucuaucuaucuugucauuuaugcagccaaguaagaauuggguggguauauaagaggagcauuaaaauuugauguggauuuuauugagauucuucauaaucuuuauauucuuuggcacagggccuaccuauguccucuggaaacuagaaaugaaaaccaguauuuauucaauguaguauuaauuauaauuuuaaaaacuggaacaacccaaauaucagaaauacauguauaguguguaggaaaaaaaaaucacagccauuuaaaauauuuacaaagaauuuuuaauaacuuagaagcuuaugauaaagaaaaaaagccagaaggcaaaauuguauucaguagaggcaaaaaauucuguuuggggcucccauaugucugcaacuuccuguaagagguugaagacaugucuucauauuagcgcuaacaguccagcuuccuugguuagcuuauggucaggaaugugggacaaaugagauuuuuagucaucuuuuggguuauuuccuauuaagacuguauucugucaaaguuuucccgcaauaaaggguaggcacuagggauaccacauccaagagcuugacagaggaacagguaaacaggugaaaguggaauccgugccccagagacuccagggaauagagauggcgguagguccaagccccaaaccaagucuggguauaacuacacacacuggggagaaugccagauccauuccugaguggaauuccugguaaguggugggcucuaggcuucacguuuucccacccacaaaguggugaugggacaauucucaucauaauugguacauuugcacuggaacauucuagacucaaucuuacuaguaaaagcacuuccuuaugaaagaaaaccacauaacauucacagucagggagcacuuucuuuuuaccaguaguaacccgaguaugguaccaggcaagcuugcuuucacuuauaauaaacauuuauugaauaaccauaggagugguaagugccaaccacaauagggcccugucuucuagaggcuggaauuuuguacuuugcaaauguauuuuaagggcgcaaguguuugcucuuuugcuacuugucucaauggccacagacauuaucuagucucgaguccagcagcccugggaagguaaauaaaaggaccguggcaaucuuucauucagcacucugcacuggguuucuggucaccugcuggcuggugccaaccugcccuggccugagcaaggauggaaguagcaaaggugaugaaggaugugaagauacccuuguggguggggaugaggggaagggcacauagagggcagcaagacaaggccuuuggcugcuucugggaggccuugccaaaacuucccaccuguguucugcagucacacccuucuguuaaucuugcacuccaggcugugcacaguuuagggauaacggcccucuccagcuacagcccaguuuaccagugacuuucauccaaccauauccaccaggcugcaucuuucccauccuuucuuugaaagggccccagcuucagaguuuuggacguuaaguaugugacuuaaagauccuaaagauaggauuucugguggccacaagacugugaacuccuaauuagggucuagguuuguuuugaaauaauauucuggucuacacuugaguaauuaaaauggugaaugaucugugagagugauugguucaaggaauaugccucaucaauuuuuaaacugaaaauaagggcagggggcaaagaaugaccaaguaauguucuguugcuuuuuuuuuuuuuuuuaagacagggucucgcccugucgcccaggcuggagugcaguggcacaaucauggcucacuacagcuucaaccuccugggcucaagcagucuaccucagccucccgaggagcugggacuacaggugaaugccaccaugccugccuaguuuuuaacuuuuuuguggagacagucuugcuauauugcccaggcuagucuugaacuccuggcuucaagcaguccuccugccucaaccuccgaaagugcugagauuacaggcaugagccacugcaccuggccuguauuuuuuuaauuuccuuucagaacaguauaauaaaagugucuuuuucuaaauauggguuauucauggccuauuuuaaauccuaagcuggcuucugacaggcaaguucccuuuaggaucuuagcuuggcuccccuccuguccaguccuggugugugcaggaaauacaaacugauuuuaauaguaguuuacauuaaauauuauuuuaaaaguagaucaccugugcgaaugaaguauuuuucucaaacaagguauguccuuagauccugugccuuugccugguuguauuggaagucaagcuguaaauggaauuuaagcaccauauauauauauauagagagagagagagagacagauucaaaccccugggcucaagugauacucccgccucagccucccaaguagcugggauuacaggcccgugcaacuacaaccagcugccuuauuacugaccugcccucuucacuguaaaaaccaggaaacauaucaccauguccuagauuuugugaaaaacgucuuuugugucucucaaauggaucaugcuucauccggaaccucugaguccuugagaccuccacguuccgggcggagcagggaagccugaacuuuaagaaggccacguggcuaaauggcuucccugaggcaugucucuccugggaaggcauucccuaccccagauccugcagccuuucauccugaggccauuagacucuccaggugcaccugcaucaaagcgcacagguaccgcgcuccugaucuggacuuaucugaauuguaccuuccccgagggugcuguuugaugugcuugauuguggaaugaaagccaaauaaaggaaugagaggggcuguuuauuuccucauuuuuagugcuuuuccucagggcccuucuaugucuggagaaggaauuuaugaaaaagccuaggauaccaccuaagcggaaaacaccagcaucuacuuacaauuauauuaacucuggcauccaugagcuguuggccucuggcagaggagucugugucccuaaagagcucuauggauagccaguaugguggcucaugccugugaucucagcacuuugggaggccggaaugggaggaucacuugagcccaggagcucaagaccaaccugggcaacauagugagaccucgucucuaccaaaaaaaaaaaaaaaaaaaaaaaaauuagccuggcaugguagcaggcaccugcagucccagcuacucaggaggcugaggcaggaggaucauucgaggccaggaguuugaggcugcagugagcuaugauugcaccacuccagcccaggugacagagugaaagcccaucucugauagauagaaagauagauagcucuaugguggaggaaagugaugccacucucgccucacacuuuuucagcugugucaucagcauccucucuuccuggaggagggugacagggccaguguaguucugaguugcucugauagccugcugcuucucauuugagugaccaaggcugggaauuuagaagggacucuagucauaauaacauaggcggccucccugcacccccucccccuuuuuuuuuuugaggcagagucucacucugucgcccaggcuggagugccguggugcgaucucggcucauuacaaccuccgccucccaggcucaagugauucuccugccucagccucccgaguaacugggaguacaagcacaugccaccacauccagcugauuuuuugcauuuuuaguagagauaggcuuucaccauguuggccagacuggucuggaacuccugaccucaggugaucuacccgccuaagccucucagaaugcugggauuacaggcauaagccaccaugcccagccaucccccaccgccuuuuuuuuuuuuaacagauggggaaacugaggcugaggcugaaagcaauugagugacuuguccacuguuggcagcaugccaguggcagaggcaggaauagcucccaggauucauuccugacuccuagccuagcaaucuggugaugaaacagggugugguggacaaucggcagagacuuucaaugcauugaaucuccauucaaaaagaaaggguccccugcaagacaaagacagauuguccagagugccagaacuucuuaaacugccaaggaacuugcaguauacugaagauuuuacugaaguuguuuuugguacuguuuggugcuaaauacaaggaauugguuuguuguaaaagcuauagggugagacugcccucuagugggccaguggagcuauuggucuagcuguguucugggcaacuuugcuuucucacgccacaucaauguagagcgauuauuccuacggaaaggaauuucaauuuuauucuuucucaagcacuguggcccauaguaacucuguugaucucuaagcacuagccaucauuugcgcgucuuauagaaggcuggguuugccuucuauacauacacacauuagaagugucuuacuucccuaacaagauucaggcuccuaaaagccaggacaugcauguauguauguauguauauauuuuguggagacagggucuugcucugucacucaggcuagaaugaaguggugcaaucacaacccaaccucuaccucuugggcucaaucaaaccuccuaccucagccucccgaguagcugagacuacaguuacguccugccacacccagcuaauuuuucuguuauuuuuuagauaauggggucuugcuauguuaccuagacuggucucgaacuccagccaugcuauaucuuaagucuuguuuuuccacagcuucugccuugcuguccccuuagcuggacauggaauuagaagguucuuugggauggaaaggaauccuucccccaccucccccaaaaagaaucccgucacuucucauuuguuccuaaaacauucuaaucucaucccucugaucaguaguuccccaaguaguugaaucaucugaaucccccagaaagcauacacaacucaguuuccugggccugacuccagcccugcucaaucagucucugugguuugagccaggaaaccugcuuuacaaacuucccaaguggcuuuugauguguagccaggucuggcagccaacugcuucaaaaccccauuuacaauuauuuuucacagcucccaccaccgacagugucuccagaggucuucagcuugugucacuuauuaaaauuaaccauuuugagacucauucagaaauacucaauauauucuucuaacugggugacaugggaaggaaaaaggaaccgcaugagauggaccaaaggcacuugcuuugguugccaauggcucugaaacaggaaauacugaaaccaauaccucuguacugacugggcagguuguugauguguagguuguuuucaguauuugggcuggauaggaagacaaaaguuuguuaaguuaucaauuauguauuuuccccuauuauaagucaucugaccucaugauuaccauacaagguaggugaaauuguccucuuuaaaaaaaaguuuucuaauugacagauaauaauuguacauauucgugggguacauagcaauauuucaauacauacaagguauagugaucagaucaggguaauucgcauauccauuaucucaaacauuuaucacuucuuuguguugggaauguccuucuccuagcuauuugaaacuauauguuauuguuaacucuagucaucaguccccuucuuuauagaugggaaaauugaggauuaggaaagugaaguaacaucccugaagucaccuaaguugguaacugucagauucugcauuugauuacaggccugauugccaaggccaacuuugaaaagguaagaggaccagagggccaaccugcuguuuuuuuaacucuggcaggccaagcgagcaguacagcggggagcuacugcagucaucuuugaugugucugaaaacccagaagcuauugaucagguaagcuccucaggccaugccaacacugcagccucccugagaaaggcacuuccuuuagugagcuuggcuugucccggucaugucacccucaucucagagcauuugcucuugucuucugaaguuagguguccauguuuggacauaauucccaaaggagguauacugggcgagguuaagagccagggaauuggggcacagggggcauuuucucuuuuuuucccccgagauggagucuugcucugucacccaggcuggagugcaguggcgcaauuucagcucacugcaaucuccaccucccggguucaagcgauucuccugccucagccucccaaguaucuggaauuauaggcacgagccaccacgccuggcuaauuuuuguguuuuuaguagagaugggguuucaccauguuggccaggcuggucuugaacucuugaccuugugauccaucugccucggccucccaaagugcugggauuauaggcgugagccacugcaccggguucagggggcauuuucuaagaccuuucugggccuucugcuugcccaguccaucccaaaacaagcgucauucucagccuugcucuucugggagcuccaaggcuguaauguuggaagagcuggaggauuccagacagguauucaguguuccuucccuccagccuuucuuucucucuacugcuucuuaaaguaagcgcaccuuuuaaccagagcccucucuucuuccuuagcugaaccagggcucugaagacccgcucaagaggccggugguguaugugaagggugcagaugccauuaagcugaugaacaucgucaacaagcagaaaguggcucgagcaaggauccagcaccgcccuccucgagugagccuccgcaccauuuggcacaggcucggggccuucucugcuacuaccugucccuuuauuucccuugggcuuucauuccuaucucugucugaaaugcuggcauaccccagguuccugcaggcuuagaucagcuauuggacucaaggccagggugaaauuuuacucauguuccuuuauagugaauuugagaaauccuaccagaaauagauacuuuugugcuaagaugucucuggccucuuccaccuggcauucccucuuggccaucucucauccuuucuuuuccaucccaucucccucugaaaggcaaacugaggaggauugaagggauggggcauccagcaccuggcuucccguggcuuccuucuucuaucuggcuuagacacuagaaaaaaaggcuuguauuuccuucuuccuguagaguagauuaccuuauugaaacuccccaaguuaauuugagucuggaaaaguuagcuuucaacugggauugaguucgacggcuaaaugaauagcaucugcaucucuuaaguauguagaagagacacuacuggccacuaacucuuaaccagccucuucugcucaaaccucaagcugaagaauuccaggaaccuugggcuggugcccuauauugguguuauuuccuccucacaaauauugggacauucacaguguaggaugauucuuucccauacacaacauagccgguuacaugcagcuuccacuuugcaaagcucuauucccauuggccaaauggaggucccagauaagguggcugugagguuuuaggaggcagugaggaaaagguaagaacuaaaacuagagggaguuugcugaacugacuuguuggcuucuuuuuaaagggaaaaaaaaaagcgcuuugguaaauaugacucauuguaguggaagcugauauuuguggaagcagcauacaauuuucugaguuguuguaaaccauuaauuauacgguuaguaaucacuguucccucaaaacaugacacucacucuuuuguccuauaaaugugauuauuuguguugauuuggaagggccuuucuuaccaguuacagccaacuuugcaguauuccacaggcuuuaccaacagaguucccuuggcucuuggggggccuggcugagaucgccacaggcgucccccugggccacaccaaaggcacuacaugggccuagggagcacaccaugugcaugugagcagaaccccaggaguuuccugcaaauugaggggaaacucaucccggucaccccaucuuuauccugacaaagccaagauagcccaugugccgcuuaccaggcuggagagaggcugugacucacugugucuguguuccguuccagcaacccacugaauacuuugacauggggauuuuccuggcuuucuucgucguggucuccuuggucugccucauccuccuugucaaaaucaagcugaagcagcgacgcagucagguagugccucuguguguagcccgugagcaguaaccccucuugccgugacacuggggaaaaccaggacucucgucaccuuauuuuuugauggugcaacauggagccucacagcuguggacucugagcucugcagccuguucccaguggccuagaaacugcaaagauggaaaaaaaauaagagcaaacuaggccaggcaccaugacucacgcuuguaaucccagcacuuugggaggccgaggcaggcagaucacuugagcucacgaguucaagaccagccuagucaacauggcaaaaccccgucucuaccaaaaauacaaaaauuagcugggcaugguggcauguacguguagucccagcuacucgggaggcugaggugggaggaucacuugagccuagagggcagagguugcaaugagcuaugaucacaccacugcauuccagccuggguaacagaguaagacccugucucacaaaaaaaaaaaaaaaaaaaagaucaaaacuuacagcccagugccuucucuguucuaaaagggcuaguccuacaaagguuaagcauugggaauaucuccagcagguguuucgaaggaaguguuuauuuuauuuuuuuauuucuuugagacaagaucucauucugucacccaggcuggagugcaauggcaugaucucggcucacugcaaccuccaccucccggggucaacugagucucaugccuuagccucccaaguagcuggaauuacaggcacccggcuaauuuuuguauuuuuaauagagacgggguuuuaccauguuggccagccuggucucaaacuccuaaccucaugugauccgcccgccucggccucccaaaaugcugggauuacaggcgugagccaccacgcccgucccaaaggaaguguuuaagucaacguuaauaaguauuauaaacacuccacaggucuagaauaugugcuguagcagucugaguuuugagugcuuucucugaagucuauucuggcaugauugagaaguguuugccugucccaguacaucaaguggcgcccuagagccuugguccucagauagaaucugugguccagcagcaacggcagcaccuggaagccugauagaaaugcagggucucaggcuccgcuccaggccaccuacacaguauaccaggcucucugggugaugcuugauuaacaguagcugcuguagcacugcagccacaucacuuugugcuugcaggaaggagaaacucggguaggggguggugagaggauaagcagagaucuggacccccaaauguauggcagggucaugucucaggggagagaugguggaucuuggaaggcaaucuguagagaagagaaucaccaaaguucucuugaggguugagcgaccacccccaacaagaugauggcuuguguuuuuugagcacagccuauuugccaggugcuaagcacuuacacauugucuauuuacugucaccaccuccuucaacagaaagaggaggaacgcuuggcguagaacagguugauaacucggggucuggcagaguuaggaggcagcagguccaaguaauuggaggagaccccugccuucaaaucagagagaccccugcuagucuugccacuuaggaaaagccuagguugaugucguggacaccccacgcgucuggagaauaugugcuauggcagucugaguucugagcgacuucucagaagucuguuccggcaugauagagaauugucugccugucccagugaaucgugugucaugucccuggggugacugccacuuucauacguacuggacccucacacagacuacauucugcccugcagaauuccaugaacaggcuggcugugcaggcucuagagaagauggaaaccagaaaguucaacuccaagagcaaggggcgccgggaggggagcuguggggcccuggacacacucagcagcagcuccacguccgacugugccaucugucuggagaaguacauugauggagagguaauggcagaagcaggcccguccuggguggggaaaacauaggcaggucagcagaggugcccaagaccuagaaggacagggcccuguguuccaucacacacaucaacuuuuagagucacucuucugaaaauucugagacuugacuugauacuuagcuggguguuuuuacuuacaaagagacaagggauuuuauaucccucacuuuuuuuucuuguagcucuuugaaaauuuuaggccuaguaccaugccuguaguccuagcuacuugggaggcugagguggaaggaucacuugaggcuaggaacuugaggcugcagugagcuauuauuacaccgcugcauaucagccuggacaacagagugagacuuugucugucuuagaaaauuucagaccuucagaaaagacuaguaccauagacgauauaugucaggggccuagaaucauccaugaugaacauuuugccacauuugcucacucucccucucucuagacagaugcauacauacacauauuugcggggcagggagcaaaccacuugagaauuacagacauuugaugcgccuuuguugaaaauguuccacugcugcagagacuguuggauggaaauggaauuuuugcagaauagaauaguagauucuuacacagacucuggguucuaauccugaccuggguggauucuagcuuugugaucuugggcaagugacuucguuuucuugugacaugggccugacacugaccagcauuccaggugaucaugaagguuccaugagaagauccaggguagacccuuugucauucugucaggcacaguguuaggugugagcuggaauauuacuguacuagacaggucagaaaauugaaagacaaaguaaaaugagcaaaucuggaagaugcuuaggcuuaggaacucuggaggugguucugucccaauaacucuaucugucuagauaggcugcuuuucuuauaaaccacacaccccauggugagguucaggauccaguaaaggaggggauagcagagcuuuaccccuuugcugccacaccugucaaucaugagucccagguaucuuccuuucuacucaugccuauuugggauacccagggacagccagcaccucagagaugcagaauaucuugggguauaccuggcccucucuccauaccccuaagccucccauccucacuagcaggaggacucggcccucccuggguggaggcaugaguguguuugcccuccuccagcuacgggaaagacgccugccucugugcgugcccacucccuuaacacugaggacuguggauggggcugacugcuggcaguuuccuucuuccuagaacacaugggugggcccugcuucuagggaauugagcccuaauuggagguggggaggagaguagggaagggcacgggcaugcugugcagaacuccuuggucuaugcuggacucugcaggaggacacaccugcgaggcugaaggcagacuuguguccccucucucccugcccaggagcugcgggucauccccuguacucaccgguuucacaggaagugcguggaccccuggcugcugcagcaccacaccugcccccacugucggcacaacaucauagguaacugucacccgccuuagccauugcugaagagucaagugccuagcuagagugugacacacaccgcaggcuugggaacacucagaaccaccguggcacugcccucuggacuuggaggccuggcagcccuggguuuuggagguugucugcacgacccuuaggagagcuuggcauuaagaaucacccugaguucaaguuugggcuucacauuaagcagcuucuugaccucgggcaagacaucuggccucuccuaggccugaggccccuaaucucuuuaguggcaaugacaguaaugguguuugcccacacccaguaccauggggguguuccuaggaccacgagagacgaugagugugcagaggccagcuugggcuguugcuccugcaucacugugucauuaaacagggauggagggacacuggcaucuuugaauccgauucuuuucugcagacuucuguggugcccugucaggcagagcaguggggaguugggagcggggcccuuacaggagaugggccauuucacacagacaggcaggucagccucugccgcugcagcucaguuugggggcaggguugugagaauggguaccuuggcaggugaccaagccugcugcuucagccuuugcccguuuuaaaaaucccuuuagccucugacaccaguaugcucagcccugccuacucuguuuccuccacuugucuccagaacaaaagggaaacccaagcgcgguguguguggagaccagcaaccucucacguggucggcagcagagggugacccugccggugcauuaccccggccgcgugcacaggaccaacgccaucccagccuacccuacgaggacaagcauggacucccacggcaaccccgucaccuugcugaccauggaccggcacggggagcagagccucuauuccccgcagacccccgccuacauccgcagcuacccaccccuccaccuggaccacagccuggccgcucaccgcugcggccuggagcaccgggccuacuccccagcccaccccuuccgcaggcccaaguugaguggccgcagcuucuccaaggcagcuugcuucucccaguaugagaccauguaccagcacuacuacuuccagggccucagcuacccggagcaggaggggcaguccccaccuagccucgcaccccggggcccggcccgugccuuuccuccgagcggcaguggcagccugcucuuccccaccguggugcacguggccccgcccucccaccuggagagcggcagcacguccagcuucagcugcuaucacggccaccgcucggugugcaguggcuaccuggccgacugcccaggcagcgacagcagcagcagcagcagcuccggccagugccacuguuccuccagugacucugugguagacugcacugaggucagcaaccagggcguguacgggagcugcuccaccuuccgcagcucccucagcagcgacuaugaccccuucaucuaccgcagccggagccccugucgugccagugaggcggggggcucgggcagcucgggccggggaccugcccugugcuucgagggcuccccgccucccgaggagcucccggcggugcacagucauggugcugggcggggcgagccuuggccgggcccugccucucccucgggggaucagguguccaccugcagccuggagaugaacuacagcagcaacuccucccuggagcacagggggcccaauagcucuaccucagaaguggggcucgaggcuucuccuggggccgccccugaccucaggaggaccuggaaggggggccacgaguugccgucgugugccugcugcugcgagccccagcccuccccagccgggccuagcgccggagcagcuggcagcagcaccuuguuccuggggccccaccucuacgagggcucuggcccggcggguggggagccccagucaggaagcucccagggcuuguacggccuucaccccgaccauuugcccaggacagauggggugaaauacgagggucugcccugcugcuucuaugaagagaagcagguggcccgcgggggcggagggggcagcggcugcuacacugaggacuacucggugagugugcaguacacgcucaccgaggaaccaccgcccggcugcuaccccggggcccgggaccugagccagcgcauccccaucauuccagaggauguggacugugaucugggccugcccucggacugccaagggacccacagccucggcuccuggggugggacgcgaggcccggauaccccacggccccacaggggccugggagcaacccgggaagaggagcgggcucugugcugccaggcuagggcccuacugcggccuggcugcccuccggaggaggcgggugcugucagggccaacuucccuagugcccuccaggacacucaggaguccagcaccacugccacugaggcugcaggugagagcaggaaauggcaguaggucagagcaggaguuuccaucagggucgucuugucuucugucuuaggcauuuucugaaugacuucuuuuguguccuugguuuuaaacaccaucugaggcugaagacuuccaaggguuacuccucagccuggcccucccuuggaguucagacccauugagcccucugcuuccaugaucucgggaucucuccccaagaugccugcagccugucauguccacagcaguacucauuucccccucugcccugcuccccauccgcaugcucacaccaaaaaccuagcaccagcuggggguaguggcucaugccucuaaucuuggcucacccaaccacuuugggaggccgaggcuguggaucacuugaggccaggaguuggagacagccuggccaacauggcaaaaccauggagucgguucaugacuccucauggcugggauauuauguaggagccacuucauaaacauucucguuacucaguacaaaaguuagccaggggugguggcgggugccuguagucccagcuacucaggaugcugaggcaggaaaaucacuugaaccugguuggcagagguugcagugagccaagaucaagcuacugcacuccagccugggugacagagcgagacucugucuuaaaaaaaaaaaaaaaaaaaaaggcaggacccaguggcucaugccuguaaucccugcacuuugggagggcaaggcgugugaaucacuugaguucaggaguucgagaccagcuuggccaauauggugaaaccccaucucuacuaaaauacaaaaaaauuagcugggcguagcgggcaccuguaauccuagcuacuccggaggcugaggcaggagaaucgccugaaccugggaggcggagguugcagugagccgcgcuccagccugagcgacuccaucucaaaaaaaaaaaaaaaaaaaccuaggccccaucccugugcccacccugccccuugcacuucagccuccugggcuucucaacccgccugugaaggaccccaguugcuuguuuuugccucaguccaugaaaaugaauucccagaaaaugaaacuuagcaaaagacauguaagauacaaguccagguauuuuauuauuagauucaacagacaucagauugcuacaagauuuccaaacaugcugucucaguaauaaacuggagucuagcaccucugaguagcacugcaacaagaucuaccugcaaaguacaucccaaauguaucuacuucucugcacucccacugcuauccccucaguccagucucauuuuccucucuucgggacagaggcaauaaccucugacugaucugcugucacuggucuugccuucuauuccacuuggaaccagaguggccuuuuuugaaacauaaguugaugucuuugugcuagaaaacccuucaaugacuugccauuaccuuuaaaaucuuaaaaauguuggccgggugcggugauucacgccuguaaucccagcacuuugggaggccaaggcaggcagaucaccagguaaagagaccgaggccauccuggccaacauggcgaaaccccgucucuaauaaaaauaugaaaauuagccgggcgugguggcgugugccuguaguucuaccuacucgggaggcugaggcaggagaaucgcuugaacccgggacgccguuguugcagugagcugagaucgccccaucguacuccagccuggcgacagagcgagacuccgucucaaaaaaaaaaaaaaaaaguuaacuccuggcugagugcuuuggaaggccaaggcaggaggaucacuugaggccaggagcuggagaccagccuggggaacauagaaugacccuaucucuuaaaaaaaaauuuaaaaaaaaauuuuuuuuuaauuagcugggcacggugacacaugccauuagucccagauacccaggaggcugagcccaagagauugaggcuguagucaugaucucaccacugcacuucagccuaggcaacacagcaagacccugucucaaaaauaauaauaaauguuagcaucucacucaguucugugugauccagcuccugccaacccaucugaugagcuccugguucacucuccuugcuuccugcuuucaccuccuguggccccugucccguucuucccaugugccaagcucauuccagcccccagaccuguccgcuacuuuucuccuccagaucuuagguuagguaacacuccagcccccucugagaucaccuacacaccuucuguucacuucugucauccuauugcuaaauuacuuugucucaagguucguaaucucugugagggaguccucucugcugcuuuucccaaggccugacgcacaccgggcacccaguuaacaucuuuaauauauugggcuuucgugcuaccugagggcuucuagaaagcucucuacauccaagugagaggcuggcucuccaggagguaccugugcucucagcacaaauggagccccucugggaacaggaaccugcuucagcccuuuagcauacacaggccugccacaugcuggggacagggccaccugagucccuugccuggucccauguguggugccagcucccuccccugaugauuguucucucucuuucccaggaccgagaucucacucagcagacagcagcagcccgggagccugagcucaggaggaacucuuaccuggaaauugggaacuguauggagacuccaaacugacuucuuucaaaaaacaaaaacaaaaaauuuuuuuagcuuugacaaacacacaaaagugguaauaaagagagcccuccuugucaacccaaaaugugagcccccuguggcaaaaccacccccuaccccauuaacaaaucaacagacaaaauucuccgaguccuuugccucuuuugauaacauguuguucuguuuuguaaagugugugugcuugggguuccgaggugugggauugaguucucugcuuuguuuuuuuuuaagauauuguauguaaauguaaaaaguuauuuaaauauauauuuuaaagaacccuaacugccaacuuuugcugaaaaagaaaaaaaaaucacugcugcauuaaaugaaccacaucauguguagauacuguugucucccugaagggagcucaggccuuugaaaagcucagggcuucaccugccuuagaaaaugaaccagaaacuugaaguaaagcuaguugauagggguacaggcucugaggagcagugcaaaacugccucuuucuuucucguggcaaaucccaauguacacgauuucaggucucagacgccaugccucuccagcccacgccuuuaggcaggugauggcagcagcuaggaauaggguguacaugauccacagcccugcggagccaggucaagccgcugcuaugaaagcuccagggugauggggacgauucugcccaguguccucagucuguccccucaggucauggucccaagugaaaugacagaguucacagcccuggucuuggcugagguccaggucauaguaagggcauguucuuggggcccucgaccugaacucugacccuccgggcagggaagaggagguuguccccuuugguuguccuggcuuuggaguccuuugcaaaaauauuuugggcccccugccacuggcugcagaaauggcucgacgggguguguggggacagacacccagaaggaauguacuuuuguggccuugguguccgauggggcugggggagagugcucuccacugacccagcagcacacccaugugcagugcgccugcaucugugugggggcagccacaccccuuggcugcugcuuccuugggcugccuuucugggggcaugugacuggaccuacgaggucugcacugagcuccauuugaaugauaccuuuccuaucccauuucccccacggaagcaccgcuucaggguuauucaguccucugccucauggcugaaauugcucaucucgucugcagaugucuacuauccugucuaccuaaugcacuauuauguauugauucuccaugagacagagagagagagagacuaucagauaguuuacacccaaaggguagguuuuuguauauuuuuccagccuuuuuuauuaaggggaaggggagaguuuaaaaacccaaaccguugugguuuuaagguguuucauuuuuaaaagggagagagaaucuauuuaaagcuauuucagaucagggauugucauccuuuuuuguccaauguauuccuuguucuuuaaaaaaauuuuuuuuagaggaaacuaauauuagucuuuguguucacuaacucuucuggucacuuguauuuauuuauucauucauucaucagauauuuguugccaucugaaagaacuggcccagugggucugaaagcucgcuugagaauaggaaacuugagaccuggcccccuguggguaggagaacaaggaccaccuggguucuccagucuugaacgagaaucucacucuuaucagaauguuuuucuuaaccucagcguaugaugaggaaauuuacuuaucucuagcuaggauuugacaaauuccaacaucaaaugaucaaaacauuugccacugaggcuucacuggugagauccguucuccguccucgggugcagucccuugggggcugcuccucggacugcgccccgcacaccuguuaucgagggugugagaagcgccuaagcuggugacaugugaucugggacgccuucauuucucgggccaggaguagcagcugcuaaggacagcagcuugcauugcgugguuuuagggaagcagggucuggcuuuuaauaugaacugcaaaaagcagcuucucacugauauuuuuuuguuguuguuucugggggguuuuuuuguuuuguuuuuaaugccuuugagugcauauuuucuuccucgucugaaaccgaacucccaaaguggcuuucuuuagcccuggcuggaaaaccaccucucaauagccuuaagcaauaaauagaugaguagagaauguggcuucaacugggcuuauuaaaguaagugugucuaguuuucacuugaacaagugauagcugcagauggcgaaagaaacccauuuaauuuuuguagcuuacaggugguagaaacaaaaaugcaauuuuaaaaccuuaaauaccaaauaccaaccauugccuuuuuuuuuuuugagauggaauuuugcucuugucacccaggcuggagugcaauggcgcgaucucaccucacugcaaccucugccucccggguccaagugauucuccugccucagccucccaaguagcugggauuacaggcaugcgccaccacacccagcuaauuuuguauuuuugguagagacaggguaucuccauguuggucaggcuggucuuggauucccgaccucaggugauccgcccaccucggccucccaaagugcugggauuacaggcgugagccaccaugccugcccagcaauaccaaccauugucuuuuaaauucguguuggcuucucagacagggagaucacuggaauaaaauaaccgauggucuuauuuugucacacguaaaucaaaagaaauguccucuuugaaguuguaagacuccaccaaugacagacacccuuuucgguggacucugagugguguguagugguuuuauagccauggaaacuaggaguaucucacuuuccacugagaaccccugcccccaaucccucuaaguugggguguggcaguugggcagggucaagugacccagcccuggcuguaggacagccauauacagugaagaguucuagaaccagcuaaaaauggaaguuuggguguuuaccaacaagguaccucuuuauggaugcagccccaguaagcuggcuuuaacucucagcuccuucccugucuccuccuaauccaagcccuuuuauaaaauaaagccccuucugucccacugcucacauacuuaugugcugcuagucucuacucgaaguucgugcaggacuaaugcuuuuaaaaugaggucuaaaaaauaauuacuagucgagacuauuauucuuuaaacagaacugccuuuuucuacucuuuauguaaacucuuucuauuguguuggucuaacaaggcacuauuuuaaaauuuuuuaauuuuucccauagcacuuaaaagagauuuuguaaagaccuugcuguaaagauuuuguaauaaaauggucuaagggcucuuuuuccaacauuaccauuuuuaaaaaauguuuuaaaagcuagaagacaacuuauguauauucuguauauguauagcagcacauuucauuuauggaaauauguucucagaauauuuauuuacuaauauauuuaucuuaagccaugucuuauguugagagugugacauuguuggaauaaucauugaaaaugacuaacacaagacccuguaaauacaugauaauugcacacagauuuuacauauuugcagaccaaaaaugauuuaaaacaaguuguagucuucuaugguuuuguaacaaauuguacacaugacuguaaaaaaaaaauacaauuuuaucaaguauguguuauauguugucauuggucuguucaguaaaagucugcagauucaacaaggggagguuugcauggggcaguacuuuuaacuucuacucguccauggaagcauucauauaacuuucucuccuguuaauauagaguccagguuauuggggguuuaggcagugucacaggagagcaucuguuauaagguguguggguuuacauccuugugagaaugguaggcuuucugcucagcccuauguagaaggagcuagggaaagugauagugauugagccuagggguccacuuuuuauuuuuuauuuauauuuauuuauuuauuuauuuauuuuugagacagagucucacucugucgcccaggcuggagugcagcggcgcaaucucggcucacugcaaacuccgccucccagguucaagccauucuccugccucagccuccugaguagcugggacuacaggugcuccccaccacgcccggcuaauuuuuuuuuuuuuuuuuuguauuuuuaguagagacgggguuucaccauguuagccaggauggucucgaucuccugaccucaugaucugcccaccuuggccucccaaagugcugggauuacaggcaugagccaccgcgcccggccauccacuuuauaaaaauaaggaaccauauggccaggcgugggagcucauaccuauaaucccagcuauucaggagguugagucaggaggaucuccugaggcaggaguuggagaccagccucagcaacauagugagaccccaucucucuaccgagaaaaaaaaaaagcuauacguguugggguccaaauguagucuuagcuacucaggaggcugaggcagggggauugcuugagcccaggaagucgagacugcagugagcuaugaucaugccacugcacuccagccugggcgacagagcugucucaaaagaaagaaaaggaagggaaagaaggaaggaaauagggaaccauagccugaauauaaaacaucugcuuuaucugucaggucuuuuccuaccuggaagacuaagagacucucaaggccuuggaggaaaaauauuccaagcaucuacccuucaaaauuaccuaaucaugaguggagagggacccuuggucuucagugaaucugguaccucuuuguuuccccugagagggugucgcuaauuuguaaagcacucugcgauaacacggaaggugcaaaguuguguuuauuuuucagaucucuagcagagaauacucuaaucccaugaguucuuguuccuauuuuuugcucuuuaacuugggccauuucuugaguacaggcuccucguggacaccuggcugcuuccugccagggaaccggucccucugagcaccuucagagauggcacccugacugcaaagagccucccagagcuuuuguuuaauggccuugcccagcuccaggcuguaccucuugggggucccugaaggauuccacagcauuggcuccaccacagcgugguacagagccugguaacccucuguggggagaccauggaugguuagcguguccuccgacaacugcugucucuuuuggguuucaggaagcaacacucggcccuuccaggcugcugucccacuguccugggguagcgcuuggguggcagccacauguucagcauaucuguccucaagaucuuggcggacuguuaguuuuuucuccuuugaacuuucuuuacucuagccaggaagaaagcagagaagucaaagcuaaaacuugagaggggagcucagaauaauuaucugggauuugugucccagagucuugguuacagcaacaaccaacauuugucuagcauguucuaguuuacugaauuccuuuauguacauaccacugcauguguuccccauaacccugugaggucagcaggagacaacuuuauaggcaaagaaauuggaauugguuugcccaaggccacacagcuagaagguuaauaacagcugucaucuauugaaugccacgcaagauccuaauuauuuacccucugccaggcucuguucaaaagccuuuugcauguauuauuuaacauucaugaagcccuaugagggaagggccguuaucccccauuuaauaugauaauaucaaggcacaaagaaauuaagcccgaggucguccucaauuacaguccgaguugggauuugaacccugauggccugcuggccaccacgggguaacauaccuggauuccaaucaggccuucguaggccaaguucuccauguggacgcucacaauccagauccauagcugaccacugguugugugugugugugugugugugcacaagcaugcacuacccauauccuagccuuccuucucacccuuauuuuuccuucaugucaagucugugcuuaugaaagccaccucauccuucucuagaacuaagcauaguguaaaugauaaauagcaugaccccaaaaucuggggcauucuuccacucugucaugcuacaccuccuccccacauucugucuucaacuuuaggauuuccuucacuugguauagaucuuuuuuucuuuucuuuuuuuuuuuuuuuuuuuuuuauuuuuuagacagggucuugcucuguugcccaaucaggaaugcaguagugcaaucauggcucacugcagccucaaccuccuggguucaaguaauccucccuccuuagccucccaaguagcugggaucacaggcaugugcaucaugccuggcuuuuuuuuuuuuuuuuuaguagagaugaggucucccuauguugcccaggcuggucuugaacucucugagcucaagugauccucccugcuuggccucccaaagugcugagauuauaggcgguagccgcacgccauauaaucucaaccguuaaguguucucuggcuuuaccuuuucccuccccucgccagucacauuuuccccaccacugguccucgucuaccucucugaugccuccugcaggccuccuaugcccugcuggcugcuugcucuuggaacugaugaaguuucuuuuccuggccugcuggguggcuuucaucacugaaucguccuugugcuuuaaucucuucgagaguuuuccuucuccaaacuugcaugguggugggcagcacuuauucuucaguugccgccugaguacaagcuuaaccagggagaaggaacuggcaauuaauggguuccuuacaacuucccaagaggaagugguagcuggugcuggggcauuaauguucugcuuugcacauguucuggccauccagauguuggugagagccggugaguccacauagcaguccugaagccugguauuuaauaagauggacugucggaguccauagauagggaugcuggggucucgucucacauugauugggugcuagaauuauaaggagggagaaaugaauuuuaaaaggaccguucuucagcagagaauaaaaggucuacuuugaaggcaaaauauuaacaucuuuuuauaggccauuccuuccacccaguucuuagaaauuuacuauauguccucuccuguucaccaaagccuuuuauaccaaguagggaggagauagucacuccacaagguuacaguaauauucaggcucucaaagaacauagcaugccagggcaggaagucgggggucagggaggguucacaaggaauugaagacaauuccugccugcuggaaagauacggacggcagggucacucaagacuuccauaugagcuguagacacucaaccaugcugcaacacagacaugacagccgguaaguucugccaagcccugaauacgcuuuacacuuucuuuuuuugugugugggggggacggaguuuagcucuuguugcccaggcuggagugcaauggcgugaucuuggcucacugcaaccuccgccucccgggcucaagggauucuucugccucagccuccgaaguaguugagauuacaggcaugcaccaccgcacccagcugauguuguauuuuuaguagagacaggguuucuccauguuggucaggcuggccucgaacuccccaccucagaugauccgcccgccucagccucccaaagugcugggauuaccagcaugagccaccauguucggcugaauacacuuucuaaccaacugccaugcaccaagaagagcucauucacagggaaaucaauauacucuggggaccauaaaagcaacacgaaaacauuaaugcugccggccuccauuuccugggaccaacuaagagcaacagaacaauuuggauagauuagaaucacauauuuaaagagaucuggcuuucuaagaaaugucaucuauagaaauaaaaucaccuuaccauauuucaguugccuuaaauuuuauuuucgcuagcuuaguaaggggaagaaauauguauuuucucuuuccuuuuucucucucucucuuuuuuuuuguuuuuguuuuaauauuucuagucaccugucuuucucugccuuagucacauaugggcaaauugcuguuuguuuagaugugggcucaaugcaggcagcuuugagccauuaucucuaguauuugugaugucacuuugguuugugauguggguguggguggguguuacaucaucagauuuuauaguuaaauuaugugggaagaaguucuauacgguuuugcuucuagccucagaaacuucugaaguccucauuucccccaaaauggcuuggaugaauuuugaagaucuucauguucuuaagaaguauguuuugcaggaaauguagucaaauaugcagaccagauuuggggauauggguagugagaugcaucccuacaugugcaaaagugcccuccuucauguacauaaaggaggcacuguuaaguucucagaacagcugccaagguuagggaccaggaaugaaagaacacguuccugcagaccugggcaccuuucccugcaugucucucccgggaagacuacaugguuucuggaauguggguuucuuuuacaucccauggcaaaugcaguaauuagagcuguuagcagugucaagggcuugaaaggagaacaaagccgccucuuccugggaacucuugggcaaugccucacugcuuaucaggugcucguccuguugguggguuugauucuuuuauuuguaaaaugccucaggagccucccuccugagggggaggccagugaaaugauggaaaaacagaguaugaaucuggcaggggcuccuggaaucgcauguguugccugcuugcguuuuuaaguguugucccuggagugaaucagagccugcaggcggaccgcaccacaggcugugguggaaccaccuccaggccuauggcagcuggacccacagacaguugagaggacaauugcucccuuucaguggcgagcccuggccucaccuccuaagagcugggucgauuuuagagcagggcuuuggaaaggguuugucuuugggaagaguuugcgaaugucuggagacugggcaggcaagagucuuuucaaagcuggucagucuuggaaaaauggcaccgggcuccugggcuaccuggaaauuaccaucugucuuuacucugcaaagcagggacaggagggaaaugucaagcaaaaaaaggcauaauaggaguaggucaucuguuucucuuuucuccuucuccaucuugaguuuggcuuuccugcaccucaucuuuccacacacucauccguuagauuuacucugcuaggucuuuuacucaaugacucugcuuggucuuuuacucacucugucccccaggcuggagugcaguggugcgaucucggcucacugcaaccuccgcuuccugggguucaagcaauucucgugcaucagccacccaagacgcugggauuacaggcgcggaccaccaagcccagcuaauuuuuguauuuuuaguagagaugaguuuucaccauguuggcccagcuggucucaaacuccuggccucaagugauccacccaccuuggccucccaaagugcugggauuacaggcgugagccugugcucagccucaaucuccuucuuccagcagagagcuguucacaugggcagcacuugauacauacucuucaaguucuaucaaauucugccuucucugccuucauuguaacucacuucaauugacuaugccacaacagguaacccucagccuuccuuagaacuaacccaggguacuuuguucuaagcuauuucuccuaugucaauaaaacuaauauuuauugaaugcuuccugaaggccaggcacuguucuagccacuuuauuagcaucaugucaugaaaugcuaccaaccauccuaugaguuugagcacuguucccuguuuuacagauaaagaaacugaggcacaaguugcucaaguaucaugccucaaguaaccaacaaaggcugaacccaaccaaagucuauacugcccuuguuuuuguuuuuguuuuugagacggaguuucacucuugucacccaggcuggagugcaguggcacgaucuuggcucacugcaacccccaccucccagguucaagggauucuccugccucagccucccaaguagcugggauuauaggcacgcacuaucaugccgggcuaauuuuuguauuuuuaguagagaugggguuucaccauguuggccaggcuagucucaaacucuugaccucaggugauccaccugccuuggccucccaaagugcuaggaauacaggugugaaucaccacacccagcccuacugccccuguucuuaaacacucacaguuaucaccgugaugccuggccucucuguuggucagcccauccaucuaccauacccgggcccaguucuaguccuguccuugucaugagacuuucucuaggcccaggagggaaucugccugugauggcaucccagauccaucuuucauuaggcaagugaauucauaccccugaaccuuaauuuccucagcugugaaaugggccuagucauacugccuaccuaaggguuauugugaguuugaagugggacaaugcaucugaaauacuuggcauggcuccugguguauauaguaagcacucaaugaauauuugcuuuuuuguguuuuuguuuuuguuucaagacagggucucagucugucacccaggcuggagugcaguggugugaucacggcucaugagagccucgaccuccugggcucaagcaauccucccacuuuggccucccaaguagcugggaucacaggcuuguuuuugcccagugauuuuuuuuuuuuuuuuuuuuuuuuuuuuuuuuuuuuuuuuuuuuuuguagagaugaggucucccuguguugcucagcuuagucuggaacuccuggucucaagugauccuccuuggccucccgaagugcugggacuacagcugugaaccaacacaccuaacccaugugaaaguuauuuuuuacuuauuuauuuuuuugagauggagucccaaucugucacccaggcugaagugcaauggcacauucucagcucacugcaaccuccgccuccuggguucaagcaauucuccugccucagccucccgaguagcugagauuacaggugugcaccaccacgcccggcuaauuuuuguauuuuuagcagagauggggguuucaccauguuggccaggcuggucucgaacuccugaccucgugaucuaccagccuucaccucccaaagugcugggauuucaggcgugagccacugcgccugaccaugugaauguuauuaauauuaugguccauuuacucaucugacccuuucuugagcuccuguugcucauggucuaagugauguaaugcaacauuugauaugaucuuugucucaggucauucauguacaucaaucugguuuauggccggugugguggcucgcaccuauaaucccagcacuuugggaggcugaggcagaaggaucacuugaauccaggaguucaagaugagcuugggcaacaaagcaagaccccaucucuacaaaaaagaaaaagaacaaagaaaaaaaaaucuaguguaugaggccaagcaaugagccucuuggaaguagggaaaguuucugaucugacuuggguaucagacuuucaugauccaucuucauuauauauuugucagaucgauugaccucacagaaguguugaauguagaggagcuacauccccugguuacgggaguuguucagaauauucuaugcuuuguuaaacggaaagggaagcagguagcugaagauaagauaaggaagugguuagucuuuagcagagauugucccaucaaaggcuguuuagaauuuuaaagucaggauggaaugacuacuugguccaggguacuaaaaccauggcaagaguuuccaucaugggugccagcacuugaucuggggaacucgggguugaagcaguagggcuuccauguugcugaaagaccucuuccuuaguuugauucucccaugaagcuuuuuuauucugcugagcucagucucacuaaccuuuauuuuccacccaucauuuggagcugugcuuccugacauaucuaaaccaccgcuucuauuugcaaacacaucuguccuucuuugauguuuagccaaacuuuccucacaguauuuuuagcucguauaaucuuccuucuuccuuuuuuuuuugucuuuccuuuacuacgaccuuucuucuuuuuagcuucucuuagcucuuauucuccuucugguggaucagcuaauaaagaagaaauugagucaauuucuauuaauucuugucuuccaccuuuauggcccugccccacccaugcaauucuaguggaauuuaguugcuuuuaauuuccucagauguuuuuguuuuaacacccaagcaguaaacuuccauacccaugugggaacauaucugagguucaugaugcaaaagagaaacacuuuggaugggaaagaauuggaaaagauuccugaacugugaugcaaacucggaggaccaaugauuuggaccacaugugcugaauaugcaccaaucaugggccaaguaugcaaaauaaugguguccugugugccuucccaccaguucucaccugacucccgcagaugucccacacuuccuccuuucuuucuuucuuucuuuucuuuucuuuucuuuuuuuuuuuuuuuuuuuuuuuuuuuuuuuuuuuuuuugagaugcagucucgcucugcugccaaggguggagugcaguggcacgaucuuggcucacugcaaccuccgccuccuggguucaagcaauucuccugccucagccuacugaguaacugggauuacaagcacucaccaccaugcccagcuaauuuuuguauuuuuaguagagacaggguuucaccaugucagccaggcuggucuuggacuccugaccucaggugauccaccugccucggccucccaaagugcugggauuacaggcgggagccaccgcgcccagccaacgccuccucaaugcuaacccaaacccuacugugagucuucagaggugcccaccuggaugccccacagacaacucuaacucauuauguucaagaccagagucuuucucuuccuucacccccaucagaacaagcaaaugacugccucucuugaauuucccaugacuaguugucugagccagaauccugggagacucaguaaugauacagugcagccucaaacccgaggcugaaggaaaaucgggaauacagauccuaucuucauuuaaagcugggacagucuguucauaauggauuuuuuugcauucauuuagauguuaaaaaauuauuuuaaaauauugcauuaaauacuauuuacuaaauauauuuauuaaauguauaaaauaucuauuaaauaauauuuaucuugauuacuggauuuuuuauuguguuuucuaaaaauccucuuaaacucugugccugaggcacauacuucacuugccccauuccagucccagcucuggaccacucaguaagcauuuggugacagaaaccuauuauuuuauuuuuuauuaauuauuauuauuaauuuucuuuuuucuucucuuuucuuucuuuuuugacacagacucucgcuuucucgcccaggcuagagugcagugacaugaccuuggcucacugcaacuuccaccaccaggguucaaguagcugaacccugcguuagccuuccaaguagcugggauuacaggcaugagccaccacgcccggcuaauuuuuguauuuuuagcagaacugggguuuugccauauuggccaggcuggacucgaacuccugaccucaggugaucugccagcaucggacucccaagguacugagauuacaaccaugagccaccgugcccaggcuauuauuauuaauuuuagagacagggucuggcuuucuuguugcccaggcuggguugcaguggcuguauccucguucacuguaaccucaaaauacuggguucaagagauccucccaccucagcuucccgagguacugggauuacaaaugugagccaccauaccuggccuaaugacagaauaaggaggcaucagguacaguagcaagcaucuguagccccagcuacugagucugaggugagaggauugcuggagcccaggaauucgaggcuguagugugccaugauugugaauagucacugcaauccaaucugggcaacauaucaaacauaucaaaccccgucuuuuuuuuuuuuuuuuugagacagagucucacucuugccuggguuggaggacaauggcacuaucucugcucacuacaacuucugucucccggguucaagugauucuccugccucagccucccaaguagcugacauuauaggcgcaugcccugacaccuggcuaauuuuuauuuauuuauuuauuuuuuacagaugggguuucaccauguuggccaggcuggucucgaacuccuaaccucaagugauccacccgcuucagccucccaaagugcugagauuacaggcacgagccauccugcccgggcucaagacccugucuuuaaauuucuuuuuuuuuuuuuuuugagacggagucuugcucuguugccugggcuggagugcaguagugugaucuuggcucacugcaaccucugccucucggguucacaccguucuccugccuuagccuccugaguagcugggacuacaggcaccugccaccaugcccggcuaauuuuuuguauuuuuaguagagacgggguuucaccauguuagccaggauagucucgaucuccugaccucaugaucugcccaccucggccucccaaagugcugggauuacaggcguaagccaccgugcccggcaagacccugucuuuaaaacaaaaaagacaaggagguggcucaaccugguacuuuuuuuuuuuuuuuuuuuuuuugagauggagucuuggucugucucccaggcuggagggcagugacacgaucucggcucacugcaaccucugucuccuggguucaagccauucuccugccucagucucccaaguaccugagacuacaggcgcccgccacuacaccuggcuaguuuuuguauuuuuguagagaugggguuucacuauguuggucaggcuggucuugaacuccugaccuugugauccucuugccucggccucccaaagugcugggauuacaggugugagccaccaccccuggcccagccugguacuugugaggguaagacuaggguuccacugccuggguucaaagcccagcucuaacacgaugucaccuuugggcaagucauuuaaucucucuuuguucugggguggguguggggcugguaagaaugccucccucauaaggcuacugggcggauuuugugaaaugcaaccguagacacccugcauagccuuagucaagucugcaguaaacauuugcuauugcugucauuauaaucaggcccccuccuccagggcucuuuccauaaaaugacugcccuuugagcagaaaucaucccaacuggaguuucaaagacaguugaaugacccaaacuccaacauuguaggucuccuggcuucuuggccaauccugcugcccucggaggaagaaaggggccuuacuugcacagugcaaacagacaaacggacaccaacaucuuucuggaggcccaggagcugcauucaguguccucacucuuuccaugaaauaaagcugcuaaacaccccaggcauguaaagcacugaaaugaguaucccggguugcucucugccagaagccaggaccacaaaagaccuugagcuguuaagugccaugaccuagacgugcugggcuguauuuuuagccucuugugcacuguuuccaucaccugugcugggcuuucagcuggaaaagagaagguggggguggagaagguuagagggauguuuuucacugcagccagugccaggaggagcuugcacacaaauuucugaguccuguuguacaauaggaccauuuucaugggcgugcaaccuguauaucaacauaggcccccuugcuuggaagggccccacacaugcuuuaucuuuucaucuucugcugucacugucuugaaauucuuuuuuuuuuuuuuuuuuuugagauggagucuugcucugucacucaggcuggagugcaguggcacgaucuuggcucacugcaaccuccaccucccagguucaagcaauucuccugucucagccuccugaguagcugggauuacaggcaccuaccgccaagcccggauaauuuuuuguguuuuuaguagagaugaggugucaccauguuggccaggcuggucucaaacuccugaacucaggugauccaccugccuuggccucccuaaauguugggauuacaggcgugagccacagcgccuggccugucuugaaauucuuaauaaguuuggacaaaggacauacauuuucauuucucacugugucaugccaauuauauggcugguccuaagcaguguacaugacagagagagccaauuggaggaggggcugcugccagcccaggaggggugccuucccgcagcaggcaggacagaccaaagcuacuaucacaaggcauggcugcccagacuuggccaaauaaacuuuguuuccaaccuccugggugcccuuccuauuuucuccucugaaaccugaaugagaugcagaaagaaccuugugaacugg

SEQ ID NO: 16493 - RNA, 10666 nt, Homo sapiens
cuccuccuccccggggguggggagccggcuccggaagccccggcgcccccgccccgggccccgccagcgcuuuggagacggcuauccgcgcgggagugcgccacgcggggccggagcgccuauuagccgccaggaccucggagcgccccgaccaccccugagccccucuggcuucggagccccccagcaccccuucccggguccccucgcccacccuaauccacucucccucccuuucccggauucccucgcucaccccauccucucucccgccccuuccuggauucccucacccgucucgauccccucuccgcccuuucccagagacccagagccccugaccccccgcgcccuccccggagccccccgcgcgugccgcggccauggcggccgugcgcggggcgccccugcucagcugccuccuggcguugcuggcccugugcccuggagggcgcccgcagacggugcugaccgacgacgagaucgaggaguuccucgagggcuuccugucagagcuagaaccugagccccgggaggacgacguggaggccccgccgccucccgagcccaccccgcggguccgaaaagcccaggcggggggcaagccagggaagcggccagggacggccgcagaagguaagagcccagggcagggcggggguguggggggcuggcaucucaggugggaacagggggauucgguagggucuggccacuccccagucugcuaggggaggaauggcuggcuuacuaaugcgcacgcgagcccagaugccuggagggacccugugcuaggccgaggucagcgcuggcguggaggcacauccagcacccgggcggcagggccgcuuuugggggccgguggcucuaggguuggugcugugguuguacgggucgcuuauccccauuccuccaguacgcgacagguacuaggcuugagccacaggggacugugcugugucacccccugccauacuaaugggaccacucucccuguugguggcacagcuucacgucgucccucccuccugccuuugcccuccuacuccaggaggucucacguaggugagagaguuucaggugguggugagcacagggcuucaggugguggugagcaaugggugguccuacauuaguacaggaaauuagaugaggugaugcaucacugaagcauuuaacccacggccucuugcauaaucaguugucaguaaaucuuagcuguuuucaucguggcccucuggaagguggcagagggucuugugaucccugucucccaggagauuccaaggcaccauccaacauuccugaugucagcagccccuccccugccaccccagcucuagaucuuuccuggcugcuucccacacccugggcugccugugccccuccugccucuggcucuccuuccaggcuugcucuccuggcucuggggcaccgcucuagcagcccugcguccccuggcugucugcauuugguagcuuuccuguguuucugccaaacuucccucaugcuccccaccucucaucagguucucaacagcacuugcagcuccugcuuaggguccugggaggauucccauggggaauccucacaaccagucccugcucccucucccagacucugaaaugagugugcagccacaagcucccuaccugucuuuucuguccucugugugaucccugaaccccccaggacucccuauccuuccaaucaauuccaaaccccuuacuucucgaaaggagaccacuuccucuucuuugggcuucaauacucaaccaagugucccuuuucuuugaagcuuuucuugccccguaggagaccaggggaaggucuugggcccaugucccuuccuuuguauggcaguuggcagggaugaccagaugcuccuccaggccuggauggcucagucaccucucugccccuucugugcccagaacagaauaguggaggaguggauaguaaggaaccccuauugagguuuuggcagguggggggaugagggccucccccugggaacugggaacccuacgcucagucuuuagagagguugagauugguggucacagccccagacuugcagacagaaaaucuggguccggaucccaguuugccacuugggcaaaugacuuaaccucucaguuugcugauccgcacugggaacugacaagagucccugugcccagguucugggcaucuagagaggggccucaugggggcacagagcuggcucuguucauuugacacgagucugcaucuuggacagugccuccggaaaagaccaaagacaaagggaagaaaggcaagaaagacaaaggccccaaggugcccaaggaguccuuggaggggucccccaggccgcccaagaaggggaaggagaagccacccaaggccaccaagaagcccaaggagaagccaccuaaggccaccaagaagcccaaggagaagccacccaaggccaccaagaagcccaaagagaagccacccaaggccaccaagaagcccccgucagggaagaggccccccauucuggcucccucagaaacccuggaguggccacugcccccaccccccagcccuggccccgaggagcuaccccaggagggagguuugugccgggcuccucuggggugauggggcucugacugccugcucggguggaggcagggagugggaggcagguuucuggggcccugcuuccuauagaccuucagcuccccacuggaugggaaccucacuuuugcuauaaauuucacaauuugauuggugggcucccucagugcuguagccucuuuuggguagggagagggcuuggcagccuuuugggugggaccucugucccucaggccccugcccagaugucccugggcucugagcccauggaguucccuccugccuucucccgcuggggacagcuuugugguagggccuccagcagcacaguagguuccccagaaggugggcccagcucucuggccccaugagaugccagcaggaugcugaaggccagaggagcucaggccuccuuggagugagcucggccucaggaggguguccacaggcucugugugggcucuauggguggcugguggccugaggcucccaagguggucagagcaggccucccgcccaccugcuucuggaacuccuguguugcaggggcgccccucucaaauaacuggcagaauccaggagaggagacccauguggaggcacgggagcaccagccuggugaguggccgucauccgccuggccuuggggccagcugcccuggcugguuggacugagggcuuccccagaguaggccugggugggguugucaggcagcuaccagcgcuuuccccucagagccggaggaggagaccgagcaacccacacuggacuacaaugaccagaucgagagggaggacuaugaggacugugaguaggguccugccagccccaccugggucggaccccuggccugggggaugugccaaugggcccaucccagccuugggccccacucugagccagccucccccucaguugaguacauucggcgccagaagcaacccaggccacccccaagcagaaggaggaggcccgagcgggucuggccagagcccccugaggagaaggccccggccccagccccggaggagaggauugguaggauggggggcaggagaggaggugccauggccacggcgcucuggcccccuccuaaccuccccgccuccccagagccuccugugaagccucugcugcccccgcugcccccugacuauggugaugguuacgugauccccaacuacgaugacagugaguacccagcaccccagagucugagggacauaggcaggugggggucggggcugggguguggucaggagccagcuggggcaacucacccaccuugcaaccccaccugugcccgugguuaccucgcugucccugcugucccugcgugcccaccccagccacugcccugucuccucugcccucaggcuggucuuuccuuggccgcuucccugguuccugcuuggcugugacccccacaggggugucccuaggcacacacucugcccugucacccauguggguuccagcccucccaguccugugcucuaacuggcuucccgcuggcucguggccacugccccacucucuucagggagcccgagggcuuuugccucccuguugcucaugccccugcgucccuggagcccucagguucccuuuccuccuggguggcagcccgugcaucgccauuucccugcccccagguccccaucagugccuccaaugucuccccaucucaccccccagcccgcaaccccaggcacaggugccaguugucccuccaggccuuucccaugcccugggccucgaguccuuuccccaggccagaugcuccuggaaggccgggcuggugacuucagcagggucuugcucagcugccccugagcucgggcugcuccugacuccugcaagacccucucccaacucagcugucccccaucucccguccuccuccccucuggcgcgguccuguccugcugagcuccuguggacccaggagcugaggccccgcagcagggucagggcagccucagcuggcucucccuccccauaguggacuauuacuuugggccuccuccgccccagaagcccgaugcugagcgccagacagacgaagagaaggaggagcugagugagugggaccaaggacuucccacaccaggccugcccugaaggccaccuggggccugccugauccaccccacaugguccucaaagcccagagccaggcugacuggccccuccuaccuugcaccuuccagagaaacccaaaaaggaggacagcagccccaaggaggagaccgacaagugggcaguggagaagggcaaggaccacaaagguguguggcuggggcuuggggccugggucccuguggggcagcaucuggacuccugauugccucccgggcccuuggugccauguccucccuucauugucccuagagccccgaaagggcgaggaguuggaggaggaguggacgccuacggagaaagucaguaaguggggggcacaagggggugagggugggggccacaggaugggggugcugggacaagugacuggcccaaugucacaaacaggacccagguccccggaacccuuuccuacucagauucuugggacccagaagggaggggccccgggagcccaggauagccucgcuuggcugccccagcccuggaccccaggcuggccugcuucaggaggguggcagcuccccagggccccuaguggcugggcgugguagggggaggaccuggggccuugguggggagugaggaccucagguaccuucacagguaucccugcagggccauugugcagacgguccccaucuggaugacaucuguggcugcgcccugggggagcucuaccugugauuucacguguguccccugagagcugggcauggucagcccguucuccagauggggcagcugaggcccagggaggggaagcacaggcugggauuggaaacagcuccuggccuggcuuugagucgauuccaggugggcuggugcagggcaccagggagccaccagcugaccagagcugcccucugacugugcccccgaugugccgggagugggcucugggcuccuugguucuggguuugguggagggaaggauggagcuagugagccaccauucugggguacgcguccucagaguguccccccauugggauggagucacaccguauugaggacaaccagauccgagccuccuccaugcugcgccacggccugggggcacagcgcggccggcucaacaugcaggugggcauugggaugggcccaucucccaacugggauaagggacuccuccgcccaugcucagccuccccugcccccuggacagaccggugccacugaggacgacuacuaugauggugcguggugugccgaggacgaugccaggacccaguggauagagguggacaccaggaggacuacccgguucacaggcgucaucacccagggcagagacuccagcauccagugcguggccaggcucauggauaguuggcagaggggaguggcuacauaggcauggcucugugucccauuaaggagauuccagugggcccuucuuuggcccagccaaagaaggccaaaaagaucagugagggacucacccugcccauccccacuccucagccuggucagucagccccuguguccugauagcacaugaguuuagggacagaucaccugcccauggcuaugugacgggcauaggacccaggcucaacaccugggccgugcagcaccacccugcuagcucuuaaauucuuggggcucggaagagggaggcucaggccaccugagggccugggagggggaagacccuugcucugaccacuguccacuccacagugacgauuuugugaccaccuucuucgugggcuucagcaaugacagccagacaugggugauguacaccaacggcuaugaggaaauggugggcaccaugcccaggcucuuggcucugcucccauugucugggcgaggggugggcucucagaggggcuggcaguacugcucugaggccugccucuccccagaccuuucaugggaacguggacaaggacacacccgugcugagugagcucccagagccggugguggcucguuucauccgcaucuacccacucaccuggaauggcagccugugcaugcgccuggaggugcuggggugcucuguggcccgugaguguggagggcuggcaggggcucugaguggagguggggugcuagggugggccagccggcacccagcuaaagacaaccccgccucccuugcagcugucuacagcuacuacgcacagaaugaggugguggccaccgaugaccuggauuuccggcaccacagcuacaaggacaugcgccagguugggagcauauauccuggggcugggggugggaccugucuguggcugacgggagugugugccuggugcuucugucacugggcccagucccuacugguuccagggaugcuggcugucccucaccuuaggaaggaggccaguaccugggggcugcgugaaggggucaugcccgucccucgccauagagcaggcccuggaaguggaaggggcauggucagcgggggacggauugcaugauugauuccacguccucccccucugccccagcucaugaagguggugaacgaggagugccccaccaucacccgcacuuacagccugggcaagagcucacgaggccucaagaucuaugccauggagaucucagacaacccuggggagcaugaacugggugagggucugugggggccagcagcuggccucugcugcugaugugcagagcucacugccucccgccuguuccggagccucucuggggauucuggcuugucuuacagggcccuaggagccccagcugucccccagacccucggguaugaggugggucuggguccuuccucagcugcccugggccucgggagacugagugcucacugaggcucccgcccuugcaggggagcccgaguuccgcuacacugcugggauccauggcaacgaggugcugggccgagagcuguugcugcugcucaugcaguaccugugccgagaguaccgcgaugggaacccacgugugcgcagccuggugcaggacacacgcauccaccuggugcccucacugaacccugauggcuacgagguggcagcgcagaugguggguugaagggugaggcuggccaggguccaggcagcuggggguuguggggguguggguagccgaugccuacccugcuggcuccccacagggcucagaguuugggaacugggcgcugggacuguggacugaggagggcuuugacaucuuugaagauuucccggaucucaacucugugcucuggggagcugaggagaggaaauggguccccuaccggguccccaacaauaacuugcccaucccugaacgcuaccuuucgccagaugccacggugaggcuacagccuggcugaaagggcaggagggagcagcuggacccugggguccugguguucugggcuuggggguggggcugacggugccugaacuccagacgcugaggcucuggggguugggggacaggggaucgugcgaguacuggugugaagcuucauggagggugaucgggcuagguuggggauaguggccggagcugcagcccuggccucacacgugcuggccacuccagguauccacggagguccgggccaucauugccuggauggagaagaaccccuucgugcugggagcaaaucugaacggcggcgagcggcuaguauccuaccccuacgauauggcccgcacgccuacccaggagcagcugcuggccgcagccauggcagcagcccggggggaggaugaggacgaggucuccgaggcccaggagacuccagaccacgccaucuuccgguggcuugccaucuccuucgccuccgcacaccucaccuugaccgagcccuaccgcggaggcugccaagcccaggacuacaccggcggcaugggcaucgucaacggggccaaguggaacccccggaccgggagugagucagccugggaggggcugugggcggggccugguccggagaggggcugacuuugggucuguaucuguccccggccagcuaucaaugacuucaguuaccugcauaccaacugccuggagcucuccuucuaccugggcugugacaaguucccucaugagagugagcugccccgcgagugggagaacaacaaggaggcgcugcucaccuucauggagcaggugggguggcuagggcaaugccuggggagaggaggcugcacaggcuccuggaugggcgggagggagcagcggaccacauuggaccuuccugaggaccagcagcccucaccugcuucccuaggugcaccgcggcauuaaggggguggugacggacgagcaaggcauccccauugccaacgccaccaucucugugaguggcauuaaucacggcgugaagacagguaccuagugugcacaccuuuaccccaucuuucugagggaggacccgccagagagggugggggcuugaggaacucagcgagcagguagagucuggggagccugggggcgaaauucagagagggagggcggugcugggggcgggaacucagagggggagggcggggcugggggcaggacugagugggagggugggggccugggaggggcgcucuggggcagccggaucguucucccuccgcagccagugguggugauuacuggcgaaucuugaacccgggugaguaccgcgugacagcccacgcggagggcuacaccccgagcgccaagaccugcaauguugacuaugacaucggggccacucagugcaacuucauccuggcucgcuccaacuggaagcgcauccgggagaucauggccaugaacgggaaccggccuaucccacacauagacccaucgcgcccuaugaccccccaacagcgacgccugcagcagcgacgccuacaacaccgccugcggcuucgggcacagaugcggcugcggcgccucaacgccaccaccacccuaggcccccacacugugccucccacgcugcccccugccccugccaccacccugagcacuaccauagagcccuggggccucauaccgccaaccaccgcuggcugggaggagucggagacugagaccuacacagagguggugacagaguuugggaccgagguggagcccgaguuugggaccaagguggagcccgaguuugagacccaguuggagccugaguuugagacccagcuggaacccgaguuugaggaagaggaggaggaggagaaagaggaggagauagccacuggccaggcauuccccuucacaacaguagagaccuacacagugaacuuuggggacuucugagaucagcguccuaccaagaccccagcccaacucaagcuacagcagcagcacuucccaagccugcugaccacagucacaucacccaucagcacauggaaggccccugguauggacacugaaaggaagggcugguccugccccuuugagggggugcaaacaugacugggaccuaagagccagaggcuguguagaggcuccugcuccaccugccagucucguaagagaugggguugcugcaguguuggaguaggggcagagggagggagccaaggucacuccaauaaaacaagcucauggcacggacugcucacauucugaggugucagggauggggaggagggagaccggcuggugggugcaugggcuauggucacugugggcaccccugcaggagucccauagccagagugcccagggcucaaggcucgcaucagcaagugcucaggcuuuauuuacaaugccgacacugcagggaaugaacagccuccaucugggccucucuggucaaaaccacuuuuuugagucaggggcccagccccaggccucccaggucaucguccucugccccgaagcccgagaagcugaugggcuggcaggccaggcugcgcagguucacaaggcaggcggucugcguggcacugaagucagggacagucaccaacagcacugucugguccucaggaccug

SEQ ID NO: 16494 - RNA, 10666 nt, Homo sapiens
cagguccugaggaccagacagugcuguuggugacugucccugacuucagugccacgcagaccgccugccuugugaaccugcgcagccuggccugccagcccaucagcuucucgggcuucggggcagaggacgaugaccugggaggccuggggcugggccccugacucaaaaaagugguuuugaccagagaggcccagauggaggcuguucauucccugcagugucggcauuguaaauaaagccugagcacuugcugaugcgagccuugagcccugggcacucuggcuaugggacuccugcaggggugcccacagugaccauagcccaugcacccaccagccggucucccuccuccccaucccugacaccucagaaugugagcaguccgugccaugagcuuguuuuauuggagugaccuuggcucccucccucugccccuacuccaacacugcagcaaccccaucucuuacgagacuggcagguggagcaggagccucuacacagccucuggcucuuaggucccagucauguuugcacccccucaaaggggcaggaccagcccuuccuuucaguguccauaccaggggccuuccaugugcugaugggugaugugacuguggucagcaggcuugggaagugcugcugcuguagcuugaguugggcuggggucuugguaggacgcugaucucagaaguccccaaaguucacuguguaggucucuacuguugugaaggggaaugccuggccaguggcuaucuccuccucuuucuccuccuccuccucuuccucaaacucggguuccagcugggucucaaacucaggcuccaacugggucucaaacucgggcuccaccuuggucccaaacucgggcuccaccucggucccaaacucugucaccaccucuguguaggucucagucuccgacuccucccagccagcggugguuggcgguaugaggccccagggcucuaugguagugcucagggugguggcaggggcagggggcagcgugggaggcacagugugggggccuaggguggugguggcguugaggcgccgcagccgcaucugugcccgaagccgcaggcgguguuguaggcgucgcugcugcaggcgucgcuguuggggggucauagggcgcgaugggucuaugugugggauaggccgguucccguucauggccaugaucucccggaugcgcuuccaguuggagcgagccaggaugaaguugcacugaguggccccgaugucauagucaacauugcaggucuuggcgcucgggguguagcccuccgcgugggcugucacgcgguacucacccggguucaagauucgccaguaaucaccaccacuggcugcggagggagaacgauccggcugccccagagcgccccucccaggcccccacccucccacucaguccugcccccagccccgcccucccccucugaguucccgcccccagcaccgcccucccucucugaauuucgcccccaggcuccccagacucuaccugcucgcugaguuccucaagcccccacccucucuggcggguccucccucagaaagaugggguaaaggugugcacacuagguaccugucuucacgccgugauuaaugccacucacagagaugguggcguuggcaauggggaugccuugcucguccgucaccacccccuuaaugccgcggugcaccuagggaagcaggugagggcugcugguccucaggaagguccaaugugguccgcugcucccucccgcccauccaggagccugugcagccuccucuccccaggcauugcccuagccaccccaccugcuccaugaaggugagcagcgccuccuuguuguucucccacucgcggggcagcucacucucaugagggaacuugucacagcccagguagaaggagagcuccaggcaguugguaugcagguaacugaagucauugauagcuggccggggacagauacagacccaaagucagccccucuccggaccaggccccgcccacagccccucccaggcugacucacucccgguccggggguuccacuuggccccguugacgaugcccaugccgccgguguaguccugggcuuggcagccuccgcgguagggcucggucaaggugaggugugcggaggcgaaggagauggcaagccaccggaagauggcguggucuggagucuccugggccucggagaccucguccucauccuccccccgggcugcugccauggcugcggccagcagcugcuccuggguaggcgugcgggccauaucguagggguaggauacuagccgcucgccgccguucagauuugcucccagcacgaagggguucuucuccauccaggcaaugauggcccggaccuccguggauaccuggaguggccagcacgugugaggccagggcugcagcuccggccacuauccccaaccuagcccgaucacccuccaugaagcuucacaccaguacucgcacgauccccugucccccaacccccagagccucagcgucuggaguucaggcaccgucagccccacccccaagcccagaacaccaggaccccaggguccagcugcucccuccugcccuuucagccaggcuguagccucaccguggcaucuggcgaaagguagcguucagggaugggcaaguuauuguuggggacccgguaggggacccauuuccucuccucagcuccccagagcacagaguugagauccgggaaaucuucaaagaugucaaagcccuccucaguccacagucccagcgcccaguucccaaacucugagcccuguggggagccagcaggguaggcaucggcuacccacacccccacaacccccagcugccuggacccuggccagccucacccuucaacccaccaucugcgcugccaccucguagccaucaggguucagugagggcaccagguggaugcguguguccugcaccaggcugcgcacacguggguucccaucgcgguacucucggcacagguacugcaugagcagcagcaacagcucucggcccagcaccucguugccauggaucccagcaguguagcggaacucgggcuccccugcaagggcgggagccucagugagcacucagucucccgaggcccagggcagcugaggaaggacccagacccaccucauacccgagggucugggggacagcuggggcuccuagggcccuguaagacaagccagaauccccagagaggcuccggaacaggcgggaggcagugagcucugcacaucagcagcagaggccagcugcuggcccccacagacccucacccaguucaugcuccccaggguugucugagaucuccauggcauagaucuugaggccucgugagcucuugcccaggcuguaagugcgggugaugguggggcacuccucguucaccaccuucaugagcuggggcagagggggaggacguggaaucaaucaugcaauccgucccccgcugaccaugccccuuccacuuccagggccugcucuauggcgagggacgggcaugaccccuucacgcagcccccagguacuggccuccuuccuaaggugagggacagccagcaucccuggaaccaguagggacugggcccagugacagaagcaccaggcacacacucccgucagccacagacaggucccacccccagccccaggauauaugcucccaaccuggcgcauguccuuguagcuguggugccggaaauccaggucaucgguggccaccaccucauucugugcguaguagcuguagacagcugcaagggaggcgggguugucuuuagcugggugccggcuggcccacccuagcaccccaccuccacucagagccccugccagcccuccacacucacgggccacagagcaccccagcaccuccaggcgcaugcacaggcugccauuccaggugaguggguagaugcggaugaaacgagccaccaccggcucugggagcucacucagcacggguguguccuuguccacguucccaugaaaggucuggggagaggcaggccucagagcaguacugccagccccucugagagcccaccccucgcccagacaaugggagcagagccaagagccugggcauggugcccaccauuuccucauagccguugguguacaucacccaugucuggcugucauugcugaagcccacgaagaagguggucacaaaaucgucacuguggaguggacaguggucagagcaagggucuucccccucccaggcccucagguggccugagccucccucuuccgagccccaagaauuuaagagcuagcaggguggugcugcacggcccagguguugagccuggguccuaugcccgucacauagccaugggcaggugaucugucccuaaacucaugugcuaucaggacacaggggcugacugaccaggcugaggaguggggaugggcagggugagucccucacugaucuuuuuggccuucuuuggcugggccaaagaagggcccacuggaaucuccuuaaugggacacagagccaugccuauguagccacuccccucugccaacuauccaugagccuggccacgcacuggaugcuggagucucugcccugggugaugacgccugugaaccggguaguccuccugguguccaccucuauccacuggguccuggcaucguccucggcacaccacgcaccaucauaguagucguccucaguggcaccggucuguccagggggcaggggaggcugagcaugggcggaggagucccuuaucccaguugggagaugggcccaucccaaugcccaccugcauguugagccggccgcgcugugcccccaggccguggcgcagcauggaggaggcucggaucugguuguccucaauacggugugacuccaucccaauggggggacacucugaggacgcguaccccagaaugguggcucacuagcuccauccuucccuccaccaaacccagaaccaaggagcccagagcccacucccggcacaucgggggcacagucagagggcagcucuggucagcugguggcucccuggugcccugcaccagcccaccuggaaucgacucaaagccaggccaggagcuguuuccaaucccagccugugcuuccccucccugggccucagcugccccaucuggagaacgggcugaccaugcccagcucucaggggacacacgugaaaucacagguagagcucccccagggcgcagccacagaugucauccagauggggaccgucugcacaauggcccugcagggauaccugugaagguaccugagguccucacuccccaccaaggccccagguccucccccuaccacgcccagccacuaggggcccuggggagcugccacccuccugaagcaggccagccugggguccagggcuggggcagccaagcgaggcuauccugggcucccggggccccucccuucugggucccaagaaucugaguaggaaaggguuccggggaccuggguccuguuugugacauugggccagucacuugucccagcacccccauccuguggcccccacccucacccccuugugccccccacuuacugacuuucuccguaggcguccacuccuccuccaacuccucgcccuuucggggcucuagggacaaugaagggaggacauggcaccaagggcccgggaggcaaucaggaguccagaugcugccccacagggacccaggccccaagccccagccacacaccuuugugguccuugcccuucuccacugcccacuugucggucuccuccuuggggcugcuguccuccuuuuuggguuucucuggaaggugcaagguaggaggggccagucagccuggcucugggcuuugaggaccaugugggguggaucaggcaggccccagguggccuucagggcaggccuggugugggaaguccuuggucccacucacucagcuccuccuucucuucgucugucuggcgcucagcaucgggcuucuggggcggaggaggcccaaaguaauaguccacuauggggagggagagccagcugaggcugcccugacccugcugcggggccucagcuccuggguccacaggagcucagcaggacaggaccgcgccagaggggaggaggacgggagaugggggacagcugaguugggagagggucuugcaggagucaggagcagcccgagcucaggggcagcugagcaagacccugcugaagucaccagcccggccuuccaggagcaucuggccuggggaaaggacucgaggcccagggcaugggaaaggccuggagggacaacuggcaccugugccugggguugcgggcuggggggugagauggggagacauuggaggcacugauggggaccugggggcagggaaauggcgaugcacgggcugccacccaggaggaaagggaaccugagggcuccagggacgcaggggcaugagcaacagggaggcaaaagcccucgggcucccugaagagaguggggcaguggccacgagccagcgggaagccaguuagagcacaggacugggagggcuggaacccacaugggugacagggcagagugugugccuagggacaccccugugggggucacagccaagcaggaaccagggaagcggccaaggaaagaccagccugagggcagaggagacagggcaguggcuggggugggcacgcagggacagcagggacagcgagguaaccacgggcacaggugggguugcaaggugggugaguugccccagcuggcuccugaccacaccccagccccgacccccaccugccuaugucccucagacucuggggugcuggguacucacugucaucguaguuggggaucacguaaccaucaccauagucagggggcagcgggggcagcagaggcuucacaggaggcucuggggaggcggggagguuaggagggggccagagcgccguggccauggcaccuccucuccugccccccauccuaccaauccucuccuccggggcuggggccggggccuucuccucagggggcucuggccagacccgcucgggccuccuccuucugcuuggggguggccuggguugcuucuggcgccgaauguacucaacugagggggaggcuggcucagaguggggcccaaggcugggaugggcccauuggcacaucccccaggccagggguccgacccagguggggcuggcaggacccuacucacaguccucauaguccucccucucgaucuggucauuguaguccaguguggguugcucggucuccuccuccggcucugaggggaaagcgcugguagcugccugacaaccccacccaggccuacucuggggaagcccucaguccaaccagccagggcagcuggccccaaggccaggcggaugacggccacucaccaggcuggugcucccgugccuccacaugggucuccucuccuggauucugccaguuauuugagaggggcgccccugcaacacaggaguuccagaagcaggugggcgggaggccugcucugaccaccuugggagccucaggccaccagccacccauagagcccacacagagccuguggacacccuccugaggccgagcucacuccaaggaggccugagcuccucuggccuucagcauccugcuggcaucucauggggccagagagcugggcccaccuucuggggaaccuacugugcugcuggaggcccuaccacaaagcuguccccagcgggagaaggcaggagggaacuccaugggcucagagcccagggacaucugggcaggggccugagggacagaggucccacccaaaaggcugccaagcccucucccuacccaaaagaggcuacagcacugagggagcccaccaaucaaauugugaaauuuauagcaaaagugagguucccauccaguggggagcugaaggucuauaggaagcagggccccagaaaccugccucccacucccugccuccacccgagcaggcagucagagccccaucaccccagaggagcccggcacaaaccucccuccugggguagcuccucggggccagggcuggggggugggggcaguggccacuccaggguuucugagggagccagaauggggggccucuucccugacgggggcuucuugguggccuuggguggcuucucuuugggcuucuugguggccuuggguggcuucuccuugggcuucuugguggccuuagguggcuucuccuugggcuucuugguggccuuggguggcuucuccuuccccuucuugggcggccugggggaccccuccaaggacuccuugggcaccuuggggccuuugucuuucuugccuuucuucccuuugucuuuggucuuuuccggaggcacuguccaagaugcagacucgugucaaaugaacagagccagcucugugcccccaugaggccccucucuagaugcccagaaccugggcacagggacucuugucaguucccagugcggaucagcaaacugagagguuaagucauuugcccaaguggcaaacugggauccggacccagauuuucugucugcaagucuggggcugugaccaccaaucucaaccucucuaaagacugagcguaggguucccaguucccagggggaggcccucauccccccaccugccaaaaccucaauagggguuccuuacuauccacuccuccacuauucuguucugggcacagaaggggcagagaggugacugagccauccaggccuggaggagcaucuggucaucccugccaacugccauacaaaggaagggacaugggcccaagaccuuccccuggucuccuacggggcaagaaaagcuucaaagaaaagggacacuugguugaguauugaagcccaaagaagaggaaguggucuccuuucgagaaguaagggguuuggaauugauuggaaggauagggaguccugggggguucagggaucacacagaggacagaaaagacagguagggagcuuguggcugcacacucauuucagagucugggagagggagcagggacugguugugaggauuccccaugggaauccucccaggacccuaagcaggagcugcaagugcuguugagaaccugaugagagguggggagcaugagggaaguuuggcagaaacacaggaaagcuaccaaaugcagacagccaggggacgcagggcugcuagagcggugccccagagccaggagagcaagccuggaaggagagccagaggcaggaggggcacaggcagcccagggugugggaagcagccaggaaagaucuagagcugggguggcaggggaggggcugcugacaucaggaauguuggauggugccuuggaaucuccugggagacagggaucacaagacccucugccaccuuccagagggccacgaugaaaacagcuaagauuuacugacaacugauuaugcaagaggccguggguuaaaugcuucagugaugcaucaccucaucuaauuuccuguacuaauguaggaccacccauugcucaccaccaccugaagcccugugcucaccaccaccugaaacucucucaccuacgugagaccuccuggaguaggagggcaaaggcaggagggagggacgacgugaagcugugccaccaacagggagaguggucccauuaguauggcagggggugacacagcacaguccccuguggcucaagccuaguaccugucgcguacuggaggaauggggauaagcgacccguacaaccacagcaccaacccuagagccaccggcccccaaaagcggcccugccgcccgggugcuggaugugccuccacgccagcgcugaccucggccuagcacagggucccuccaggcaucugggcucgcgugcgcauuaguaagccagccauuccuccccuagcagacuggggaguggccagacccuaccgaaucccccuguucccaccugagaugccagccccccacacccccgcccugcccugggcucuuaccuucugcggccgucccuggccgcuucccuggcuugccccccgccugggcuuuucggacccgcggggugggcucgggaggcggcggggccuccacgucguccucccggggcucagguucuagcucugacaggaagcccucgaggaacuccucgaucucgucgucggucagcaccgucugcgggcgcccuccagggcacagggccagcaacgccaggaggcagcugagcaggggcgccccgcgcacggccgccauggccgcggcacgcgcggggggcuccggggagggcgcggggggucaggggcucugggucucugggaaagggcggagaggggaucgagacgggugagggaauccaggaaggggcgggagagaggauggggugagcgagggaauccgggaaagggagggagaguggauuagggugggcgaggggacccgggaaggggugcuggggggcuccgaagccagaggggcucagggguggucggggcgcuccgagguccuggcggcuaauaggcgcuccggccccgcguggcgcacucccgcgcggauagccgucuccaaagcgcuggcggggcccggggcgggggcgccggggcuuccggagccggcuccccacccccggggaggaggag

SEQ ID NO: 16495 - RNA, 3366 nt, Homo sapiens
cacacagcacagauccaggccuggagaaaacaccaaggaggugacaggacaacgcggaugccagaccagccccuuagccuagcugacuccagcacagccugagccccugcugccugggaagaaccaggaauauuccucaaaucuacgcccuagggagcagacagaggcgagcaacucaaaacaagacaagaaggaugccagcagcagacagaaaugcaacagacuccacauccucacguaucccacucuuacucucccccagguggccuaagcacuguacauguaacucagccaacgcugaaaaugugccaggaguagauauuaucacccaacugaugcacagagagguuaagcaauguguccaagggcacacaacugggauccaaguguaugccccugagcacugggcagaaugacaucccuguaaccgauaguaggacaugcuuccacccaggcaaugugcuggcaccaagaucaaaacuggacauaaaagccaacacuugcccccacucagcccacugggucuaggcaggagaacgacaacaggccauagacaaguaacucgccacagugacaagugcugugaacaaauggugagcugagguagaaaacggaggcccucauugcaagguggcuucagguggccccucaaagaauauaacacuucagcugacaguggggcuuagauggggccaugggaagacaagggaaagagugugccaagugaagggaaaagccuacagcaggaaggucugggcagguuuggggaacaggugaguggaaagaccaauuuggagagacaggcugagcuucagugaggaugcacaggccacauggagaagccacauguagguauucagggugggggccagcaccaaccaccaggccugugagcgagugcuacugcugccccgcugcuaucaacacauucacuguggcagcuguuugguuuccugaccagucugugagcacagugaaaucgcuaucguccaucacuggggagcuuuuuugacagcuccaauaacuggaagagaaaugugcgaccagaggaggugcugccggaaagaaucuagaagguggcauugacauugggcccaaguaguaacugagcucugaaaggagccaaggaaggugucccgagggcugaaaggaaagugaggaaaagcuaccggagccgcaggagggagccccugauuaugugggagaggagaggugaacagcacuuugucucagguaaacaaaacagaaaacauccugauaugauuuggcucuguguccccacccacaucucaucuggaauuauaauccacacgguguugacggagggaccuggugggaggugacuggauuguggggguggauuucccccaugcuguucuugugauggugagugagaucaagccaucaugcgaucugaugguuuaaaaaugguuggcaguuccccuugcucucucucuccugcuaucauguaaaagagccuugcuuucccuucaccuucugccaugauuguuaaguuuccugaggccuccccagccaugaggaacugugagucaauuaaaccucuuuucuuuauaaauuacccuaucucagguaguuuuuuauagcaaugugaaaauggacuaauacauaucccuaaugaauuugagguucuagcuagauuucuaggcccaggguucuccugccugccuauaacgagaauugaucuuggcuuggcaugggaugagaugggcuucucaaagcuccccaggggauuccaaugugcaacuagggcugagauccauuuugccuggugccaaggacaguaaaaaugaguaagaccuggucucaccuacuaaauccucaguuuaaaaauauaauaggagauggauuugaaaauuaccuggaaagccacucuuauguaagugguaggaaugggggaaugcagcagcaccuaaaacucaaauaaacucaaagggggagaugggggucccugcuucaccaccaagaguaauccaacugcaggagagaucaccagggaagaaaugggggcaaagaacaaggguuguguugggcaggccacuuuauuaggaaagacagagggcccaagggacaggaaaauucauggccagcaaauaugggggccaggaggagaggcaaacagacaugagugaacagaggggguccccucgagaccagagagugcauccucaccagucuuggcuccuggugccuggcgccaggcuugccacacugaggggcucucuggcuacagcacaggcaaauaccugaauaaucugcacugaagauaggaaaaccauuuuccucugccagugaaguaaucgccaucaccgccagaacuaaguccucaucuccaaccagccucugaacuaaaacuaacuccaaacccacaaauuacuuaauuuaauccuuguuacuaucuuaagaagaaacugagggaaaaagagguuaauuuucccaagguaacaggaagugggaucaauuagauaaacuguucccauucucuugcagaacacuucuaaguucagggaugcugugggggaagcaccuucccaaacucucacuuaccccagugcugcugggcccgguucuccaggaagggucucauuuggaugaggcggguggcauaaaugugggcauacugccggcuaaagcugcgcucuccuagccggaaggguugugaggaguugguguagguugccacuggcacccgggcaaagguggcauuguuggcugaugguggggacaguagagugugggcccucugggcagccugcucagaaaacauggccacacuccugacuugcuugguccacacagcuucgcccaggccaaggagguucacugcgaaaacacaaaggcauuccugcugccccuguccaucccccaaagcagcagcucuccuggugucucacugcacccaaaggauacugggaaaagaaggagaacagcuguaguugacaccagacauuguguccacuuggaaauuuaucgugccuggauaccgaugucucacccuguagcggucauccaaaaagagaaaaggaaagcuaggaguguuugucccaucuggaguucuucccgaacccuagacucagguguccuguuccaucuggacaacuaccagggucucaaucaaguucaguuugccccaaauggaauucccgaucugccuccauccagcucuccggcaccugucucauuuccagacaagaggucugccuuauuaaauaaaacuucugugaaauaauaagccuauuauuaaauaauaauagaacuaaaccaaaaccaaaacauaaaucagucacugcucuguucaaaacucuccaaaguguccucauuucauugaauaaggccccaaguccuuac

SEQ ID NO: 16496 - RNA, 1158 nt, Homo sapiens
uuaauacuuuaaaauagggaacaucuuacaaucaacagguugugacagguuaauuagccacguuuuaucuuugauagguagcucuaaagucaagaaaacccaggcaagaucccgggcaagaucccagcacugccaacugucauuuguagaccggggauaggaacaccugucucacagauuguuacacaauagcgccggugaagcgcuugucacaaagccugacccaggacaaucucaaaaacggagauucuguuauucaaauuguuuauuuuugugcgcuaaguuucacaucaacccaacuaucucuugauagguuccuaccaggcgcuagagauaucuuacuuucagaaauuauuuaugauagcagaagccgcuggaaguccauagacaaccucaucucucuagcggagcaaacagcugggcuccagcuggcccuggcuucugcaacugcgcagucggcgcugugacgcccggcgcggcucugugacgucacgaaucgguccucuguaagaggggagggcauucuucuccaggggagggcuacguguugacgccauacgccggggcggggccgagaguuuggagccccggaguggggugucggcgccucauucggguggagcugagccggagacagguaaccgugcgcugucgccgcgcccgucccagugccgggugucgcggcgcuuggcggcccgggguuggagaucgcgguaaagggggaggccgccgcgcccuuggugcugcgggcgccgcggugacaggggaguggagcuggauggaguggggcucacggagggugguaggagggacgggaccugauggauggccguggcagccaauggagccgcggggccugcccggcgggcggagauuggcggguacgggcgggcuccgaggucgcgcggggcgcggagcgacgcgccauuggcggugggcgagcggggggcgggcgcggcggcggaugugagggagagggcggugcguccgcaggggugacccccaaggucgccgcgggcgucacgugguuaggccgcucuccgacggcguccuucccgaccgggacgcacucuccuucccgccugugaggaccgcgucgcuuuguccgaaagacaguguggccugcucgaguugcgucggagcaucuggcuuuggggu

SEQ ID NO: 16497 - RNA, 396 nt, Homo sapiens
aaacucaagauuuuauugucuucauaauaaaagaugacacuuagaacuggaucacuuggcccuuucucuucuuaucuccucccaguucaaaaugcuugcaucuuuuaauagccagcauucucuuagaucugcaguugggcucaacgcacucaagccuuagcacaaucuucuuuguaguuuuagccuuuuuccggaaaaucggcuuaguuugcccaccauagccacucugcuuccugucauaacgccgcuuucccugggcguacagagaauccuugcccuucuuguacugugucacuuuaugggguuggugcuugccacacuucuuacagaaaguccggcggguuuuagggacguuaaccaugcuugcgugagcgcuaucggcgcggaaagaagcca

SEQ ID NO: 16498 - RNA, 572 nt, Homo sapiens
ccggaaccgccaucuuccaguaauucgccaaaaugacgaacacaaagggaaagaggagaggcacccgauauauguucucuaggccuuuuagaaaacauggaguuguuccuuuggccacauauaugcgaaucuauaagaaaggugauauuguagacaucaagggaauggguacuguucaaaaaggaaugccccacaaguguuaccauggcaaaacuggaagagucuacaauguuacccagcaugcuguuggcauuguuguaaacaaacaaguuaagggcaagauucuugccaagagaauuaaugugcguauugagcacauuaagcacucuaagagccgagauagcuuccugaaacgugugaaggaaaaugaucagaaaaagaaagaagccaaagagaaagguaccuggguucaacuaaagcgccagccugcuccacccagagaagcacacuuugugagaaccaaugggaaggagccugagcugcuggaaccuauucccuaugaauucauggcauaauagguguuaaaaaaaaaaauaaaggaccucugggcuacaaaaaaaaaaaaaaaaaaa

SEQ ID NO: 16499 - RNA, 9058 nt, Homo sapiens
ggaggcaucgggcugggcggggcccccucccuccccaggcccugcacccucugcuuggucagcggggaaggaggcugcgccgccaacuccacccaaagcgcuccgagcaucccagaaucccaaccaccuccccagccucccacaaccaggguucuaggggcguccccgccucuuccuggccacgggcgaaugccacccugaggcaacccagcuuccaauuggcccugaaacccucccucguaaaugcuguggaaagggugggaccgggcgcaggcgcccacccccgcucccccacgaaaccgcccacagcgagagggaggccacagccggguggggugggggcggggagggagcccccccuacgcccuccgcagugccuggcgagcccgcgcacgcucacucgcugggacaggcgggcggggcggccugacgucacccacugcccccaccgcccggccgaggggcgguggccgcgcaggcucggcggggcggcggcacggacugacggagggucggaaggacugagggacgggcgggcgcacggccaggccaugccuggggaggcugcccgcgccgagcugcugcugcccgaggcggaccgacccgggccccgcacaggugaggccguggccacucuuucccugccuucagccucuccccucuccagcccggguucucuuuccaucgcucaccuuucaccccucucccccaucccccuggccccccucgaguccccuccccuuuccgcgcccuguccuucccuccaucugaacccugcuaccgccucucucagaacugcggggaagguggggcgcacgaagugcccgccgcgagccagaaagaacgugggggcuuaagcccuuggcuuccgacccagggaucguggggcucgcaucccgcccgcugcaucccguuguuugcaccgagcugccagccugcuggggcugggccgcucuggacagaggcagcggguucuggaggcgggguguccggcugauacccccaguacgaucaggugaccaccgggaggguccucaguugcacccggucuguccugggccggcgacuggucauggcucuggagggaggagcaggacuggccagagccuaggaagcccggauggagggccaggugguggaauaaagccuaaguugggucuggaagguggaaggccuugggggagguggccugauuagcaauggcccugggugugcagaccaccuguccuuaggcugggucaacaaaugcugguggaggcugauggggucuacggggccuagaaagagccgagccuggacaguccuggcguggaggucagccauguguggguagggccaagggcaccuugcugugggcaagaagucacccagagaugggaccacugcuggggccuggggccugguuuggggugacacaggcugcugccucugcucuaggugggaggcagggagugcaggcccagacuucccagccccagggucuugugcuggcucuguucuggcuugcuuggugaccuugaaugaguuauaaaaaccuuuggccuuugguuucugcuccaucccaacagcucagccguuccccugcccugggggccacaccaggggccagaaccaagagcccagcuucagggcacccagugaugccccaccagccacgcccacuccugauguugggugucaggcaugcaagaacccaaaggacccccuugucucaggacccccuggaugucccaucaccccagcagcaaagcccuugggugacaaguuuuggcuggugguucagggcucagggcucugaugcugcugaggggagcuggagcagccuggcaacagggucccccuucuuucagcuucaacucuaauccuggcucugcuuuguagaugagaaagcugaggugcaagagauguuguccuggucaccagugagugcgggagagcaggagccaccaggcaggcaucugcagccuggagagcuggccccugugugccgccgcucccccaccuugggcaagaccuggccugggcucugaagggccuucauuggaugcuucaaacagaggugccuuuggccuagguccaagugagggaguggacauaauggagacauuuaaaaugaagcuuaugagcauuuagagcacacaggaaaaugcuuaugagauuagguugggugaaaauagcuagauucaaaacugaaugugcaaugugaucucgccugugauaaaauacaggccaguaagaguccaggaggcagaaaaccauagcggucuggugugccgcaaccucggagggguuuucuuccaucuuccugaguccccuaaguccuuucugacccaugagggcuacuuccuauggacuccuuucucagcuggagguguguuagcucacagacguuuacugaguaccagagccuccucauacugaagccugcccagcggguugggggagugcaucaugggacccagagaaggcccacagggcagggugggaacucccagcacccgggaaggaacugguggucacccaugggguggcugccaccaaggagaggacucagccagaggcugcuguuggcccucugaagcuguccugugcucuugcugggcuccauggucuccguuccugcccaccacugcccuuguggccagaugcuccagcaaagccuccacgggacacuucaucucuguucuccagaaacuuggcugcgugugguggccccuggcuuccccaucucccugggugcaggaggggagcagggucagaggggccuggugaaacccugacauguuggccucaaguguagguagcaaggacagcagagagaggaggcagagcgaggcaugaagcccagaguguucgagcugcgcgcgucgugcuggugccaccugccucauguggcgcaucuauugggaggucaugggaugggacuggcacugccuggcagauucccaccaccagccccucccaccgagcccagcugaaccacacugauucuguggaauggaaacugcaauccagucuccccagagaggcugaaaugcuaguucuuugcugagguguccuugagaaaagccgccagacaggucuguucaugacucccagcaacacuucccucaaaaccccucucuaggaaaccacuagcaucugcucucugcugucaaaacuccuggaaguucucccucaaacgcagcgugcagagggucuucucuuuucucuccugccuuccuggauccaccuuccucugggcccuaugcagccggaauucaucuccccgggccuggcccuugccugggagaugcauccaggggcaccucaugaucuucucuaucuccacagaucuguccugcgaugcggccgcugccaccaccauccugggaggggaccggcgggagcccugugcucugaccccagggcccagccaccuggcccucacguuccugcccagcaagccgggugcccggccccagcccgagggagccagcugggaugcagggccugguggggcacccucggccugggcggacccaggggagggcggcccaagccccaugcuccucccugagggccugucuucccaggcucuguccacggaggcuccucucccggccacccuggagccccggauugugaugggagaggagacgugccaggcccuccugucacccagagcugcccggacagcgcucagggaccaggagggugggcacgcaagcccagacccaccccccgagcuguguucucagggugaucuuucugugccuuccccucccccagacccugauuccuucuucacgccucccuccacccccaccaagaccaccuaugcccugcuuccugccugugggccccacggggacgccagggacucagaggcugagcugcgggaugagcugcuggacucgccccccgccucacccucgggcuccuacauuacggccgauggggacagcugggccucuucacccuccuguucccucagccugcuggcuccggcugaagggcuggacuuccccucaggcuggggccuguccccgcagggguccaugguggaugaacgagagcugcacccagcagggaccccagagcccccguccucugaguccagccucucugcagacagcagcuccuccuggggccaggagggccacuucuucgaccuggacuuccuggccaaugacccaaugauccccgcagcccuccuacccuuccagggcagccucaucuuucagguggaggcaguggaggugacaccgcuauccccagaggaagaagaagaggaggcuguggcggaucccgacccagguggggaccuggcuggggagggugaggaggacagcacgucugccuccuuccugcagucacugucugaccuguccaucacggagggcauggacgaggcuuuugccuuccgggacgacaccucugcagccuccucugauucagacucagccuccuacgcagaggcagaugaugagaggcuguacagcggggagccccaugcccaggccacuuugcuccaggacaguguccagaagacagaggaggagagcggagguggggccaaggggcugcaggcucaggaugggacuguguccugggccguggaggcugcuccucagaccucagacagaggggccuaucugucccagagacaggaauugaucucagaaguaacagaagagggccuugcuuuaggccaggaguccacugccacugugaccccucacacucugcagguagccccaggccuccagguggagguggcuaccagagugaccccacaggcuggggaggaagaaacagacuccaccgcuggacaagaaucugcugccauggcaaugccucagcccucccaggagggcaucagcgagaucuuaggccaagagucugucacugcagaaaaacuuccaacuccacaggaagaaacaagccucacauuguguccagacucuccucagaacuugaaggaagaaggagggcuggaccuccccucuggcagaaagccuguagcugcagccacgauuguccccaggcaggcuaaagaggaccucaccuuaccccaggacuccgcuaugacaccgccucugccccuacaagacacagaucucucaucagccccaaagccuguggcugcagccacgauugugucccagcaggcugaagagggccucaccuuaccccaggacuccguuaugacaccgccucugccccuacaagacacagaacucucgucagccccaaagccuguggcugcagccacgcuugugucccagcaggcugaagagggccucaccuuaccccaggacuccgcuaugacaccgccucugccccuacaagacacagaucucucgucagccccaaagccuguggcugcagccacgcuugugucccagcaggcugaagagggccucaccuuaccccaggacuccgcuaugacaccgccucugccccuacaagacacagaucucucgucagccccaaagccuguggcugcagccacgcuugugucccagcaggcugaagagggccucaccuuaccccaggacuccgcuaugacaccgccucugccccuacaagacacagaucucucgucagccccaaagccuguggcugcagccacgauugugucccagcaggcugaagagggccucaccuuaccccaggacuccgcuaugacaccgccucugccccuacaagacacagaucucucgucagccccaaagccuguggcugcagccacgauugugucccagcaggcugaagagggccucaccuuaccccaggacuccgcuaugacaccgccucugccccuacaagacacagaucucucgucagccccaaagccuguggcugcagccacgccugugucccagcaggcugaagagggccucaccuuaccccaggacuccgcuaugacaccgccucugccccuacaagacacagaucucucgucagccccaaagccuguggcugcagccacgccugugucccagcaggcugaagagggccucaccuuaccccaggacuccgcuaugacagcaccucugccucugcaagacacaggccccaccucagguccagagccucuggcuguggccaccccucaaaccuugcaggcagaagcaggcugugccccagggacagagccuguggccaccauggcucagcaggaaguaggugaggccuuaggccccaggccagcaccugaggagaagaaugcagcccucccuacagucccggagccugcagccuuggaccagguccaacaggaugacccacagccagcugcagaagcugggacaccuugggccgcacaggaagaugcggauuccacuuugggcauggaggcccucagucucccugagccggccucuggugcuggggaggaaauagcagaagcccuuucuaggccuggacgggaagcaugucuggaagcgcgagcgcacacaggugauggggcuaagccugacucaccccaaaaggagacccuggagguugagaaccagcaggaaggaggccugaagccacuggcacaggaacauggacccaggucagcacuuggaggugcaagggagguccccgaugcgccuccugcugccugcccugaggucagccaggcccggcuccugagcccagccagggaggaaagaggccugaguggcaaguccaccccggagcccacgcuucccucagcuguggccacagaggccagucuggacuccugcccagagucuucaguaggggcuguguccagucuggacagaggcugcccugacgcgccugcccccacgucugcaccaaccucccagcagccggagccuguacugggucugggcaguguugagcaaccccacgaaguacccaguguccuuggcacccccuugcugcagcccccagaaaaccuugccaagggucagcccagcacgcccguggacaggccccugggcccugacccuucugcuccugguacccuugcuggggcagcccuacccccacuggagcccccagcccccugccugugccaggacccccaggaagacucuguggaagacgaggagcccccaggcucucugggccucccaccgccccaggcaggaguccagccugccgcugcugcugucucaggaaccacacagccucuggggacugggccgcgagucagccucucgccucacuccccacuccucagccccaagguggccuccauggaugccaaagaccuggccuugcagaucuugccgccuugccaagugccuccucccucugggccccagagcccagcuggcccucaagggcucucagcccccgagcagcaagaggaugaggacagccuggaggaagguaaggcagagggugggagugaagugcccuggggcuugggucaacuggacuccuccuuagagcuguccugagcuggagggccucugagguggcgagguggggggcccagaccccacagccaccauggagagcuggcacugcuuccucuggcccugauguggcagcagggccaggguccugaacccccuuccccgccaccuagaagcaaaaggccauccucacaccucuccccuuccccagacucgccucgggcccugggcucgggccagcauucggauagccacggggagucaucagccgagcuggacgagcaggacaucuuggcuccucagaccgugcaguguccagcccaggugcccaguccagggaagagggugggccucugggagggccccacaccccacccauggaugcucagcccucaccuuuucucaggccccagcaggcggcagugaggagaccaucgccaaagccaagcagagucgcagugagaagaaggcccgaaaggugggcugguggcucccucugggaccucaggccugggaccaucuguguggggaacguccuuaccaagacccucacacuccauggcuaaugaaaucccauccaucaggggaccuuuggguccaugccaguaacccacacaccuuccccuaaacagcugaggcuggaaugucaugagaaggcccuuauagacugaggcucauggggaaggaccaaccaccagcccaaggucuuggggaaguuggcgguggagacuuugccuuccugggcacugugcugcucuccucccccgacgugggucaacaccaggucugagccccccucugcccucuacucccaggcaaugucaaagcugggcuugcggcagauucagggagucaccaggaucaccauccagaaguccaagaacauccucuuugucaucgccaagccugaugucuucaagagcccagccucagacacuuauguggucuuuggcgaggccaaggucuggguggcggcugugguggaaugggggauccgagggauaggggacaagggggggacaggcucuacugacacagcugucuuccauuuugcagauugaggaccugucccagcaagugcacaaagccgcagcugagaaguuuaaggugcccucagagcccucagccuuggucccugagucagcacccaggccccgggugaggcuggagugcaaggaagaggaagaggaggaggaggaagaggugaagugcaggggcuccagggccucgcaggggguggugggaggcgcuacaugggggcucugccccagggaccucaagcagcuccagccacuucccugcucccccaacuccagguggacgaggcggggcuggaacugcgugacauugagcuggugauggcgcaggccaauguguccagggccaaggccgugcgggcucugagagacaaccacagugacaucgucaacgccaucauggugagugagcacuggccccuuucccuaccccugagcuguccccaagggccucgagagguccugauguuggcuccacugcggggugcuucccccaacaugaccaucucuuucugcaggaacugaccauguagccacugaccggaagcuggagccauccuacgccuucccucagcucugcuacucaauaaaucggugucccuucauugcccucuggugucuccuccucgcccucuggagucccaucaucaccau

SEQ ID NO: 16500 - RNA, 1471 nt, Homo sapiens
accuauuaggaaaaaauauauacuuuuuuuucaauaaacaugaaagacgauaauaagacugaaggagcccacaucucucagaagugaagaauucccucccauguucuauuuuaaaugaaagacaaaacaaagucaccaaaagcacaaacguguaccugggaacauaagaaauaggaagucaagaaacuuuuacuuccgcagguuaaaauuagacuaaauguucuaagcagguuauuuuaucagagagaaaauucaugcugggcucaguggcucacgccuguaaacuuaccacuuugaguggccaaggcgauuggauugcaugagcucagggauuugagaccagccuggggaacauggcaaaaccccaucucugcaaaauauacaaaaauuagcugggaaugguggcacgugccuguagucccagcuacucaggaggcugaggugggaggauggcuugaacccgggagguggagguugucaugagcuaagacagugccacuacacuccagccuaugugacagagccagacccugucucaaaaaauaaaaaauaaagaaaauuuaauuccuaguuuuucaauaacacaauaucugcuaguaaauuauuuacacauuccuuuuuuuuuuuuuuuuuuugagacagagucuugcucugucacccaggcuggagugcaguggcaggaucucagcucacugcaaccucugccuccuggguucaagcgauuccccugccucagccucccuaguaguuggaauuacaggcacccaccccgacaccaggcuaauuuuuuuuuuuuuuguauuuuuaguaaagacaugguuucaccauguuggccaggcuggucuugaacuccugaccucaagugauccuccugucucggccucccaaagugcuggaacuacaggcgugagccaccaugcccagcuaaacauuacagauaaacaaggaggaacagcuagacucaagcaggugguacuggaugagaguuggagauaucaaugugaacucaccuuuagccuaaaauacaaaugugucugcagauggaugaacauauacauauaugaacaaauuuauagagcugugugcaugcacagccuagaaggaacgacaccccaauaccaucaagcacacccaaugcccauaucuuggauucaaauacuauucuucaauaaaacgaaccaggauuccuuaaagaauuggcugauuccaggucugggaaaauaauauacgagaugaaccuggagcauuuuguagugcaagaaaguaagaaaaugcuaaaaacgaaugaaaagcaaguaaugcgagcaugucaaagggacacaggaagaaacugaaaguuugcaaaguucaaaucugggaccauuugaacaagaaaauucagaaaguaguauuggacuauaauucaaaauauaaaauaaauauccauaaagcugcaaugauuuagauaaaugacuggauaaauaaagaggga

SEQ ID NO: 16501 - RNA, 8929 nt, Homo sapiens
cagaugcgagcacugcggcugggcgcugaggaucagccgcuuccugccuggauuccacagcuucgcgccguguacugucgccccaucccugcgcgcccagccugccaagcagcgugccccgguugcaggcgucaugcagcgggcgcgacccacgcucugggccgcugcgcugacucugcuggugcugcuccgcgggccgccgguggcgcgggcuggcgcgagcucggcgggcuugggucccguggugcgcugcgagccgugcgacgcgcgugcacuggcccagugcgcgccuccgcccgccgugugcgcggagcuggugcgcgagccgggcugcggcugcugccugacgugcgcacugagcgagggccagccgugcggcaucuacaccgagcgcuguggcuccggccuucgcugccagccgucgcccgacgaggcgcgaccgcugcaggcgcugcuggacggccgcgggcucugcgucaacgcuagugccgucagccgccugcgcgccuaccugcugccagcgccgccagcuccaggugagccgcccgcgccaggugcgcugcgugcagcacccggcgcacuggcgccgaagggccuggggguugcugggugccgcugcgggagacuccgcuuuucuucucacuggagauaauauguggggaaacugaaggcgcuccgggaaaggugaaggcggucgccggagggacccuccccagccggcccucuacuugcucgauucucuaagugcagaguacuuguaaauugcaaagcgcuuucagugaaaauggguuaaagguuuccggagcugaggggagcgguaccgauguuuagcuguuggaaagauccuggacacaggagauucuccucgccccgcacgggggugcacacggacugcaaucccagggaugcuuggggaugggggggauauaggcggauuuggaccaaggaaggugggcaggcacguuguaggaaauaguaccucucuuuuaaaauacugacuuugcacagccuuuugguuugcaaagcaaugucuagucccgguauguccaaaaacaaguaaaguggauucggguuuugauaucuucugcgguuggaaaaccugaagcugaaaaagaaguaacuucuuaagguuacccagcggccacaacagaguguagguuugaacuccgcgugccacuuucaguaccauaccauucuuacaacucgggccaccccugcaccugcgccgaccucaaacaaacuuccaggugcguggugggugcgggcaauguggacuaagucaauuucaaugacacggaagggaauuggaaucaguccuagggcugucucccuucuuaaucugaaaugggggggggaaugagauguuguuaaggggagccccagaagaggaaaaaugcaaacauuuggcagaguuacccucuuggcuuagccacuaucaguaucaggcagacagcgacucugguaagggcaucacauuguucccuuaaaaaaaggagcggggguuguuuaaauggauuuggcagcuguucuuucaagcauucuuagccagccucaccuaguuauaugagaaauaaaguuccugccuugcacagcugaaggcugggagaauucuccccauccuaauucccccaacuccccaacgaucacguuggacagaugucacugggcaggcccccaucuagggcuagcaggaugaacagucccuuuauaauuuauguagcuguagaguuccacgcccgggugaaguuauuuucuggcucggcaaggcuggcucuguucaccccugagaaaugcuggauucauggaaaggcaagaugccugaaacauacacuggcucuggucagcuguuaaagcugcuggaggcauuugucucucggggcaaaguuaugucauuugccaagugucguacauuauugugcauuuugggguauucaaaaagugaucuuagaaauacugauacacaucgucauucuugggcuuuagcaaucaucaugauuaccaccuuaguagcacuguaguauagguugaugugaguuauaagauuauaaaaagaucuaagugacuucuagaaucuauuugacaaaaaaagguaaauuuucgacagucaaaagucacaauuaucuguugcuuaaauagaacuguuuugucuucaugcccuagucugcagcccaggcauuaagaagaaaccaaggaaauuuaagaaauuacucaagguucuuagaaaagaaguauaaauacguuuauuuacauguucuuagaguauuuacauucuuaguaucucuuuuaucucaguauuuccuugaaaaagaaagcaagcuaagauuaaaagaaauugaaaccaaauccucgcagguagggaccuccucugugaggcucugugcuggacccugggaaugugugcuucccaagguaugaaaccccuuggggaacuuuacagcaggaccucagugagcuguuuggcaggugaggaaacuaagacccagagaggagagggacuuuccuaaggcccuggugagugaccugccaguagccacuuccaggggagagcagagcaucugcagccaaaucauugcagccccagguagcuuucuagaauagacuguggaccagaugggccaccugagcucccugcuaggguuacacauuauagcccuguuuguuguaguagagaaauuucaugacucucaauuguggacuuaagccgaugccuccagaccuuggcaugguccacaggcccugggagcaugggcucugaauguagccuuugauccccauagcggucuuacagccccuccaaguucauucugaagaaggaauggagugagaauccuggcugcagauccagucuugaauuuagucauauacuuaaaauuccaauucaacuguuaacauuccagcauccauuuuaagcaucagacuuucuucauuuagcacuuuuuauuauaaaagggagaucugcuggagggggauuucuccuaccccacccccacccagggaaggaaaagcucuuuggcacuuagaagucugagccgugagugggacuuuggcauugucugcauccaugugcugcuguguucacccggggugaaaaggacucacuuaggcaggcaccagcaagaugcacagggucuguguagaccuugaguuuuagagauguaacggggaccuagaaaacaagccaccaacaugcuugcaugauucugagccccugaggcaaaacgcuuugcagguaauaauucaguuuucccaucugagcuggacaccaagcucuuauaagcguguuuaccugguagcauugaggacgguacuggucaaccuuggaauucccauaagggcuuguuacaacucagacugcugccgccacuccagcguuuccggaguggagaaugugcauuucuuccaaguccccgggcugccgcugcucccgcgggugggaggaccacacuuggaguugacugcaaaauuucugagccggcgcugcagcagccucccguggcucaggucugcccccugccgguggaagaugaagcauacugccuucaccuacugaggggcacugaagcguuugucugccuucuuuaguugcagcuacuuaggaagagcaccugucagauugacuuucaaacagauaacuucuugagguagagcaaccaccauguagugaguaguaugauggaauaauacuucaucgagguauuuuaaaaaaaaaaacucacuuggauugccaacuaauauugucauuuacaugugaccugguugcaacguuaagauuuuuaaaagacugugauagauauugaugacucucauguguuugucucucuugggcguuuuaaggaaaugcuagugagucggaggaagaccgcagcgccggcaguguggagagcccguccgucuccagcacgcaccgggugucugaucccaaguuccacccccuccauucaaagauaaucaucaucaagaaagggcaugcuaaagacagccagcgcuacaaaguugacuacgagucucagagcacagauacccagaacuucuccuccgaguccaagcgggagacagaauaugugagagcuuuuccucuuguuaaaggaggagggcaagaccugccaagccuggguacucagagccucuugagggcaauucuuacucaacaaaccccagcgccuggcugaugggugggcaaccccuagccccucugugcccuaccucucuccucuccuuacauaaagaauauugacccuuuuggagaaucuuaugaggaucaagcugaaauaacacucuuaaaagcauaugggaugucauaaagaccucugcagauaaugaaaaauauucucauaaagauaguuuuauuuacuucauccucuaugcuuguugaccugcuauugguuccauaccagcuucugugccuuacucugggaagagcaaaaaggagacagggagugaugguuagcuuauucgggggacuuucgugcuacaucagacauaagguaucugaggagcaaauuacaggucccacuuuugguaguugugcagcaucguaagauuuuuaaagcacacauucuagaguaaaaacugugacucuguugcucugguccuuccugauccccagggucccugccguagagaaauggaagacacacugaaucaccugaaguuccucaaugugcugagucccagggguguacacauucccaacugugacaagaagggauuuuauaagaaaaagcaggugagugagguccucaguguguuuucuuccucuucuguugacacagaggagaaacccaucucaccagcccccaggcucuucuggccauagcucuaacucugagccugugcagcaccagugcccaggacuuggugccagucucaggaggucagaccaagggcugcuuugacuuguugcucugagugcugcuauauuggccauaauccucaacccuagugccuuuccaccacccgcuucccacuccuguccuuucaaugguucacccacagggcggacaagaugcugcccaguggcacccuuuauaaacugcaaguggacauguuaacacauuuguuaaugcugcgucagggagugacauuucaaacaacuauuauagucaguuuccaagaagugugacaugaggucauaccacaaaaagcuuacccugaaaucccacaaucguccccuuuccuacugaugccuucccgauagugagcagguugcaauauuaagauuuugaaaaggcuguugcuagauguuggugacucgugugucucugucucccuugggcuuuucaaggaaaugcuagugaguggggggaugacugcagcauggccagcuuggagagcccagccauccccagcacauaccaggugucugucuuggcguggaggggauggaacuugaaaucagacacucgguccaugcuggggauggccagucucuccaaacuggccauguggucuuccuccgacucacuggcauuucccuagaaaguccaagugagaagaaggcaugagagucaucaacaucaaacaacagucuuuucaaaaucuuuauauugcaacauagucccauuccuggaaaaggaauggagugagaauccuggcuacacaucagccccaaauguagucauaugccuaaaaucccaauuaaccugaaaaugaucaaacaaauuuaagauauaguaauauuaagcuguaauaaauaugcuucuauaggcuuuguguuaugugauggcacuauuucaauuggcuuucuaauuggacaauugauacuaugcuaucuacagaauuggccuuuggagaccuaagugagccacaguggccucagggugaccauauacuaggauucauaguaguggccacagucagaaagccuaagcuuuccuccauugccauugcucguuuauacccacguuuucugucaaagucauauucauucaacaaagucauacugagaaggugucaugugaggcuggaugugggcuccaaagucauagcugugacauucgcaggcagcggggauguucucagucccacauuuggcagagaagucagucaagagguucuacaagggcugguguccaccuuauacuccuagaaacacaaaacugcccccacccccgcuuucuuggagcaggaaguuacacccacacgcaugcacaggcgcacacucagcgggccuaggcacgcauggcucuuguguugccuuagcugaaauuucuguugugcuuucucagcauagcagagucacgcuggcaaaccaucaugcgcccuggccaccgaccugacaccagacccaggagcauucacuucucugucuucuguuucucucccacagugucgcccuuccaaaggcaggaagcggggcuucugcugguguguggauaaguaugggcagccucucccaggcuacaccaccaaggggaaggaggacgugcacugcuacagcaugcagagcaaguagacgccugccgcaagggugaguacucaggaggggcagccuggggcuccagggccucacuguccuuggaccagccucaggggcugggcguggccacuggcccuuccccaggcuuacagacccaggagcugcagcucagggccagaaagagcaaagcaaauaggacagagcccucagaagggugcagggagagggagaccccaucaacccaaccaaacaaguguggggaaggaggccggccagugcaccucagggacacucugcuuuaucucagauaccucacagcaccuaagcuaucauucauccacacacaaagugaagauuuucaaaguuaggcuuuacccgugaggucuggagguccauuuaucuucacagagaaaccguuuuaauccgcaagaaccugcuaaagauacauguuucuaaauuaaagaugugaaugugagacagcugaaauagcucaguugggagagcaucaguuugaagaugcagcuuuuuuuuucuguaaaauauauaaugaauauucuguuagucuguggcuaauauaauuuuaauaaaguuaauuuaaaucugauagaaaaaugaaauuuuaaacgauaauuuuagagaaugcuauuauauccagucuucuuuuuucuuuuaauaaaugagggaacuauugggggaaaggaauaaauacauuuucuuucauuuuauuaagacaaauuuaguaagcagaagaaauuugcauguuuaguuauaaggguuucuuuuuuccuuacaaguuggaaaaaauaauucuaauuuaaggguaacucuuugacaaugaacacugugagcagcaucugguacucguugcuuuguuugaaaacaugaguugagaccccagcccugcacuugcaggccuagugccauuagccugcaggcugugcuggauaucucagggcaagagucgagcccuuuugauuuuggggggauuauuucaauauauuucuuuuucuuuuuguuuuaguuaauguggagcucaaauaugccuuauuuugcacaaaagacugccaaggacaugaccagcagcuggcuacagccucgauuuauauuucuguuuguggugaacugauuuuuuuuaaaccaaaguuuagaaagagguuuuugaaaugccuaugguuucuuugaaugguaaacuugagcaucuuuucacuuuccaguagucagcaaagagcaguuugaauuuucuugucgcuuccuaucaaaauauucagagacucgagcacagcacccagacuucaugcgcccguggaaugcucaccacauguuggucgaagcggccgaccacugacuuugugacuuaggcggcuguguugccuauguagagaacacgcuucacccccacuccccguacagugcgcacaggcuuuaucgagaauaggaaaaccuuuaaaccccggucauccggacaucccaacgcaugcuccuggagcucacagccuucuguggugucauuucugaaacaagggcguggaucccucaaccaagaagaauguuuaugucuucaagugaccuguacugcuuggggacuauuggagaaaauaagguggaguccuacuuguuuaaaaaauauguaucuaagaauguucuagggcacucugggaaccuauaaaggcagguauuucgggcccuccucuucaggaaucuuccugaagacauggcccagucgaaggcccaggauggcuuuugcugcggccccgugggguaggagggacagagagacagggagagucagccuccacauucagaggcaucacaaguaauggcacaauucuucggaugacugcagaaaauaguguuuuguaguucaacaacucaagacgaagcuuauuucugaggauaagcucuuuaaaggcaaagcuuuauuuucaucucucaucuuuuguccuccuuagcacaauguaaaaaagaauaguaauaucagaacaggaaggaggaauggcuugcuggggagcccauccaggacacugggagcacauagagauucacccauguuuguugaacuuagagucauucucaugcuuuucuuuauaauucacacauauaugcagagaagauauguucuuguuaacauuguauacaacauagccccaaauauaguaagaucuauacuagauaauccuagaugaaauguuagagaugcuauaugauacaacuguggccaugacugaggaaaggagcucacgcccagagacugggcugcucucccggaggccaaacccaagaaggucuggcaaagucaggcucagggagacucugcccugcugcagaccucgguguggacacacgcugcauagagcucuccuugaaaacagaggggucucaagacauucugccuaccuauuagcuuuucuuuauuuuuuuaacuuuuuggggggaaaaguauuuuugagaaguuugucuugcaauguauuuauaaauaguaaauaaaguuuuuaccauuaaaaaaauaucuuu

SEQ ID NO: 16502 - RNA, 964 nt, Homo sapiens
cucucggucccauauugaucucgaguuggaagaggugaguccugucucaaaauggagguaaaaccgccgccugguugcccccagcccgacuccggcagucgccgucgccacuggggggaggagggccaugauccaaaggaaccagagcagcugagaaaacuguuuauugguggucugagcuuugaaacuacagaugauaguuuaagagaacauuuugagaaauggggcacacucacagauugucugguaaugagagacccccaaacaaaacguuccaggggcuuugguuuugugacuuauucuuguguuacagagguggaugcagcaaugcgugcucgaccauucaagguugaugggcguguaguggaaccaaagagagcuguuucuagagaggauucugugaagccuggugcccaucuaacagugaagaaaauuuuuguuggcaguauuaaagaagauacagaagaauauaauuugagagacuacuuugaaaaguacggcaagauugaaaccauagaaguuauggaagacaggcagaguggaaaaaagagaggauuugcuucuguaacuuuugaugaucaugauacaguugauaaaauuguuguucagaaauaccacacuauuaaugggcauaacugugaagugaaaaaggcccuugcuaaacaagugaugcagccggcuggaucacagaggggucguggagguggaucuggcaauuguaugggucacagaggaaacuuuggaggugguggagguaauuuuggccgugauggaaacuuugguggaagaggaggcuauggugguggaggugguggcagcagagguaguuauggaggaggugauguggauauaauggauuaggaggugaugguggcaacuauggcagugguccugguuauaguaguagaggcggguaugguggugguggaccaggauauggaaaccaaggugguggauauggugg

SEQ ID NO: 16503 - RNA, 9302 nt, Homo sapiens
uuauguugugcucuuuauugccaaaaauaaacacuuuuaaaaagacaacuucuguuaaucaauaaauauccuuuccuuucuguacuggaucucugguuuucuccaggcugccuaauuaacugcuuugugcauguuccuaucuggagacagugcugagggguuagggccagagccuucauuaaggagaaaugaaauacuccuccuguguaugugggaggggcccuugcuccugcggcugcuuccacccccacccccacccccacccccaccaaacuaaaugaucaggucauuggaggugaagggguucaugacugcuggacagagaaugaaauaucauguuuauuugguggggaggggacagccagggucuaaugcuauuccaaaagguuacuucucaaauuagggacaccugggaauuugaagcgcuagcaggccagcccuggggcaagaacuggaaggguuuauaggcccccugaauaaaggcuauggcacuugauccucaacaccagacaucuaagguacaacugaaaaugacucauuuuggacagaaaggguuuagaguaaagagcuggacuaaccaggagagaagucuaguugguucccuacaggugcacuggaaacacuccagcagggaccuucugggaucuggggagcacugcugccaauuauuaacagcagucagggccaguaaagaccuauccugccuaaacaccacugcaucccugguaaucuaucuaugacccacuucuaguugguacugauguccugccaagaagcucaaccaacaguagacuagauucucagaaacgagaagagucugaagagagacccccauauccagcugcuggccugaaucuccguuuuugcugaagcaggcaagcugcaguuaauuuaugguuagcacaucacucuggaucucguggcuuaauugaguuuguaaaucacucaguuucuucuucaauccugagagggcugacaggacaaugguuucaggacgcagagagccacaggacuccacauuguaguaaaaccuaggaggcaagaguccagugagugcacugcgaggcaggcuggccgacccgagcucuggccauggacaacccuuccuccuuccgggucuuggcucuguucccacauggaacuugaccuugggccagggcuaacuuccuuucauguaaaaccucuuacauaggguaguuucaacacacuuugcacaaccucaaggaggcuacaacuaccucauaagguaccugugaaaauccuaaaguucuguauguaugcaugcccccugaggagagaguggaaaaccaagugagcagugaccagugauagaccuuucacagucacccuguggaacuuggguccaaaucucugccccuagcguugaccugaagaaucucuucuuugggggcugaaaaucagaacaggaaccaccuggauaaauggaggguccucuuugucagugaccaaaaggggcugacgaccugccccugggaugugcacauaccacaggucuaguuuagcagucagcagccccuccucagcuuaugagaacugcgaggugggggagagggaaugccuaacucacggccugaaccaaaaccaucccuucuuccacacuucaccuucccauguccaaccaggcucuuaccuuucuggcuugccguuggggucauagggagccugcgacucauccucauccagcuccgaguacucacucuuuggccugaggucaaacacaggucagcacaagguugccacugcuccuuuuggggcacccaaguuccuagagagccugccacaucucagucaacaacagccauuucuaugccacacccaccccaaaugccugccaucacuccuaaggggaacauaccauuccucgggcuugggguacacugugugccucagggcauugucuggaucguauucaaaagccaccccugcaguaggguuccacuuggcaugcuccuugccaaagcccuuuuuggcauaggcucgaagucucagcuccuggcccuuucucaacuugacgaugaggaugucugcagggagaggcacaagucagucaagggccaggagagacaugcuucuccaaauucugacuuggagugccacugcaagaccacacacaucuggaaaaacggucuaaagccaauuuucgaggagaccaggcagcacgagaggcugugucuggucccuccuucccgcuggcccacacggugacaggucaggaagacuuaccauccugcuccacguagucauuggggucauuaucucgguuccgggaugucaccuguagggaguccaccaggcauucauuagcugcucaccuccccagucaccuccucuggcauccauaucccagcaccucuagacugcaaucugucaaccagggaacgaacaccugacgaggugguggcacagaugcccccaggacuccaacccccacuucaggguguggugguagccucaggcaaaacaauuccauggccuuuaaaagagucccugggugauagagggugcgcagcaccaacgaugcuaacgaugcccaagaggaauccagaauuagcacuucuagggaucagauuaaggcagaggguaacagggaaagccaacauuuucuaaggaucaaccccagucuggcccacuuggagccagccagagaagagaaaagaucccagggaaaagaggaugcucucccgcacugaccggaaugacccgggggcuguuggagaugaggucucgagacgugacaugucgcgucuggucuucauugcaccgcacaucgagggugaacuccaccgagcacucggggcagaacuccucacaugugcaguccuaaggcaggaagggaagcaggaaugagucaaagggagauggcaacuccugccuuggcuccuugucuuggcuuccugcaucuaaugcccaguuccuuaaguuucuucaccuguaaaaagggguucaucaguauccagguucuugugggcugugacaaucugguauaccauucucauggacugcccaaguuuagagacaacuuauacauacacuggcacgcacauuucuuucccacucccaccagcugccaggccaccucuggggacauauugcuaacaucucccucuggcccuugaacuacucuuccucagagaaccaaggcuaugaggcacaggagaaugcuuucacacucuauaguucagcuucccaagaacuaagaggaccagcuugggaauguaaccaucauuuaaaauaaaaccaccaaggaacagaaaaaaguaccuuucaaguucuacacuaaccuuuucuaaaaaauccuuucuauuauggaaaauuucauacauauacacaaauagagaagcacguaagaaacugccaucccauaaccaucaaccaccuuccauaauuauuaacauuuugccauucuuaaaacaacugacucauucccauguuagggacuauuaauugcaguuucacuucaggcaagaagacaguuacuaggaugcaaucaagcaagcuguucucucccucacaccagugaggaaaacccaacacucuuuugauguuugcaugcugaggaagaagcagcagcuagaggucccaccuaggucgucugcagucacacacaggugagguaggaaggcaacccagacccuugagacagaaucacuuuuagaaauaugaaauggggcugggcacaguggcucaugccuauaaucccagcacuuugggaggcugaggugggaggaucgcuugagcccaagaguucgagacuagccugggcaauauggcaagacugucucuacaaaaaauacaaaaaaauuguauuuuuugggugugguggugcacagcaccuguagucccagcuacuugggaggcugaagcaggagaaucauuugagcccagaggcugaggucgcagugagccaagaucaugccacugcacucuagccugggugacagagcgagaccugucugaaaaaauagaaaaauaaagaaauaugaaaugggagaaucaaaauguaauggaagauaaaaauaugaaaagguauuuaaccuaaaaaaaauguacugaaaggagaggagucuguuugagaugaaaagagacuaaagugcuaugaggaccaaaugaaucuucacuggaucaagacugacccacaaacaaacagaaaaacaauaaaggauauuuggggaaaaacuaggaaaaucugaauauugauauuacagauuaaugcuaacuuucuuaggcacaaugaaaguguaguuauguaggaaacuauucuuauuaggaaaugcaugcugaaguacuuggaaguguuaggaugucugcaacuuucacacaguucagcaaaaauaacaauuugcauaugaaaaauaaagcaaauguaaaauauuaauugguaacuauaggugaaaaguaaaggguauuauuuuaguuuuucaacuuuucuacagauuuucagaaaaagccagagagagagagagacagaccaugccaucuuugugcaauaaauacuagaaaaaauuuuaaugaaaggaacugcuaggugauagagcaugcguaucuuuauguaagauaucgccaaauugcucuuaauugguuguacaacgguccccaccaauaucuauguuuuauuuauuaaaaaacaaaaaucuggagaucugaaacaaauagggcaaaauguuaaaaugugacaacguaguauuagguagaagcaugaguauuuauuacacuagcuccaugcuuuucugugcuugaauauuucuuuuuuuugagacggagucucacuuugucacccaggcuggagugcaguggcgcaaucucggcucacugcaagcuccgccucccggguucaugccauucuccugccucagccucccgaguagcugggacuacuugggagcgggaccacgcucggcuaauauuuuguauuuuuaguagagacaggguuucaccgugucagccaggauggucucgaucuccugaccucgugauaaacccgccucggccucccaaagugcugggauuacaggugugagccacugcauccagcugaauauuucuuuuuuaaaaauacacacauauuuauaagauauaucaaauuagccaucacaaaaaugacauggcccuugagaauauuagaaaauggacugauucuggaucacccaaagccaucaagagggaguagccuuaagcugcuguguaaugcagccuagugaaaggaugaagguaaccgacuccuauccuacucucuccaaacucugaaggccuguuaacaugccaucagggagcaaacacgaccaggaggaagggggugagacacuaagaguguggccauguuuaagcagcaucaccugcgagggaggggacagcaugaaucugcagacaccaggacuagucccccaggagcugcucuugugagacagcucccauucccucugcuccuugccuaccccaaccuucuguugacuccuguagcauccuaaggccccugcuacugggaagagaugcuuuggaaggaagaaccuccacucuaaguauaaaugggcacugugguggagcugccuaacaacacucccugauguucugcgugcuaaucaaucugaagccccaucagaacgcaggaccaaggccugcccaggcucuagacaacaucuccacguuguuguuccagaacuacaacaguauucaagcuggaugccaaaugucaggaaaaaucccuuugagaaccaaagccuccccaccaaaccucacauuccacccaaucacacaacauacccgagaguacugcagcuuguccacaaugucaucacuaaugaggggaauuaauccuguaaaaaacagaaaagcacuuuaaagaaaaccaaacagccaagccaaaaugagaacccagaagccuucugggggugaggcuggaaggaggcccccuccugacacuaggcacaauacccucccuuuaaccuccuaguaaaaggaguacucaccaagccugugagcaaugaauucaucaugaagaacugaggaauuggcaucaaucugaacccagucaauggcuaaaaaaugaaagaagcagacauggaguuuagccaucaaauuuaccuacagacuuaaugcagugguucucaagauuuaggaaucaccugacacuaaacugcagauugcugggcugauuccacagcauuagaguggggcccagguacuugcauuuuaauaagacccacacacaccacaccucaccucccugcccaggugaauuuaaugcagggggcucccugcuucacagaaaacacugacuuauagaauaucauagaaguggaaacauguuuauuugagcugaguauuugcaugagaagcacuuaaaucugcuaccugugccaccacuaaauccaagaacaugaacuauuugagcacuucaaagucagggaaacccucacagaagcaacacagacuuauggggccauaccucauuuuaggauauaaugacuggacugcccaacuuagcacuuuuuaaacacucaaucaacaaauguuuacugaauucuuuuaaugcgcaaaguauacuaaauauagaacccaaucccuagcagcaaugagcucguaggaggguaaagacuguauuaucgaucacacaugcuugacuuaaacacacauuuauucauucauaaacauuugcauggaaccaacuaaauccaggaaucaaauggcacuggagcccaacugccaaacgagggacacagacacuaggaacagcggucggaagaggaccucccccugccaggccuccaccugcucuguccugcuaugcuucccauugcuuccccaguccaagccaacugagagaacccugacccaagcuuuucugccucuuuaaucccccagcccuucccuccagcacacccuuccccuccuugcuguacagguuaagauccucugugccuccugaaaacuaagccuugccugcucucuaugcuacagaugugacauucccucccuuucaacuccucucucacaaaacucuguucagacuucccucaagacacuugucauagugugccuugugucauauuuguguauguuaugucuauaccucaagcuucagaaauuccuucacgcagguccugggaugucuuuguauuccuagcaugggugcucaauauuauuuguagaacugaauuuguugggaaagaggcauuuagacucagaauggcagggcugcaucaugaaguacaacucccucaccugacuccugaugaaacugagguccagaggcaugaagugcuuaggcagggggagguccagcacuccaagcugaauuuaagaagugacuggggggcggggggguggggugguggugguaguggauaaacuacaauguucucuugccuaaucauuuggccugcuuauuuccuuaaaagucugaauauuugaugccacagcuaugacuuauauuuauuuugccuaauccaaacucucugagcugacucucagaaaugcuugaaguauuucauacaaguauaaucaaugcauuaagcaccuggagcagaguggcuggaaccagaccagaaauugaucuucccuccucuaagagccaagugcaccacagcuaugcuucuccugaacuacugaucaaaaucuaccuugcuuuaguguugucuguggauucaucucuccccuacaaccucacuguggacuccaugagggcaaaaacccuguucucuacagcuuugcauucccagagcuuaccaccaugccugccacuuucaugcuccauaaaugcuguugaaggaauagauuaauaaaaaagccaucuaccagcacugagcacucacuaaacacaaagcacuuauauggauuaccucacuuaauccuuaacauuacccugauaaggaucauuaguggccgaauguuacagaugaggaaacugcagcacacagaaguuuaauaacuugcccaaguuucacaaaagcaguaagugaugcagccauaagaacgaacgaaaucauguccucugcagcaacauggacguggcuggaagccacuaucuucuuuuuuauuuucuuuuguuugagaaggagucucacucuauugcccaggccagagugcaguggcaugaucucggcucacugcaaccuccaccuucuggguucaaucaauucugccucagccuccccaguagcugggauuacaggugggagccaccacaccuggcuaauuuuugcauuuuuaguagaggcgggcuuuccccauguuggccaggcuggucucaaacuccuggccucagguguuccucagucuuggccucccaaagugcuggaauuacaggcgcgagcgcggccuggaagccauuauccuaagagaauuaacacaggaacagaaaaccaaacaccgcaugggagcuaaaacuggguacgcacggacauaaagaugacaauaaacacacuggugacuacuagagcuggaagggaggcaguggggcuaggggugaaaaacuaccuauugcguacuaugcucacuaccugggugaaaggaucauuuauaccccaaaucucagcaucacgcacuauacccaggcaacaaaccugcaccaauguaccccuugacuccaaaauaaaaguugaaaacauuuuaaaaacuuuuguaacaauaguagugaaaacaguauuugaacccaagucugcacacugcuaaacccaugcuucucagcaaugcauacccaggacaaggguggaccuaaguggcccgugggcgccagggaggcggccacugagccaagggcacaggguauggucaagucuccagcaaugcacuuuucucagcacuaccacccucagcccgaaccaaggacuggaaggagccccaaagaguguguggguggagagcggggcaggaacccgugggcgcgggaacgaggaaggggagucgcuuaccuauuaugggaaccucagcgaugaagacccuccgaaucgaauuggccacccugaaagaucaaaagccaaggggcgugaaggcgcugcagccucgacaggcugggcccgcgccgcaggcucccaaagcuaaagcccuggugcaggggggcagcucuggaaggacaucgcccccaccccaccccacuacacccccgcccccugccccggggccccggcuugggccucccggcgccccagagccgccagccucuucccucgguagccuuacgccaggucgguguucucgaugaugaacuugacauucucgucagugagcuccgugauccgcacgguaggcugguuggcguacggcaucucgcccaggggccaccagcc

SEQ ID NO: 16504 - RNA, 1085 nt, Homo sapiens
auuuugaauacuuuuaaaauugauuccauguuaugaagcaauuaugaggcauuuccucucuuguuggaauuaacgauuuuuuccccuaggagggacucuauggucuguguuuuacuuccuuucuuccccuguauuucuagaaaauauuuuccuaguaacccugacauuucuuuucaucuugcuuauucuaguuggucugauauagcuugauugacauuucagccuucuucccacuauauuuuuuuuuccugugagagcuauuggguuuucuaaauccugaaagaaugccaaagaugggguuggaggaguuuggugaggcaaagugcagccuuuguuaaaauacuuuuccuuugcucucucucccucaucugaaauuuaguuaaauacccuaagccaucagcacuguaccuaguuggggaaugcuuucauccccacaggagauucucuggggcuuugggccaucuuccccuucaguguagaccacagaggacuuugcuucugucccagggagcccgcaggggcucacuucuccauguucaucugauucuugucagccaagguuucaaaugcuuuucugaucagaacagggaaaagauaccuaucugaaucaugucuuuauagauaugaggcuaugagggaaaauucugagguuauucuugacucacaccuaaagauuuggaaaugagauuagcagcaaagcuuugcccuacaucucaugucagaauuuucuguuucuuucuagucuuugaguguauguguguucucacacacgccauaaugaaaugcauauuauauauaauuauguguauauauaauauucuaugacuauacaugacauguuccuuuagcugauugcuguuaagagaaauuuauagguuuuuauuuuucuuguuuuguuggguauuaaggaagagaaauucuaugguaauuuucauguggcacaguaaucuggcauauauguugauuuuuuuccuacacccauuuguugugauaccaaguuugaaaacaacagauuucagugguugcuugggaaaccacagaaccaugacuuggggagagacaggaugauuaggugggaaagcacc

SEQ ID NO: 16505 - RNA, 300778 nt, Homo sapiens
cagagcagccggggcgggggcgcggcgcaccuugcucccggcgcccccgccccgcgccgccgccagccccucccugcgcucccggcgcccccgcccgcuagagacgauuccagccccuuccguccgccgcgcuccgccgcuguccuccgccggcccgcgugggaggacgaugggucagcgcggaaaaagugaaugagggcggcagcgguggcggcgguagccagcgccugacucggcgggcccggagcaccgcccgcgucccggcccccggcaccauggacgcgccgcgcgccucggcggccaagcccccgaccggguaagcggccccgcggucgggcgggguggagagggggcuucccugggcucggacgcccgcguccgcaccgcgcgcucccgggcagggcgcccucucugccgccccagcgggugcuggugguagugguggagcagguggugcggugcugguguugggugcugguguugggugguggugcgugcuguguacuuugggcacccgggucguugcccagguaaccgugucgggccggggccggagcgcacuuuucgcgcggggugguuuguaugcaggcguccuuauggggguccccgccagcacagcccccacucagcuccgagcuuuccucaggccccccaaguguuugccguagggguggagcggggagcgaggggacgcccggccuuugacuccggccucuucccugcgggcuugccccuggccgguucccaucaagucuucccucucccggccucggcggcagccccaggaucggcucucccggcagcguggaggggagggcuccccggcuucgcagccgcccgggccccgcguucucggaagguguucggauugcccggaggguuucauggcagcagcucucccucccugccuuuauuccagggucuccccuggcaguggaaggggcguccuaguggggccaggccugaggcgcagacauccguagcggacccgcgagucuggcggcccaucccugucuucgcgauuccgcuuuugcccaaaccucucccgguuucuguuugcuauccccacaccuugcgugcagggauuacacgucacauucaggauuugacucucagaaagaguaauuucccucaaacaggacgagcagcccugcucauuauucagaccccgagccaggugcgccgugcucaucccggccagcggugcaggcugggccgcgggguagcgcgcagucccgguggacuuuguaguuuucagcgcggcgcgccggggaccuucgaacucgcucgcucgccuggagcaaauguguaugagucuugcaaauggaaugaggguuggggugagcccugcaccugcuuacugaaugggcccacuuucugcuauggcaacuggacuugaaggaggcagcuuuggggacaacaaaucuuuuuuucuguuacaguugugucccacugacucacccugcccaugugcccauaggcgggcguguugcccaaguguguaaaagacuuucagucgggcucuuuuuaaaauuuuaaaguuuuccuuuaaugccaggaaaaggugagccagguuagcaaaucaaauaauccugaagcugaggaauguuaaaaagaaguuuucuuucucucucucuuuuuuuuuuuuugcagugcacuuacuggugguuauauaauucucuuugaacaaacaaauuccccagaaagaaaguaaaugugggaaauccuuuuucaugguaauaggcaucccaaaauaacagggaaaugugaaacagagguaucuuuaaaucuguggcuuucauagccuauuaaaugagccuauuuaaggacacugaauuauuuugucacuaucaccuuauaaauaaauaugaagacagagagaacauuuaaaaggccggcaaaacuguauccaaagaguaucuguaagauccuugaagggagucuaaugauagaagugaaaggacuuacccuaagagcguggcacucuuuucagccugguacuguguggcaagagguagucgagggcuggccuucucagggcuucccagagcucugauuggcuuucauauuugaauugcaaaguaaaacuaaggauuuuugcuauggaaaacaugaaauuauuccugaugcauucaguucuuucccucacucauauccagugucuaauuuacuuguccgaacaucuuuguccaagaaauguagacauauuauuuuuaacuucuauuguucucacuuugucauuuguuaauacuuucagugaagaagcaucaagaaaauguuaauauccuuauauuuuuucagacaagaauuacguguuuaauaagcaauuuuguguucaaaucugaggagauaaaugguguuaggucuucgaauauuuuauauaauuuagguguaugcuugcuaauuauaaagguuagauauugcugugaaauuuguggcuuuaguacauuauugguggcaggcagauucuguuggcucuucacugagauuacuccucuguucccugagauuaaggcaguguuugcagugugcuugagggaaauuuguuuuccaucugauucugcaaccguuuauuauaaaaucaaacuuucaguaagccucugucuucccacaugauaacaaacugauguggugaagcuguugcuguugcugaaacuaccacuccuccuuguguuguauagaaacaagcuagacugggugcagugaauuaacgagauuucacccuguggccuacaaacgcucuucuagaagauuacugaagggagauagguuggugaauguaaacucacugacucugugucuggcuaaauuauuaacagguaguuauuaguuaucuuugugaaaaacacaaauauacguuuuuacuuggauugaaauuguauguuuuuuacuaggaauuucauuaaaacagugauguaugacuuccuugacuccuggggaaaguguucuuuuaggaaagaggcugugugcaaaaacuaacaagucagacuugaugugacuuuuagggaguuuuagagcucaguugaaguauaagaauugacagaauacucagaacacaaguaaaggcaaauugccuuuuggugagguuuugaaguauauuuaacucucuacuuuaucuguuuacuuugcguuugucugaauauuuauaggagccaucccaguagucggcuguuacagaacacagggcuaaauuucccauuggacccucuguuaauaaaggacagaagaaggcuugcuguuuggcaggaccaugcuuaauuuuuuuuuuccuauggaggaaagacauguuucuguagaauacaguaaucuccaaugacaugaaaugucaaaacagcuggugcauuugaucaauggcuguauucaagcaguuugcucauguaaaaaucaguggaaguuuugcuaaucaguuucgucaaaauguggacuucauguacacauagcuguuauucauuucuuugcauaaauuuauauuuauuuaaucaaguuauuagaaccaaaagaaauuuuaaaaaauuaaucgaaguggguaacuugagcuacucuaguccugucggugccgcacauaguauuaaguguagaaggccugugacucuugguagugacauggggcagccacagugacauuuuguaugaaacccucauaagcaugcagauauuaagaaaauauuaacucuacaccauaauaggaagcuuagguuucuaggccuuuggcuuuuggcuaacauguuagagaaaguguuuacauucuuucaaaugagagcauguauaaugaacuguuacauaaaacuuuucccguuagauuugagcauuauuuuuaaaagauauuacuucugagcuacucuuuauuuuggcaauucauuuaagaaaguaaaaguuaagaauugcuugauguaauguggagaguaggccuaggaauuuuaauguuuuguaauuaaaauauuuacuaauaaauuagaagaguuggacauuucuguguugcaauaucacauagucucagagcauuuuuauuauuucucagugguucuauaaaggggauagaacugaaguaugauuaaaauuuguuacaaagguauuuguuaaguguugcaucucuccugcccccaggaacuuuugccugcagucccuccuguguuuucucgugaccuccagugcacagguggaguggauuauuauugaguggaaccuugacccaggcagagcgacagcccccacguauaugcaggccuggauucuguggacuucuuaauuugggauccagggaaugaagucauaaucuguguccacgcaagugcuccuguaauuauuaagaaaacaaugauuauaggaugcaucuauacaccguaauaaguaguuuagguuucuaggccuuuugugcuuuguuauaaauuuaugauuaaauuuaauuuuguaauugaucugcaguuuugaaaagugagcauaaauauuugauaccaaaguaguauuaauauuuagaucaaggacauacaaaugugaaauaugcuaacacuugguucugauuuagacuugaacuuuguaaauacacuaagaguuccuguauuuauuuauuuuuuugguggggggacauaaucucaccaugucacccaggcuggagugcaauggugcgaucucagcucacugcaaccuccacuuccucgguucaagcgauucuccugccucagccuccggaguagcugggauuuacaggugugcaccaccacacccagcuaauuuuuguauuuuuuuuuuuuuaauagagacgagguuucaccauguuggccaggcuggucuugaacuccuaaccuugugauccgcccgccuuggccucccaaagugcugggauuacaggugugagccacugcccccggcugagguccuguauuuauuauaugguguuuucguacauuccuucauucucuccccauccacauuuaauuaugaagguuuuaugcguugguuaauuuuaauugugugguuuuuuuuuucaguuaccuuauacuauagcugaaaaaaaguugguauuucaugacccacugaaagcuuuuacauaucuucaucuuuguacuuuuucuuuauuuaaaauacuguaguuauugguuuauauuacuacauagagauguauugauaauaugccuuuuuacacuuuuaugauuuucauuuauuugaguuguaaauuuuaguuuccaucucccccauuuuauacuuugcuuucucgcuuccaccuugucacuugaguguuucuggauuuuucagggccacucccuggcuuucugcuucugaauugaugggaagccuacgucacuuuucuuucaggguuccauaauuccuuauuuuucaucugucucuugcuggaauagaauuaaaacuuuuuuccucuuguauacuuuauaugauucuaguugcuucuugcaaagcuaaggauggucaauacuuucaagaccuagugcuauuuauucuagacuagaguuugcugucuccucuggugcgacaauagacaauggguuuccaacaguguguguauuuucugcugccuaucucagggccaucccugugcuucugagccagccccuccagagaaggauggcuuuccccagcagggagaaacccuguggccucuugggguguuagcacgcuucccucugcucuccucaucagguggcgagcugcucccugccagggcauugucuucuauaggccaaguccaauuagaguaaucccccagcuaaaaacauuucuauuaaaaaagagaaaaagcuuuuuaagcaacugccagaguauauuuuucuuggauacauuugguuagacagauucccagaccacaaauacuuuuguacaaauacuuuuguagauccaguucccaccugcaccacaccaagugaugccuguaaaaaggacaucaauugauuuagagaaaccaauaaaguccuuaucccuuaaaaaaaaaaaaaauacaaccggccgggcucaguggcuuacgccuguaaucccagcacuuugggaggccgagguggguugaucacgaggucaagagaucgagaccauccuggccaagauggugaaaccccaucucuacuaaaaauacaaaaauuagcugggcugguggcacaugccuguagucccagcuacuugggaggcugaggcaggagaaucgcuugaaccgggaggcagagguuacagugagccgagauugugccacugcacuccaccugaugacagaaagagacucugucucaaaaaaaccaaaccaaacaaaacaaaaacaacccuccaaagauaaaccagguaagucacgcguccuggcuggucgaucccaucucuugucuuccaggugcuccucuagcauucacugcccaagaaccugaauccccauggggagccauugccuuagagaugcucccaccucucuccagacagaggcugccgagggccagacagggcauccuucccugauucagaaugcccucugcuuauuuguuaauccuauugacuuucuucuaucaaaggcagacagcgggaggauuaguggaaagaaaauugucucaggaacaagaagcuuuggacccuggugccaguuguccaaggugaaauugcuccuucuccacgcagccugcaggcccauccugauggggccucuccagacuuuuucagcccagggcugucugaugaugcuucugccaggugccaguguucucugccagugcugccagacacaggugcuucugaacacuugacuggugauuauugcaacugggagcugagucuuucaccuuuuaaaauuuuaauccauuuaaacuuacauagcugugugcggcuaguuccaguggacagcgaggcuccagccuuuggauuugccacucuuuguuugccaccgcagcuucccaggccucaccuggggucucaggcuuucucucucaccuuggccuggagagcuuucuugccccuuucucagaaugccuguuguuuaagcugcagcuggggcucccccaggaggccuucugagaguaucccucucacaccccacgcccuccccuguccgaaaaccuccuaugggauuaugauugucccuuuacuugccccucugacccacugaauucugagcagcuccuuggagccaggacuauuacuuuguaagcuuuugugucauugguuuguggccugugaugcacagaacaaccccugcuuccuucuugcugguggagggaguuagauaacaugaucuuaagacucaugugagcucuaaaaucauaugauucaguguucccagaauauucuagaguccucuuucaaaaaaacuguuucuuaaauugcugcuuaaaucuuguuuuugccagccuguaugagaacagaccgaucaacuggcacuaacauauuuggaacugaugugcuuggacucagcuugccagccaugcagccuaguucggugcagauuugggagguguuaagaggucuuauuuugaggaacauaaagugacaguggcuuaaagaggagauaauucucucuccuaucuaaaagcccaccucgggaguccugggcugguguuggggugcagcguucccagagaccugcugauuuuuauuuggugcucagcuguggcuggugugcagucuccaucuguuccagccuggccugaggagggggagaugcaccccguccuuucgugcuccaccugccagccauacaagucccuuugcucauguccccuuggcccaaccauaaucacaucguccuuaaaagggcagcuuggaggcaggggggaucagagaucuuagccguugugauugcauuuaugacuccugugagggccgggggaacguagguguuaaagugugcagauggguauguggcuccucugccccuugccagggucuugggaaggggugccccugacaguuucuggccuuucugaaaaacauguccuuaguuugcugugacacacacccacguuauauagagcucugaccuacaaagccuaugcuuuccagacaucuaaggggaggaagugacguuuagacuguaaucuuaaaggccagugguaaacaggacuuugcaucugcaacacaucggggugcugacguccuuugcuuuuuaugaugucucuguucuccuuguccaugcuacagccagccgcuuccacuuauucauagugggcaccauccuggaggaguuggggaaagaggaucccccagcccccaauuaggguaguugcaccugggaaagucagagcuuccugcugguuuggaggagguaggcaaguuggagagacuccuuguuagaaugaggagcauuggcaaagcguugucuuaucauaagugcucugcuaagugcucugcguggcuuaaggacucauagagcuggaagaggagaaauaccaaauggauuaacuuugcaauuacauguggauggcuugagcaguuaaguaaguagcaaacuaaggcuaaggaacauaaugggaaaaccagcuguuugugugaauguaugugugagugugugucugucugucugucugugugagagugggcgugaaguuaaagcuaacuuccagcacuuggcaaagcagcagauuaccaaaucaguucuggcgguuuucaaacuuaauggcuugggaguuguauuuaaaaauagucuuggguaggaguguuaaugcagccgaaguguauacuuuuguucauguggcuaauuuuuuagucucuaaauacaguuugguuggcuagaacccucuuaauuaagugcaaaauccacuaguguucaaugcacaaacuguuaggcuggagggagacugaucgacagcagccagagucuaaacauuugccaugcagggcagguccuugccaggcuuucccguccgcccaccuauccaucugucuuguugucuauagcuaccagguagaauugguuuuggguggaacugaaaacuuccuuccuccugcuccugccuaaaccacuuauuacgugauaaugguuaucugcgcucugacaacaucacacguaggaagagugaauugcagaucucucacaagagccaagccacccaauuggauuuaaaaagugggaauuggggugaugaagucugaauguuuuucaugcugugacaacgcucuaaauugcuacacuuuaccacuucucagaaauauuugauugguuucaacggcacaagccauaaucaaagacuguguucugaaugcaguuaauuugugaauuucacagucaacagaaaaguaaggaaaacuaguuuggaagcuagacuaaacugaaaaauaugucaguuuggaauauuuccuuauuauuuguccauuucuuuuugcuuaccaucauguuucacauuuuuagaaugauagauuuuucuaaaggaggacccaaaaaauguucuuugcaaggacuugccuuauuuuggcauuagagccacuugccuguugccauugucuagcugacagagauaggagauggccagaaccugcuccuugugugugggaggucuggcucucccaucagggcccucugauguugguaggacaguacuguccucuccuuuuuuuguuuuuguuuuuguuuuuguuuuuguuuugagauggagucuugcucuggcacccaggcuggagugcagaggcgugaucucagcucacugcaaccucuaccuccuagguucaagcaauucuccugccucagccuccugaguagcugggaucacaggccugcaccaccacgccuggcuaauuuuuuuuuguauuuuuaguagagccgggguuucaccauauuggucaggcuggucuugaacuccugacuucaagugauccacccgccuuggccucccagagcacucggauuaugggccugagccacugcacccggccuguccucuugguuuuguaggugagauugccaugugacucugacgucucucgucaguguccacguccucaucguuggccacucugcuaggccacauugaagcacggagcucauuuccaaagcugcuuuaugaaagcuacugcucuagcucccugcaggaugaaggaggauguugcucugcucuauuucugaagcccuggagugucucagcagcauuuugccaugaaaagccagugugccugcagacauucuuacgacuuauuccugguauaggagccucaugauuaccuguuugauugugacagaacucaugcuuuucuaggaugugcgauuccugagacuccuacgugggauuuuacuuuuucaaagaaauacguggugugugauaggagaggaccaaacucagcuguugcugagcacagagcaguuaugaauuaguguaaggagucgaauccagacuccccuuccucaaagcaagauguucugccugauacuggcugaugaauuaauaaacauugaaaagccuucccuuuuguacuggauguuggcccagcucagugucuugggcugauacauuuaaugaaaacacagagcucugcucuguucaauaaacgagcuuccuucaaaguagaagcuacacagaacccagacccacaaauucgcuaauuguguuuucuuuggguaacuuuauacagcccuugcuccaagcugcaagagccucaguaaugagcugggugaugcuuuuagggccucuucucugcaggugagugggcccuguuggccugggugugcuagucaguaucggggcuucuagaggccagcacccuccagcagggaugaacugagcacggagagaaaauagcccugguguguggcacuuccaagccgccucuagguucauggugccuagugucacuguguuccuggggccccacucaucugcauuacagcucacaccucaagacacucgggaagcaagggccaucuucauucaucaaguacaauguuugcccccacccccgccccaagacagagucuugcugcucugucgccugggcuggagugcagugaugcgaucucagcucacugcaaccucuaucuccuggguucaagcaauucuucugccucagccuccugaguagcugggauuacaggcacgugucaccacggcuggccaauuuuuuuuguauuuuaguagagacgggucuucaccauguuggccgggcuggucucgaacuccugaccucaagugauccaccgccuuggccucccaaagggcugggauuacaggcaugagccaccacgcccagccaucaucgaguacaauguuuuaagcgcauaccugguaccugguuuaggggcuuuuuagugcugugaaugagcugguguucuuggcucuccuggggccuaugcaagcagaaugucccucaaucuauuuuuuguuuuuaacuuaguuuuagucacuuucacaaaaguaauuuauccuccuuaugauguuucacuuaccugugcagaauccuccuucuguuagaacugauuguucuaaaugacaugcaccaaguuggaagauuauaccuuuugucucuuuauuuuaacuguugaucuguggaaaauauugcuuuguagaugagguaucuagacagcaaccucagaggaaaauuauauguuagaaauguuuucuugauguuuacuuuucauuuucugaguuaaaaauuauauaguauucuuacagucagggauaagacuggcugcagagccugaugggaaguaaagcauggcuuguguuuacgcugggcuggcuuucaugauuuacccaugugccuaggaaggggaugcacuucauuuguguaacauuuuuuacuuagggcgguguuuuuauaaugcuaaauauuuauugucaugaaaagguguucuuguuuauuuuaaacaagugaaagugacauauaauugaaacagauuuuccacaaggcucagcuuaugucccucuuuguugugucacagugacauagggacuggcccuuguauuaccuaguggugcuggcauuuggaggggcgggggcuaugcucuggggagcacggcugguuugcagcucucugguaacuucuuggugagggugucaaccuacagaacgugaguggaaggacaaggcccacacauccgcccuccccugaaagcuuugucacuucgagggacuguuuagccuccucaucccucaugacuaaggcggagaugacuggauugcaggguuuuaugagaugauuagagaccaggaguaacagcaucaguggagggccugucacaggacaguuccuauuuuuuuuuuccaauuauuuuucauuauaaaauauuguuauuuucccauuauuguuuuucugccaguauuccaucauucugguccaagaacauauaauagaugugaaacucuguccugacaccuguuuuuacaaagacuugcacugccuuuccaguaggaaauauuacugcuaccauuuguuuucuuaugguagaaaugcggccaaugccaccuugauaggaaacuaaugauucuaaugaucagaagggaucuguugguuuagaacagaaaaauagcacuagaaauacaauacaaaucauagcuuguauucacaaauuguuuuucaguggauguuguaaacacagguuuguaccaggaccaggugggucacaccgaugaggaagucaugggcuggacaggguggguuggggacuguggggagaaugaauggugacucccaucccacuggaagagcuuuguuagaaggcuggaccugccugugaccucugccuccccacuucuaaauagaggucauuguguuuugcccuuuguuuugcucuccuagcaguucuuggauguugugagggcgagaccacgauuccuccaucaugcagguguggcugccucucucacaccaucacuuuccaagcugaccuuggugcuggcgacaacaugggacuggauucuggucuccugacuguuggaccagugagugguuuugggggagcauuagugucuggggacuuccucugaacuucaaggugccgccagcguuauuccaugauacccuuuacccauuaaaaauaauauaaaaauaaaugucugaguuuaguguuggugugcaugcagucagcagccugucccauauguucugucggcggcucugcagaccacucagagaaaaauaacagcauugggugaccaccuuuaaaaaugauguuuggauauuggauaaaauacucagccagucuguagacccacugggaaaaguauaaggaaaggauccauacagaacggaucaguauacauuuguaccuucccuguuuggaguugggucagcagauaagcugaauuuugauacaugucuguguuugucacauguaacaucuaagagcuugguaaaaucccucucccaggcacauuaacuucauauaaauaaauaggugcucaugaacaccaguugcuuugacacacuuccuuguggaaugagucuguuuuugcuagaggaaaguaaugacaagugaugccucuguuucuguggcucccuccauccgggagggcuggggaugucacccugucaccucucaccuccaguggccgucucugcaugcauggucaagucaggugcgcacagagaccggauugcugguuuuguauuuuuguuuguuuguagagauggguuuugcuggucuugagcuccugagucaggcaaucuggccgccuuggccucccagagggcugggauuacaggugugagccaccacgcccggcccgggauuguugauuuuggaugaugggcuuuccuguccacauucgauuagguuuuguguccccagauuuuauaaaaggguauaaagcauuugugucuaucucugcauccgaauguaaaagcauaaaucugaaaguaugaucuauuguguuaacuuugucaugaggcucggggaaacauuaauguauuguauuuuaaaacauucuaauuugugaagugcagguuucuauugcagugauaaaacaguagcuuguuucugagccggcagcccugugagugggguauuguugucauaguugcagcauugcguugggaagacugagcuggugauuuagcacaugccaaaaacugagucaccacagccguuugguugggggugaggggugaggcgucuguaacacucucugauaacagugcuuggugcccuguauagcgucaucuuuaaaaaugguaauuuauuaucagcgaguaaaacugaucucaguuaaguuccaguauuuucaaagcacaauuauuaccagaauugugaauuauuauuauuuuuuucuuagaaauagggucuugcugcauugaccaggccagucuugaacuccuggccuuaagcaauccucccugucuuggcuccccaaaguguugggauuacaggccugagcgaccacacccagcccagaauugugaaucuuuuuuuuuuuuuuuuuuugagacggaguuucgcucuuguugcccaggcuggagugcaauggcgcaauaucggcucaccacaaccuccgccucccggguucaagcgauucuccugccucagccuccugaguagcugggauuacaggcaugcaccaccacaucuggcuaauuuuguauuuuuaguagagauaggguuucuccauguuggcuagguuggucucgaacucccgaccucaggugauccacccaccucggcuuuccaaaaugcuaggauuacaggugugagccacugcgcccaguccagaauugugaaucuuuaggaaaaaaauuaauggucuuaucaauuuacuuuagcaguagaauuucuuacaaaacuuaacugcuaggaaaugauggcaucauugcuuuauuuaugugacccccuccaaauuuauuaugcugggagggaggccaggccuuugcccuuguuagcccagcagucuucaccuaguuuguaagcaccuccuaggauggggccaggcuguggagacaugcagcucggcggcugcccucggggagggccacgacacugaagaccugucagagccaaccaggggagaggccccuggcucugacuguucaggagccaugccucuuugaagcugggagaggcaaagcuaccagguuuugagcuggggguugaaaacuagauaaaauguaaaauguggcugggcagagaggcaggcauggacugacugccaggaguggaagcccaaggauggaggaaugcacagggguucccagcacagugggacccacagaguggaggaaccugcaguccacuggaggggacacugaggacagcagauggcuuagaugccuggaucugcgcuggaaucuguggcuuggaaccacguagcggugggcaggcaauguggggguuuggauuuucucuggaagagcugggggauuggucagaggccuuaagcagaggagcagcuugcuuacagaggaagauuguucuucgaauauuagaccgacacucaggugugagggaagucccggaggaaagaagagaggguggggcccggcagggacggcugguaggacacggcccaggccugagagacaagggcuuggccuugccacccacaguacggcugugaaggaaggggcagugccacuguguugugaguuccgcgcugagguacaggugaugggggcccaggcaguuccccgucacagaguggagagcacgggcugugaggcuccugcucagauaggaaggagaugccaggcgcgguaguugaaguucccucacuuacuuuucuuuggcguauuagugcugagggugcugccugcccagaagaggauaaagggugagcguccuccagaggcuccagucucagagaggagacagaucugccagggagccccagaggaggggaggguggcccagggcagcgccggagggagccgguggagggggccgcuucagagcagcagccugcgcggugcguguaucccaccgcacucacuccucaucucagcgugcggggugagggugcucuucccauuuuaacagugaggcacgugggacacaagauagcaacauggugaccaagggcagcugauggagcgguuaaccccacaucuggaccccgcggucacacagcccagugcacacuccugacccagucacaugcaccucagauaucccuggaaaagaucccaggggcccugaugacaguugugagucugagccagaaguggggaaagggugggaaggguuuuccaggaacugugaauggcaggaacgaguaagguucuugggagggugugaguaucccaagaggaagugagugcgguggcaggcuccguccuagguccuagcagguggacuggcaguuaucauuuccucuccagagcucccuggagaaggcauucucccauuuuacccacgaguacaaugagccccagaccgcguuccugcgucacuugggcaguggugacaggaugcagacccaggccuguaggagcaggcagcuccuucugacauaccacauggcuccuucuaacacaccacgugacacucuggguaagaaggguccagacccaggccaggugugagaggcuuccccgcuuuaauaaccucuguuucggccagguaugguggcucaugccuauaaucccagcacuucgggaggcuaaggcaggcagaucaccugaggucaggaguuugagaccagccuggccaacauggugaaaccccaucgcuacuaaaaauauaaaaauaagccaggugugguggugggugccuguaaucucagcuacuugggaggcugaggcaggagaauugcuugaacccaggagacagagguugcagugagccgacaugaugccacugcacuccagcuugggugacagagugagacucugucucaaaaaacaaaacaaaacaaaacaaaacaaaacaaaacagaaaagcaaaccucaguuuugauucugaaaucuaaggcaagcaugagcacauguaauagggaaguaaggaaggcacagcggcaauagacugggucauggggaucagagaugcauggccuguuugcagggccuugaggccagcacuaguccaggugugguccguggacuggucugcaguaagaugagugcaccacuaggagugagcaucugcagacuuucauagcagcuuaauguuguugcgauauuuaagugcauggucauugauggugccucaaguaggguacagaugaccugucuuguggagucaugggucaccugugacauggagagcuuuuccuguauuauguuccucaucccccuaguagaccuguacauaggugcuguuacugucacuuucuugaagaggaggacacugagugucagagagguugagcagcuugcucaggaugacagcccaccccuauagccaugaagccuggcagcggccucucccucagcaccauuucagcucuucauguuucauuguucucagagcaggacugccagccucuuccugggcccagggcugcagcacccuuccuccuuagagagcgccaacuggguuugaggagugccagcaugcuaugggucagucccccugaaaccuggacucauaugcuagggauuauuaaccauucagucccuuugaaacuugugacuuuugggaagaaagagagacagauaggagaagauagguaaaauuuggauguccauagucuccauugauuuaccuucuuuucuguucuagcaaaucgaagcaaaggauuugcacaaguucuuuggaauauaauacuuucuaaacagccagugcugcaccuccugggcagacaggcaguggacaccgcugugugugacuguugcuggcucacgcauucguuagugucuuaaggauguccagcccuggaggaguguguguguguguguguguguauguaugugugcucauagacuuggaacguuguguggcucaucuuugggaggugugcugugcagccugucuggccuaagggcagaaagauaugaggugcccaccggcaacaccuccccuuggcuuuccuggccuaugccauucaugggugaggaaagcuguucagauguugccucccugacuccaugaagauugauugugcuggggagagucugaguggagaguaucuugggguagaggaggaagaggagagcugagauaugagaaagggcuuaugugcucggacaaguggauuugaccucagagcuucgaugucaucugugcucagacaaaggcacuguaggcuuguuuacaguuuuggaugguacaguaucauguuaguggugcaguuguuguuauuaacuccugagguaggaugagacucaugcagcaugugaagugacagggucaacagugaaaauuuacacauuugcaccauuuugcagcuuucggagucccaacaucuguguauucauuugacaugacaugcucaugagccuggugggcaagcauuucuuucccuacuuuucagauggugaaugagccaugagcuaaguaagagcaauggaguggccugccuugcucacaucugcuuuguugcuggggugggggaugcccuguggccccagcccauguguuaggaggucagagcucagaaaugguggagaaugucauugcaggagcaugcacaggcagcaagcugcacaauuagcccugaauagcaggccaccucuuaaagcaugcccugacaacaaaggugacuggguugaagucuguagguguaguaguuaccuauugcuacguagcaagucucccuaaucuuagcagcuuagcagugggaauggcuuuacugggugguucugaugagaauuuuagguuguaacuaugcuuagagucauaugcaguggcuggacaguggcucaguuuuugccaacuuuugucaggaugccucagcucuuugccauguggccucuccguaugccugagugucuucacaaaauggcagcugacuuccuguagagcaugugauucaagagggggugcaaggagcaaugcaaggccuuuuaugaccuagccuuagaagugauacacugucacuggcuucauacuuugucagaagcaagucacuaaguccagcccacacucgggagggaaauuaggccccaucuuuggaagagauuagucugaaacauuuguggucauacuuugacuuaccauagggcaauauggucuugauugucuuuucccaaagcaacuugguuaagcuccuagugaagacgcauuaaaaacauacaucgaguggccucugaagaggagacuuuuuauaaccaaaucccacugauacaaaccuuucugaugguuggcuuuuccauguaucaagggcugcaugugguaguuuucuuuauagaaguauguauuguuguuuauguaaagauuuucaaggccaggcaugguggcucaagccuguaauccuagcacuuugggaggcugaggcgggcagaucaccugaggucaggaguucgagaccagucuggccaacguggcaaaaccccgucucuacuaaacauacaaaaaauuagcugggcauaguggcaggugccuuuaaucccagcuacuugggaggcugaggcaggagaauugcuugaacccgggagacggagguugcagugagcugagaucgcaccauugcacuccagccugcaugacagagugagacuccaucucaaaaaaaaaaaaaaaaaagauuuucaaaaugaugaaacuuagcuuaccauguuaagaacaacaacaaaagaucucagguacugaaaggugaucacaugccacaguugggacagucccaguuaacaccuggugugauuccuaauaaugccuauuucaccuaccacauugcccugucuggacuauacauguuaugauugcucagccuugaugcugagucuaccuacguaaaaaugagggugggauucuuccccgguggguguuaaccagggaugugcagccgagucaccgaggagcuuuggaguagaaacauaccucagcucuuugcagggggaugcugccugggccagcagagaggggacucaaaagaggguuugagggugcuucccuggugauucagacguccagccuuggcuaaagaugauccuuucauucaucauucaguauuacacccagccaucaauuccuuaaauguguauuaguugagauguuguuccagcucccaagguggccagccugggaguucuauuuaguugaaaagaccugagugcauacagcauggucguuuuccaguacaagaauuuccucuucaagaaauauguguuuguaacgcacuucacaugguuuaaccaaauugcuuuggaaaaaggcgguccagcccagauugaaagcaagcucucguccuauacuuagcaccucccugugaguaaucagcaacaucaaaaugcccauacauccuugcaagcaaacaucuaccaugaaacaaaaacuauuccguaaaauacuuucagagucauuuaucaaauugauuugcugcaguauuauuugccccccaaaaaaguuaucuuaaguuguugaucaaaaaagaaaugaaauauuuaacuuguguaaaauaacuuuacacaaguuaacuuugguaaaaaagcaaaaccaaaaacaaaagaauagaagaagaaaguaaagccaagcuuaauuaaaaaaaaauauugcacgccuucauuuaaucaaacaucucccauguuaggacaaacuuuacauuaaaauaauauguguaugauugucucuguguugucauauuguccuacauauuaugaagguuuaaauaugaaaugauccauuuuucugauguaggaucauuuuaaaauggauuuauuuaauuggcucaugaguuuaaaaaacucaguauuaauuaaaauucaccuaugugcugauaucaugggugucccugcucugacagaucccacaauaaagaagggaggacugaucucuaaaguccauuacaacaaguguuaucauagagauaugugcaaagugcuucaugaacacccagaaaagaaggagcggagcaguuaguucuacuuguaggguggggcuuagauaagucagguuuauuuuuauggaaggccuucucagaaaaucauuuugcugaagcaguucuuaaauauaacacuccuuccagaccuaagccccagccaggccagacaagcuguaacuaucccuaagauuagcuuauguaaauaguagcuuagggauuacucagugaggguuuuuaaauuuucauugaucacuuaggaggguaaagaaguauggagaagugcagacuucugugaggcugccaggauuugaaauuuuucggaaagguuaacaagaaaguugagauuagguuggccacaaguucuugggcuuugauggcaguuguuggacacaucaucuguagggaccuacagaaggccagaggcacagaacaguuaacacagaaugugaacugauggcccuggaaggguguuguacauauccuugucuccaggaugucguguuugcuuugcugggugugucccaauccuugcaaaguaguuguugucagugacagucugaaaggacaggccuguaucagugacucuguacuacauaucuaggcauuugcaagauuauuucauuggucccaguuaauugggcaguauuuuuuuugaaaaauguuuuuuaauguauguauuuuuaaucguuauuuuuuugcccuaauuucugggauacaugugcagaaugugcagguuuuuuauguagguauacaugugccauggugguuugcuacaccuacuaaccugucauguagguuguuuuuuuuuuuuugagccagagucuugcccugucacccaggcuggagugcaguggugcgauaucagcucacgacaaccucugccuccccgguucaagcgauucucccuccucagccuccugaguagcugggauuacaggcaucugccaucaugccuggcuaauuuuuguauuuuuguagagaugggguuucaacacguuggccaggcuggucuugaacuccugaccucaggugaucugccugccucggucucccaaagugcugggauuaugauugagagccauugugcccggcccgucauuuagguuuuaagccccucaugcauuagguauuuguccuaaugcucucccuccccuugccccuaccccgcaacaggccccagugugugcuuuucccuaauugggcaauauuuuuuaaaauaaacaauuuugauaacuuuaaauaagugauaccaguaaaacuuuaaauucuauauaaauggagcauagaccauguacaaggacaaugcuagaucuacaggggguauaaaaacaugcuuauauugcuggaccccaaggaugacaugguuugguuagaggcuagcaauaucaaguacagaaaaauauuaaaccuuuacuuagaauuaagaccaaaaugguuuuuuuuuuuuuuuuuuugagauggaguuucacucuugucgcccaagcuggagugcaauggugcgaucucagcucacugcaacuucugccucccaggcacaagugauucucccaccucagccuccugaguagcugggauuauaggcaugugccuccacacccagcuacuuuuauuuuuuuuuuguauuuuuaguagaaauaggguuucaccaugugggccaggcuggucucuaccuucugagcucaggugauccaccugccuuggccuccuaaaguacugggauuacaggcaugagcucugcgcccugccuuuuauuuauuuauuuauuuuuauuuauuuauuuauuuauuuauuuauuuauuuauguuuugagauggagucucacucuguugcccaggcuggagugcaguggcaugaucucugcucagugcagccucugucucccagguucaagugauucuccugccucagccuccugaguagcugggacuacaggcaugugccaccaugccuggcuaauuuuuguauuuuuaguagagaugggguuucaccauguuggccaggcuggucucgaauuccugaccucaagugaucugccagccuuugccucccaaagugcugagauuauaggcaugagccaccucgcccagccuaagguaguucuugacuguugaaaaacuuaggcaaauagcuacagacugagugccugucacuuauauacugggagcacugugcaugauccagcacccuuaccgagcaugggacgaccugggagcacugugcgugacccaggaccccuuaccaagcauagaaugaccugggaacacuaugcaugauccagcaccccuuacugagcaugggacagccugccuuguagccagugucuguugguucucacuuauggaugaauuucuucuuuuuccucuuugugauugagaagguguacuguauuuuggagcuacuuuacugagggauauuuauguacaauaaacuauacauauuaaggcauacagcuuuaugaauuuugaugugugugacacccuugaaacuguuaccacaguugagauacagaaguuuuucuguugcugcucaaagguuucuugugcuucuuugcaauccauuccucccucuccugcgccccucaaccaccauugaucuguuuuauuuauguagguggcaucuuuuugucaaauuuuuucacuuggcaugaugauuucauggugucucuauuguucaucccucuuuauugaugaacaguauaccaucauuaauuuacaacaauuuguucucccauugauugacauuuagguuguuuugggguuuuagcuauuacaaauaaagcuauuaugaacauucauuuauaguuuuuguauggacauguauucccuuucuuugagguaaauaccaaggaguggaauggcugagucacauuguagauguuauguuucauguuuuacaaaacugccaggguuucuuagcugaaaaguaauuuggugaaaacaaaacaaagcaaacaaacaacuacaaaaaugccaggcuguuuuccaaaguaauuguuucuuccucuucuagcaguggaugagaauuaacaguuguugggucagucuuuaauuuucaccauucuagugugugugaaguuuauugaauuuuaaaucuaaacuuuuugauuuggcgcaucacauguguuuaguaacuuauuccuucaauucugucauugugucacucaagggaaaguggaauccuggccccaggguagcagcagccuuggcuguggggugcaugaaaccugugugcccaggccugggauacgugggcaucccuagagggcccugcuccucuuuacucagggcugcucggggccugcaggggcugcaaagaguugggcuugggcaagccacgggccuuggaaggagcuuugcuuucuaggcucuggaguguggagggaggaggggacagaacaagaucccagacaggagggacccuccacacaggggagugcucagccuggucucccucagagcuggcagcaggucucacagaugugugcugaagaggcuaaaggagaacagcuaccuagaaaugcacaagaaugccuuuugcgucagcaaauagaaugugucccuuucuaauaccuggcuucaggaaauaaaggggccauuuaaagaaugugauuagguuggcugaauuauguuuuuccagcuucugauggacguuuuuuaaugucuuuaucagucauauuuaaauaguacucauucuaaucagauucuuuaaaacauaauacucuuggaauggaugacuuuuuaugggauuuccucaaauauaauaaucaacagucauugauuugaagauucauuucauuccauucaguggguaccuuaaaaugacaaaauggacauggaaccuuucaaauguaaauaaaagcagagaacauaguaaagaaaucguauggguccauuaaugagcuuuggcaguuuuuaacauuuggcaauucucccacuuuuuuuuuuuuuuuuugagucaaagucucauucuguugcccaggcuggagugcaguggcacaaucucggcucacuacagccuccgccuccuggguucaagagauucuccugcucagccucccaaauagcgcccuccaccacacccagccaauuuuguguuuucaguagagacaggguuucaccauguuggucaggcugguccacagcuccugaccucagguaauauaccuguuucagccucccagcaaugcugggauuacaggugugagccacugugccuggccccacuucuuauuuuuauuuuuggcuugaacguuuuaaggcaaaagcuccccauucuaucuuuucauuuguaaauacuucugugcugauugugcacugauaaaucuuacuuuuuuuuuugagacggagucucgauuuguugcccuggcuggagugcaauggcguggucucggcucacugcaaccuccacuuccuggguucaagugauuccccuuccucagccacccgaguagcugggauuacaggcauccaccaccacacccagcuaauuuuuguauuuuuagcagagagaggguuucaccauguuggccaagcuggucuugaacuccugaucucaggugauccgccugccucagccucccaaaguguuaggauuacaggcaugagccaccaugccuggcuugauaaagcuugcuuuuuuaugacugucaccucauuacccugccugacaguaauuccuuaaugacagcuaauuuccuguccauacuuaaauuucccagauuguguucaagguaacuuuuuacaguuguauaugauccuugugcuaggacuccuggcuaggacuuuggaagacacagagguuggccucagcaaucuccuuucuggugacucugugaaugugcccucacaguucaugucuguaucuucuggucacucagacaccccuugugugucugugugccucagccuugcuugugguccccgagaugccuguuccccgcugugccccucagucuuucuucgcugccucgcgauggcuugcuggcucuaacagggauuucugcuuuccuugcucuggcgcuccaugcagcuagccguucaucuguuuauucagucauaccccaaggguugugagccccuggcaggaaugggcacugugcaaggugcuggagaccuaaagaagacguggccuuugcucuuggggaggauggugaggggcagaggcagauuccaugcaguacagugugguguugcuauggcagacaccagccggagggaagggcacacaccuggggaggcacccugcuucagggaguggcacuggaguuccuaccugaggucaagguguucacauggagaggggaguaugcauggugccagaaagggugcuggcccaggugucugggggaagugggauuuagcauauuaguauucaggguuauuauuugagcaguuuaaucuuccugaaacucacaaggaggggccgaggcugagguugugugggaagcuggagagaaagucagggcaguagggagcccaggaaggcuuaagcaggguggggcgagccuaaauuugaauuuagaaagauagcacacaucuuucacgcacccuuuguucugauaucuguguuuauuuagggguaaacuaacuucugauuaagacaagauuuaaaggaaggcugagcacaaaucauuuuacaauguagacaagcuuuuuccaagccagcaaucugaguugugacauugcagguuucacauuaucucugcuggaaaggacccuggugaucacccggccaggcauucuaguuugccuguuccuucagaauccauguuccccaaugauuagcagucagauuucaaaauaaugcaaauuagaugugcugauggcacacauuguccucugguaaccaguagcacauaauuuaugccacuggcauugugacuugcccauucuauugagucucugugauugguguaugcauuugauuguguuugcucaaguccaaguguugaucuugagcagucaccaccuuucauucagguugcaaauaugaccacccuaagguuacugcugcucauguggaacauuuugcuuugcagcaucuuagggguauuucuguuuuccugagcugccauuuuucucuguaucucauuuguuuucccaaggcccucguauagggcuggcaugcaggaggaugaacaaaaauagacacaggaaaccaggccaaagaaaggcagagaggggagagauaucagccaugaaagcaaaucuguguccugcaauugaacaucaguucggucuuuauguuucugacaagcugggcaacagggaaacaauaauuuccauaguucucauuauugaaaguaggacaaguugcguuuccucaaaggaggcgucauuguuuuuggcacugaaagguaauuacuuguaguuguuuguucugaucacugcuguucacuuccauucuguggcuugcugggaguguucacauauaauuugcagacauuguuagcacagcuacugugugcaaggcacagaaguguuugagacugagucuuauuucuggaauaaggagagguggcacucuaggacgggagguaagcaggagagcagaugggcaggaucagcacaugaagguccucugagcccugcugcccggcagagcuccguuguaggcaguggaggagccauggaagaucauaagcuccuguuuuagaaaacaagcucuggcugcuuuguggagggccacacccgagugcagugacacaggauccagggagggcugagaggaagugucagcaggagggcagugaggucuguggcucugggagccuagagucacuugggaggugacuuaggagagcagacaaugagaacacagagagggaaggacacaaguauguagaacgacuugcaaaauaaucaaaugauagacuuguucccaauuguuauaacaucauuuguugaaaagacuauuugggaaagaauaacaauuuaaaaaggaaacuguuaugaaacaaucaguugcuguccauuccucacuggacccugagcaccagugcggugggcaugcugggaggagaugcugcugacuuuagacuaugcagggcucuguucuccuuucucucugugcuaucauuaugcacaaguggaaacaagacguuuuggcccugcacuccugaggacuauuuuauauuguucuuuacaguuuuaacccugaugacuucuuauauuguucuuguucauauuuuaacaaggacagguugaguaaauuaguugcauacaauuaguugaguagguagaagaguauuuccauagauauccaucuugaagacuaguauuugaauucaguucuuauuucccauuuguauuuucuaaaauuauuauuuauuuauuuuauuuuuugagacugaguuuugcucuuguugcccaggcugaaguacaauaacgugaucucagcucacugcaaccuccaccuccuggguuuaagcgauucuccugccucagccucccgaguagcugggauuacaggcaccccccaaccaugccuggcuaauuacuguauuuuuaguagagacaggguuucaccauguuggccaggcuggucucgaacuccugaccucaggugagccaccugccucggccucacaaagugcugggauuacaggugugagucaucacgcccagccccauuuucauuauuguuguuuuuucuuucuuucuuuuuuuuuuuuuuuggagacuguugcccaggcuggagugcaguggcgggaucucagcucacugcaaccucugccucccggguucaagcaauucucuuguuucagccucccaaauagcugggacuacaggcgccugccaccaugccuggcuaauuuuuguauuuuuaguagagacaagguuucaccuuguuggucaggcugaucucgaacuccugaacucaggugauccacccgccucggccucccaaagugcugggauuacagacgugagccaucaugccuggcccccauuuguauuuuuuaaauuuuacuuuuuaaaccaaaauggaguccaguugacuucuuucauaauuccaugaauuuuaacaugugcauagauaccacaauuagcacacagaacacuuucaucaccccagcauuuucuuuuguucucuuccuggcaaccacugauuuguucuccaucacuauaaucuuuuuugagaaugcccuauaaauggaauuguaggguauaaccuaaccucuuucgcacagcauacugccuuugagauucagcuccuuucagucaacugucaguaguucauucauuuuuuuuucuuuuuuuuugagacagagucucacuuuguagcccaguuauuaugcagagucaucuucuaucauauggguccaccacuguuuguuuacccauccacccauugcaggacaucuggguuuucuccaguguuuugugagugugaauagagcugcuauaaacauucauguacagguguuugugugaaccuacaguuucauuucuuuaggguaaauacccaggagugggagugcugggucauaacuauaugcauaaaguguuuaacauuuuaggaaauugccaaaugguuucccagagugucuguaccauuuugcauucccaccagcagugcaugagagcuccaauugcuuuguauccucaccagcacuugauauuuuuaagauuguuucauuuuagcuauucuuauauauuaguauuacaucaugguuuuaacuugcauuuaccuaaaggcuaacgauggcgaagcuuuauguguuuauuuaccauccauaugucuuuuugggggaaaucuuuugccugucuuuuaagucuuuugccuguuuuucaaaggguuguuuguuuucuuauucugugggauuguuuuuauuuuuugauuuuucaacuuuuauuuuggaauaagaggguucauaugcaguuuuguuacauggguauauugcgggaugcugagguuuggggaauggcugauccuauuauccagguagugagugugguacccaugcuccucuccuuuccuccccaccuccaacaucgccagugucuguuguucccaucuuuguguccauguguacucaauguuuagcucccgcuuguaaguaacaacaugcaguauuugguuuucuguuccugcauuaauucacuuaggauaguggcauccagcugcauccauguugcugcaaaggacaugauuuaauucuuuuuuauggcuguguaguauucgaugguguauauguaccauauuuuuuuaauccaguccaccauugaugggcacuuagguugauuccaugucuuuccuauugugaauaguguugcagugaacauaugaguggcaugugucuuuuuggcacaaugguuucuuuuccuuuggauauauauccaguaaugggauugcuucauugaaugguaguuaugcuuaaguucuuugagaaaucucuaaacuacuuuccacaguggcugaacuaauuugcauucccaucaacaguguauguauuccccuuucucuacagucucaccaacaucuguuauuuuuugacuuuuugauaaucaccguccugacuagugugagauggcaucucauugugguuuugauuugcauuucucugaugauuaaugaugaugaacaguuuuuucauauguuucuuggcuguuuggauauuuuauuuuaagaaguaucuguucauguccuuugccauuuuaaaauuagauuuuuuuuugcuuuuuuuuuuuuaguuacuugaaguuucuuuauauaauguggauacagcuccuaggucauaugugauuugcagauuuuuuuuuuucagucaguaucuuguguuuuuauucuuuagcagugucuuuggaagaguagaaaauuuuaauuaugaagaaguacagcuuuuuuuuuuuuuuaaacuuuaugcucuagacaugauuuaggcaccauaucuaggaacucuugccuaacccaggccaugaauauuuucuuggauguuucuucugaagguuuuauaccuuuacuuuuccauuuagaucagugguccauuuugaguuaauuguuguauaaggcaugugacuuaggucgaaguucuucugcuacuucucauuuuucuuuggcauaggguauccaauuguuauaauaccauuuguugaaaagacugucuuucgucuauuuaauugccuuuacaccuucauaaaaaaucacuugaauauauuuauguggaucuauuucuugauugucagucuuguuuaauugauuuauaacuguugcuucaccaauaucacacuaucuugaauacuguagcuuuauaguaagucuuaaggcuauguaaugugauuccuccaacauucuuauuuuucaaaauuaguuuggcucuucucauuucuuugccuuuccauauaaauuuucagaucaguuugucuaugucuacaaaaacagccaugcugagaauuugaaauuuuguuaaaucuguaaaucaauuugagucgucugaccaaugaauauaugucucuccauuuuucuagguuuucuuugauuucauuaaccaguguuuuguaguucucagcauacaaucuuacccaugucaacuagacuuauaccuaaauacuuuacuuuuuugguagauguuuguaaauggcauuuuaaaauuuuaauuccuaauuauggauuguuaguauagaaauauacuugauuuuuguguguugacuuuguauuccaugagcuugcuuuaaacucuaucaauucugugaggauuuuugcuuuuuuuuuuuuucuuugcagauuccuugggauuugcuauguaugucuagaaaaaaggugugguuuauuucucucuguccaaauuugaugccuuuuauuuguuuuucucuucuuauuguacaguguagauuuccaguaagaaguugaauagcugggcacgguggcuuaugccuguaaucccagcacuuuaggaggcugaggcggguggaucacgaggucaggaguucaagaccagccuggccaagauguugaaacccugucuguacuaaaaauacaaaaauuagccaggugugcuggcacgcuccuguuuucccagcuacuuaggagucugaggcagagauuugcuuaaaaccaggagguagagguugcagugagccaagauugugccacugcacucuagccugggugacagaccaagacucugucucaaaaaaaaaaaaaaaaguuggauggaaguagugagaauacacacucuuaccuuguuccugaucuuaggggaaaacauucagucuuucuuugugaagcuugauauuggagguagguuuuuuuauaccuuuuuuuuuuuuugagacggagucuugcuuuguugcccaggcuggagugcagugguacgaucuuggcucaccacaaccucugccuccuggguucaagugauucuccugccucagccuccugaguagcugggaguacagaugcaugccaccaugcccagcuaauuuuuguauuuuuaguagugaugggguuucacuauguuggccaggcuggucucgaacuccugaccucaugauccaccugccucggccucccaaagugcugggauuacaggcaugagccaccaugccuggccuuauagcuauaguuuaauaggcuuaggaaguuuuuuuuuuuuauuucuaauuuacugagacuuguugauacugaauuauaucaaaugcuugucuuugcuuugauugauacacgcaugugauuuuucuucuuuaaacugucaguauggugaauuacaugaacugauuuucaaauauugaaccagccuugcauuccugagauuaaaccuccuugauuguaguguauuauucuuuuuucuuuuuuuuuugagacggagucuugcucuguugcccaggcuggagugcaguggcgcaaucucugcucacugcaagcucugccucccagguucacaccauucuccugccucagccucccgaguagcugggacuacaggcacccgccaccaugccuagugcuuuuuuuuuuuuuuuuuuuuuuuguauuuuugguagagacgagguuucacucuguuagccaggauggucucgaucuccugacuuugugauccgcccaccuuggccucccaaagugcugggauuacaggcaugagccaccgugcccagccuauucuuuuuauauauugcuagauucuauuuuuuugaggaauuuugcaucuguauucaugagagauauuuguguauaguuuucuugugaugugucugucugauguuauugguguuuuuucauuuuuuguuuuucauuuuaaaugcuuaguaaaauuggccagugaaaccaccugggucuaaaaauuucuuuuuucauaauguucuuaagcuacagauuuggccagaugcgguggcucacaacuauaaucccagcacucugggaggccgaggcaggcggaucaucugaggucagguguuugagauaagccugaccaacauggugaaaccccgucucuacuaaaaauacaaaaauuagcugggcgugguggugcgcacauguaaucccagcuacucaggaggcugaggcaggagaauugcuugaacccaggaggcacaggcagcagugagccaggaucgcgccccugcacuccagccugggcaacaagagcgaaacuccaucucacaaaaaaacaaacaaacaaaaacuacagauucaaauuuuuaaauggguacauuugaauuaucuauuuaaucuuuaaugaguguauguugguagugauuuuugagaaauugaucugugucauuuaaaguugcugaauuuauguguguagauauguucauagcauucccuuauuauucuuguauugucuguggucucuguagugauaucuucuuuuuuauuccucauguuaguaauuagugucuucucucuucuuugucauucuuuuuauagguuucucagauuuauuauaaaaaaucuuuuguggucauuguuuucuauugccuuuuuucuguuucagcaauuuccuuguauaugauuuggguuuguuuugcucuacuuuuucaaauuugauuuaaauggagguuuaaaugauuaguuugagaauuuuccucucuuauauacgcaguuaaugcucuacauuuccuucuaagcacuucuuuaucaucaucccaccagucaugauuuuuaaaagcuguaugcucaagucccucagaguucucuuucuccaugcauucuguagucauauaugauuacauuuccaaguguuuauagauuuuaugguuaucuuuguuacugauuuccggucuaauuucaguaugguuagagaacauacuuuuguaugccuuguaauuuuuuuuuuuuauauuugguaagguuuguuuuaugucccaggagauugucuaucuugguuaguguucuauuugcuguugaaaacaauguauuuucugguacaguuggguagaauucuaguaaugucaauuaaaucaaguugguugauuguauuugugaguucuucuauauuccuguugauuuucuguguaugaguuguauugauuuguaagagaguauugucucaaaaguuaauugugguuuuaucuauuucauuguuguuguaucuauuucaaagcuucauugucagguguauugaaguuuaggauuguuauaucuucuuguugaauugacucuuuuauguaaugucucucuuuaucccugguaauuuucuuugauuugucugaugucuguacuuugauauuaauauaaccaucccagcuuucuuuugaguaauauuuguaggugugguuuuucaucaguuuaccucuaaccaccuacauaaucauauuuaaagugaguuuuuugaagauagcauguaguuaaauaauaucugucuuuuaguuggauuguuuagaccauuuacauuaaauaauuauauuaaacuauuacguuacaucaaaucauuugcauaaaugaaggauaauggccuaucaucucuacugauauuuuuggauuuagaucaaccauuuaacuauuuuuuucuuuguugccugacuugcauucuuguuucuucuuuccaaucuuugaguuguuugagauuuuuuaguaucuuauuuuaauguaucuacugggauuuuuaguauaucccuuuguuuauuuucguggguuuucuagggauuaaaauaaucaaacuucucacagucuccuuagaaucaguauuuuaccauuuauguggaguauaacuuacuauuacauagguauccuucaugguuauguguuacaucuacauuuuaaagaacucaaaaaagaagaaucauguauuggccuagauguuuaacaugucuguuccuccucauguuccaaguuuucuuuccauacuauuucuauucuaucugaagaacuuacuuuaacaauuauucuagaacaggccugcuggcagugaauucucuuugccuucauuugagaauaucuuuguuucacugucauacuugaaggauauauuuacuggauauaguaacaugguuuacaguuuuuuuuuuuuuuaucucaguacuuuaaaaguuguuucgacuucauucuagccauuguaguuucuguagucauucagauuauuuccauuuaagaaaugucacuuuguuuuggugauucucaagguuuuuuccguguuuuuaguuuuaagcacuuugauaaugaugucccagagugugggcuuuuuuuguacucauccuguauaggguuugcugaacuacuugaaucuguuuucuuucaggaaguuuugugaaauuugaaaaguuuucuguuaauuugugaaauauguuuuguguaccacauuauuuuuccuuucuuucuaggaucccauugacaugaaaauuagaccuguugguauugccccauaggucccuaugccuguucauuuuuacaguccuuccucuuuauguuguucagauuagaugauuucuguugaccuguaugcaaagucagugagucugcuguugagcccauuccuugaguuuuucauuuuaguuauuguauuuucaaaucuaaaauuuucuuuuguuucuucguuauaucuucuauuucuuugccaagacuuacuaaguuuucauucauuucaagcguucuugcccuuaacuuagagcauuuuuauaaccuguauuauuuccuagucauuuuguaaaccucuauuauuuccuagacauuuugacuauuucauuaugguacucuggcucuuauuuaaagcuuauggagaauguugacauauauaauuuuuaaaucuggcaauugaccuaguuggguucguguuuaaauuucugcugggcccuuugugcuugucauuucaaugguaguuaaguuugaaagucuguacagugcucuucagaucuucucauguuucugcuaccgguggccagucugggaacuugggugguggucuguucaguucuuaaagccacccaggaccagauccauacgugugcaguuuggggacgcacccaggaguucacaaaugacuuuauguuguuccucccucuccaaagugucucagugcuuucuacuucccuagaccuuuccuuuuugugcuccagccagaaaacuaggcuuuauuuacccugcuuugcugcacauauccugugacugcaccuacagacggggcaaagcagcagcagaaaagagaaaggagaaaaaagcagugggguuuacuccauccucuugggaccacagcuccucugauccgagagaagaguuuuccucuuuuuguguuugaagcuuugcgagucccugugcugccacuguugcugucacccacucugccaccucaggacugcuuguggacuggggcucauaggagcagggagaugagcauaauagagaauucucccuccucauuaaacauuaggggacccauucccuucucuuuagcccagcacuagaagguuucucuuguagcucucucugucuaagccauugcccacugcccagguuucaggcugcauugaauccaggauugggaaaaaaaaaauguuaaacugagugcuguuuucgugguacuucgaauucuggucucuaaucccaacuucucagagucaucaaauagcuguuccuugcauucuggccagauuuuuuuugcugcucuauguggaggagagagggcacaauguguuauuccaucuaaaugauuuuucuuauaaagugcauguuccuguuauauucaggcaauggaauauuauuuaaugcuaaaaagaaaugagccaucaagccauagaaagacauggaaaaaccuuaaauacauguuaccaagugaaagaagccaaucugaaaaggccacaugcuguaugauuccaacucugugacauucuggaaaaggcaagauaagaucaguguuugcuguugccaggggucaggagggggaaagagcaggaacagaggauuuuuagggaaaugaaaauacucuguaugauacuaugaugaugaauacgugucauuguacauuuguccuaacccacagaaugugcgacaccacaggugaaccuuaauguagguuguggacgcugggugauaauaauguguccacagagguucaucaguggcaacagauguuccagucugguggggcguggguugucggggaggcucugcauguguaaggucagagggaauacgggcaaucucugcaccucccucucaacuuugcuuugaacuuaaaacugcuaaaagaaaaaagucuauuuuagaaaaaugugccaguugauuucauauuaaaauaauuggagaaccuggugaauauaguuaaaaauuucaggugauuuauuuaauaacaaagaggaaacagaauuauuaaagaaaguauaaugcacguuggaaguacauggaguaaaugccacccauucccuuuagucuuuaguaguuagucauggcucucuuaauuagcuucuuccauacauuuuugggauuauaucccuuaugaccagggauuuaguguagcuacuuugaaagaugcugaaacuucaugaugaauuuaaaaugugugccacgccuuucccauacauuugucaggcagccucucuguguaucacuggguuuuuagaaagccaagccauaggauuauucacugucagugcaggacuaguacacagggcaggcccugaugguaauuugaguaugacaacagcuguaucacuccuuacaggacugcaagugucuuaggagaaaagcauuuccccggccaccugccgccugcugcgugggugcugugauuagucacaaugugcauugugcuggguguguuuuguaguuuuguuguuccuguaauugacaguuaucuccaaacugaaaucgucuggaaaagcagaugcuacacguugggggauuuuaauuuuccuguucucuagaugauuggugucauuuucauacuguaaaaaagugugcuguuauuuuugcuuuugguagaagggcacaugguggggcuggucuaucacugccuggauuuggaggcuugagucaagaaccugucuaggccaggugccguggcucacgccuguaaucccagcacuuugggaggcugagguggguagaucaccugaggucaggaguucgagaccagccuggccaacauggugaaaccccgacucuaauaaaaauacaaaauuagcugggcgugguggcacacgccuguaaucccagcuacuugggaggaugaggcaggagaauuacuuagaacaugggaggcagagguugcagugagccgagaucgcgccauugcacuccagccuggcgacagagugagacugugucucaaaaaaaaaaaaaaaaaaagauccugucuaaauauagcaugcuugucuccccaggcagcugggaggaggggccugcaugaucauagaugagggugccuuguccaccuggcucugggcucucacugagcaugcucuuccuugggacggcuucucaauucagcuaaucuccagauuagauucacccuguuuggugugcaugugugugggagucucugugaauguggagcuucuaaauuuauuuaucauuugauacggguauugcguucuaguauuugcagagcuggcacucaaggcuggccacuauguuuuuaguucagagauaugauucagagagaugauuguaguugagacgucccuaggggcccgcuguugauuuguugugucucucugcuguacuucacgcaggcacagagaagagaucaguaaauaacgaaaugaaucugcccuaugauguugacagauauguccucucuuacuugcuaguuccucagaggcagcuugggaauauuguuggguggucagaaaguauuuagagagucugggcuacaagugacaugacuugucuguccaucugcugugccucuugaguguucuuaccuggcucugugcccccugcucucacaaugcccugccgugcuggaucccuguagcaacacuguaggggcggcauuguuaccaccuccauuuggcaguguagaaacuacaaugggcagaguauuccacccuuguaucucucuagcagcccguccaucccuuccucuagcccgcuguccaacuugcuauuuguuagugucuaauauacacaccaugaauuagcccaaagucgggugggcgggaugagggcaccgacucuugcugcgugugagcugaaguaucagagagagauuaccacugugugcucaacaguccugucgucaauuuuuaaagauauauuuuuuaacuuuuuauuuuggaauaacaaagaauucccacgucgucuucagcuagaugccacagauguuaacagguguguuugcucuauucucucucuccuucccucacaagcacauguguguauuuacacuucugcaugcacacaugcacacacacagaugcacacacauaccuucucucuuagagcaaggcacacauauucaugaacucacccucaggcuuccgugagagcagaccuagcccauuuuaacuuagucggucauuggcuugggucccugcgcauguguggccgucauggaaacagggaaggccuuguucugugccuuggcaaugagcaucccuggccuggcucugggaaggaugacuggccugugauccuuuccuccaggugcugcuuugguagagguugaugauggggccucaguggagcuggugugaggacaggagggcugugucauugucuucuggcccucaccaucuguguguucgcugcucccagaugcaucuccuuuucuguggugcccucuccuacauuucaccucuuagcuggucaaaucuuaugagccucagcugacuccucucccuuguaugguaaaagccaccucugaacucuucccuuucugggcccaggcacccuuaagggccagccaacaccagcguccagcuuuccagaaugcccuuggguuuuccucccaucuccuggaggugucuuccuucuuaccugccugcucacucugcaaggccuguucacaucuccccuuugccccacacagcugcagcucccagccaccccagcucagcccuggcaguguuuacugcgggcaguggguugugucugugucuccuuucaucccccacaccuugugcagucccuggcggguuggagguguuccuuaaagcuuguggaagguuugaacgauaaaugacaaggacuggcauuaucaagaggggaaggaaaagccugaaaagcaagaaagcccacaguggauagggcuuguggcaggcaaggccaccugugugcagucccuggguauggcccguccccggccggaggagcuuccacagggugacuccuuucauagaagcucagguuccauucgccuuucccagaaggaaccccaggacagggcucccaggaagccacagcaggaccaacuuacauagcucuuggugcugcugccuuuuacugccacgacaguccccagccucccugaaacaguuacucauggauuaagaaaugucugagaacagcuucaaaaugugcugugcaugagugcugucacccagcccauaucugugaaugccaauuaaaaugggcuccuuagaauuccuguguuauuguaaacagaagaaguugcauggucccagagccucagugcacauuuucauuuaugagcuugauauuuguuucuucaaacaauucuucccccaauguuuaucauuuagaaaagccaaagggcuuuuguaggaaaaaggaugaggcucauuuccauugaagaguaaauauaaggaagauaagggcuucuuuauuaaaacagacaaccucacaaaaccccggcagagcaggucagaggaaaagaaaacaagcaggggagagagaggccuacagccccuaaucaggcuguggaaacauucucaucaaucagcauggagacaggggccuugauuuuccacugugaggggaagguggaaucgccagccuucugggcucuguguuuucaccguuguugggacaggccuccugggugggcugcgugcggagcucacaagagcagucacggcuggugguggcugguggcggcugguggugguugguggcggcuggugguggcugguggcagcugaugccaguggcggugguggugguggcagguggagcuggagugcacuguugcugagggugccuugagagagacccaggggagaauuccccccagaccugcucugcaugggcugcggugaccacauguggccguggagcugggaucucagaacagccaggcccugucagacagaacuggaggcagugguuccccagcaaucaaaaacaaauccucguuguaaaaagggaguacugaaccuugacauagaacuuucuucaauuucgcacagcauuacuggcagagggaaaaaaccaggaggauggaggggacuugugccucaaaauuuggauacaaaucagccuuguucuugccucucccucagguccuuugcaggagggcagccuggacacugugcaacuguccccuccacagccagcccuugggccucuccccuccagcccgcaggggugaccccucucucucaugugcagagcagaacaaacauggagcggcuccacgugcgucccucaccuguccugagccucucccguccucuucagcccugucuuuguugcuucucacugcucugucucccuggaagauggagguucaggcagcaaagaguugaauugcacggccagaugauuuguauuuuaauuuguuaauaucgguguuucccacuucagacaaagccaugugcguacauaugcagaccuaaaaaucaaaucaaaugauugcuaucagagaauucuuuuuacugaaaguaucucagaaaacccugaaaguaucucagauucccaaaugcugaucuucuaucuuauauuuuaaaacaugacugguuuacaaaaauuaauacuuacacuguuguuuucuagaauacgucuguuguacaaggcauggcaucccugaacuuggaguuuucauaugaaagucauuuauugaaugaaaauccuccacugcacaaauaggaaaggacauuuugagccuacgcacaaaagugugcuuaaugaugggcuagaguauuucagcugagcuccugaggcucagccuuccauaguaaagucacugcaucugugaaaaaguggucuucucugcccagcaccagacauccauucugugggguacaauucuuuccuucuuucauggauaaugaauggucagcuuggcugguuucuuugaaagcaaagacuaagaaguggaaugcagucaggagccuguuguguugaugagacaaacagaugaaggggagcucaccuagagcugccucaggaccaugcccaggaggacacauucaagauuuuggcggugauacagucagcacuggaggacaaaggacagggugcucuucuccugcgagcagugagggucaugugcaguguguuugggagggaagguguguuugggagggaaggcguugcagcaaggcugggugugaguuugaagugcugugugucuaccguguggggagugaagcgggaggcggcccaugcgaugcacagcuggcagcugcagguccugugcuggggaaggggagcgagggccucacuuaaggcauggacuggggggaacugugagcauggugguauucgaggcuacgauguccuguggucuaaggagagcauuacagggaagggaggagagcccagaacagaugacugaagaagaucgcauuugaugggugagggggacccaacugcuacagggggaguuggcgucaccagagaaaacagcacuggguacgugaacuguggcgguucgaugacacuucaaaauauaaacaccuaaaauagguuuuaugaggcguuggcauucccaaaacacugaaguguuuaaguauuuugggaauuguauuuaauuauugaacaauuuaggcaaguuagcuauuuucaaauagguaaaauuaguuugucucucugguagaacuugucauucauuuuuagaaucuugaguuuuaaaugccagauagauccagcugcuauaaauaugcugcagauguagcuguccagucacucagacaggcaagagcugaugauugaggacuaauuuucagucuaacggcagaagcaggugucacaagguaagucagcuucaaggcuucauucccugaugucaaugaugacuuccuuaggaaugucacugcagauauggguuuguuuuuguuuuuugguaaaugaggaauuuuagauagugguagcuacuguucaccacacauaaccuuuguaacaagcuagaauauacauuaaaaauucacaaaguaugcagcuuuguauuuugagauaacuuucuuuucuuuuucuuuuuuuuuuuuuuuuuuugagauggagucuuauucuguugcccaggcuggagugcaguggcacgaucucagcucacugcaaccucugccuccagguucaagcgauucuccugccucagccucccaaguagcugggauuacaggcaugugccaccaugcccggcugauuuuuguauuuuuaguagaggugggguuucaccauguuggccaggcugauccugaacuccugaccucaagugauccuccuaccuuggccucccaaagugcugggauuauaggcaugagccacugcgccuggcuuugagguaacuuuucaaugcccuauuauuugacuuuuauuccuuaagagaaggauguuuuuguuguuguuguuguuguuguuguuguuguuguuguugguauuguguuccauagaugaaaacgcagacauagagagggggagaaaugacuggacuuguguaguauuaaguugucuuuaccugcagauaagagcagaauugugacccuagaauugugaauuacaugucuuagcccaauggcuugucuugggcuuuaauuuagacauggggagacucccaaaguacaagcuuugguguggaaaugccagaaaaacaucauuugaagaaaugccucaggcccuguguguccaauuugugcaacccuuugccucuuugaguguuuuagagguccaagcgcaauuucacugauauuuucagaucuagauuggaacuugaagagccauggauuagucucuuuccugagugugcauguucccaauauucugaauuuuccuuuuuaaagcuccaaauuuaaaugauuuuuuucuugcgucgcccaugauggagugauaaauagggagauaaauacugaugauucuucuaauuuuaacuauuuuguaguucuggcuucccuggagugaguauaauagaguaguugaugaggauugccucuuggaaucggacugccugggaugaaacauacacuaugaauugugagaccuugcgaaguuauuaaaacccaagcucaauguuauaaucugcaaaauggggauaaaaucuagccuacuggaaaaaaaucauaccuugagugggguguacuuguaugaaacaacagggagcggagggaacugaagcaugcaauaguagaaaccauuuaugugcccugauuggcacugaagauugcucacuuaguuaaaugagugaguuuaaaauguuaaaugcuuaaaaaauaugcauuuacauguauugagcaaucuuuugauagagggccauguccagaauucauuguuucaguuuguuuguuuauuuauuuauuuauauugagacagucuugcucugucacccagacuggagugcagugauacgaucuuggcucacuguagccucugucuccuggguucaagcgauucuccugccucagccucccgaguagcugggauuacaggcacacgccaccaugcccauaauuuuuguauuuuucauagauaugggguuucaccauguuggccaaacuggucuuagaacuccugaccucaagugauccuccugccucggucuuccaaaguguugggauuacaggugugagccacuguguccgacugguuucaguuucuuuaaagccagcuaagagcaugcaaauaauugugauuaaaaucugagugcagaauccugaaacugaugaguuuuuucccuccucagucuuuuucaguuuccucuccaucaccuaaguaaacuuuuaucgauuuacucauuuuauaaagcagcucaccuuuguuuuucuuaaauauuuaauguagguuucaugagacucaugcuacgcuuucucugugcacccauuaccuucuguaaaauuaacuagugggauuaaagcaguuaaccgugacugacguaaguaguugccuccuggugagaauauccccaaacuggugagaacagaaguguuggggcuuacuaaggaguagcccagcagcuccaaggaccagccaguggguuuacaaaaagcaaugaggaaaguguggaaugaaguggugcauugagcaggagccagucuagguuuagguucaggagagcauggugugcccugcaagcuuuccugcuuuauccugugggucaggaaucagcagauauuugcagcuuuguggcccuguguuucuggugacgacgcaacccugccauuauauggagaaagcagccauggacaggugacacgcacugaggcuggugaaacaauacacagacuccccagcguggagauacaccaggccuggcggccugucccaagcauuccugggaguagcagggccugugcagacccuaaaggauguagaggauuuagguugaugcagaggaggaagacuggcuuguacacacuccuuagcucaugaccccccuacugucuguauaggaauaauuaaauugaacaaaaauaaguuaauaugucaguacuauguaccaggaacaaacauacauacuugcaaauuucuaaaaucugauuucuuguuuuuuuuugguuuugauuuuuuuuuaagucgaauaauaaaauguauuuuaggcacauaguaauuauugagcaaauugccaucaagucaauuuugaaaaaaagaccuuugggucuuucagaauucuuuuugcauaacuuuaguguccguauuuauuauuucuccuuuuagcaccucuguuuucucuagaaauauucugccuuuaaaguccagucucaagguagcaucugaugauggugauuaaauuuauguugucucucccaggaauauuuguauuugcauuaucuguuuauccagugaaaaaacauugugucuuuaaaaaauuauuuaaguguaaggaagccggauguuuuugucuucugccaaaauucacccuauguucccuuacccucucuuccccacgaggcuccugagaacagugccuggcacguagugggcacaucauagauaugugaaugaaugagcauauugaggaaauucaggacucuaaccaagaauuugcaucuuuggaggagaucuuguuuugaaaucuuucuugaacggaacuaccacuauucagcaccucagagccagucuuggcucugaguuuugcuauauuugggccguauaaagaaaucuuucuaggguaaacaucuucuauuucccucuuaaaagggugcauuuuauuucgcuccagccaagcccugugugcucagacagguguccagauucagcuccugucacagguuaugccuggcaaaagugcucaugcaacaacacaggugcuuuagaaccugaguccauuucagggcauauaaauaggccgcagcugaaaacauguccguugggaacuuuucagagccucuguauuuucuuaacuugcugacuugaugaaguucagcuagagggaaggagaagcugugcacagguggggguguuauucccugugucaguauggccgccagcaggcucaggauuuucuuuggugcuuucuccugccacguccucagucuggagacagagcaccucuugucucuugaccaggguuucuuggauggggagcauugguguaacugugaacaucaauuuucuaauugaggcugagaaaacuaauagaaagggucuauaaagaaccucuagaaaagcaguuucccuuuccucacucuggccuucauaaaauacagggucguuauggugaaaccaaguggcuguggcauuugcuguccucugguuuaagcugaguguaucuuguguguuuaccuggaagcagccacgggcaaggagagcaguggccggagcaggggcagggcugugacauggagcccacgcuccugagcacaccucugccccccacguccugccgaugcaccacccagaccugccuagugcccgacucuggaggugagggacauugcguggcaguugcgucuggacccugugccacuuaccagcagcacggcaugacaagugcuggccucccaucuccuucuuaccugggucacugaugcaugaugugacuuaggaccccacugcuguacuguuuucuguccccuguguggaugcauccuggcuuauucagccaggccccuaaaggaaaaaugagccacuucugcccucccauugugaggaaaagauccccaacacaugggcuuuuguacccguccuuccuucccugcaguuuugauccagcaguucugaggcuugguggggggcugcaauuuggacacagaagcacuccccaucccaggagugcuuggggacacagcagcuauacagagccugcugcagcggguggcugggugcuggcgccuucuggcuggccucccuccaucaaccucgcuucccuggggugcacucccugcugaagggcuggcacaacugcuccagcuccagcugugucuucugggaagccugaauuuuuuuuuuuuuuuuuuuuuuauugagacggggucucacucugucacccaggcuggagugcaauggcgcgaucuuggcucaccacaaccuccaccuccugaguucgagcgauucuccugccucagccuccugaguagcugggacuacaggaaccugccaccaugccuggcuaauuuuuguauuuuuaguagaagcgggguuucaccauauuggccaggcuggucucgaacucccgaccuugugauccaccuaccuuggccucccaaaaugcugggguuaugggcaugagccaccgugcccagcuggggagccugauaaagacaccuguguucuuauuuccacaucugcaaaagggaauuacucugugauccaccugcuucacagggcugugaagaucacaucccuuaaacauaccuaacgcugccuugcacagagugaaugcuuaguaacucuucuucucagcguucaucugcguugcaggaagggugguaggaaagacuuuuugaggaggaauuaaguguccaguggguggaagugucuaguggguggauggugaggcuguuagugaaggagcuugaggguccagagggcagagcuuuggcagaggugauuuuucccacaguggaggguuaccauggugcagggugcauugauugcauuuuccuuuuagacaaauuacugggaauagugaucaugcucucuucuaguccuggaucuauuguaacacucauucauaauaaaauuccuuguuacauauuugccuuccuggagugcugaggaagagauuucuuuauugagagugggcgagaacagugccccagacggcacguggaacugaggacacccgcagcggacacagcgccugcagggcaggagggaggaaggcuguccaguccucaucucuaccaccaauaccagauaccagggcagggaucuuccacuugauaaaguaauagagccguggucucaaaaguggagguacaggcccccgggugugcuucgugauccauuugggauaaggaggaagugaauaaauuugggaagagaauauuuguuguuucuuuccaaaguucuuuuuuuggccgggugugguggcucacaccuguaaucccagcacuuugggaggcugaggcaggcggaucacuuguggucaggaauuugagaccagccugggcaacauggugaaaccccgccucuacuaaaaauacaaaacuuagcugggcaugguggcaggugccuguaaucccagcuucuuggaggcugaggcacgagaauugcuugaaacugggaggcagaggcugcagugagcugagauugcgcuacuguacuccagccugggugacagagagcaacccugucucaaaaacaacaacaacaaaaguucuuuuuuuguguguaauuucuguaauguucucaauauacuaguaacauguauaauauacucucaauauacuaguaauauauauauauauaaaaauacaaauaaaugaauguaugaaaauggaaguagaggccucaagucuuugcggauggggcugugcuguggagguucucuugagccccugcucaccagugcagguggcugugagucagguccugcgcugguuuuguucuggcucaucugugugccucagaaggccugacacuccucaggccagagugccugccugaacagaggaaaaucuuucauaaaguuuuuuacagcagggguuugggaaaggguaccagguuuggcauuguuaaaaauguagaaauaacaaggguuucagauuuuuauuuacugaaaaaucaaaguaaaugagauacuuauuuuuguucaagguuuucuuccaacaugggccuuuguguggccucuguauuuaugcggugggagagugguggugagcggagauuucuaaaaauugagaggguaucuuugauaccuuuuggguuuaucgcaaagcccuguggaaauccugaccaugauacaauguuauaugcuuuuuauuuguaaucguauguuauuaagaagcagagggcauugaugucgaaauguaaguuaauagggaauauaaaaaugggacucauuuugcaaauuugccuugggacuccucccaagggcaacuccucccaacccugaauuggguuaucucaauaaaaauguuagguuucuuggucuagguguccauagcacucaaaaaacauguggaaaaaaacugugugugggugcuugugucguagaguccuuuccuuccguccauuugugggaaacagggacagcccuugcauaugccauguuauuuguguagaaguacuugcaagcagcagccagaaaagccguuucucacuuugucauuuaaaauaagaaucaguugaucuuuuuuuuguuuuguuuugagauggagucucgcucuuguugcccaggcuggagugcaauggugcgaucuuggcucaccgcaaccucugccucccggguucaagggauucuccugccucagccucuugaauagcugggauuacaggaaugcgccaccaugcccagcuaauuuuguauuuuuaguagagaugggguuucuccauguuggucaggauggucucaaacucccgaccucaggugauccaccugccucggccucccagaaugcugggauuauaggcuugagccacugcaccuggcaaucaguugcucuuuaaagcaaaacuaaaaagucagaaauuaaguuaaugacagcagcuuuugccuauaauacaauuaguuuucaaucuauauuuuaccauguauuuaguguccauacagaagaugagauaauuuauuguuuuguaauuaauuugcccacaugugauuguuucuuacaaaauuaaaauguuuuagcagcaugugucacuaauuacuuaaaacaucagaauuugccuuucuguguaaugaauauuauuaaauauuauguuaaucccagggggcuuuuaagguuguauauuacugugaaaggaauugugaauugaaaaaaaaaugguagggaaacgccaauucacuggaucacaucgauccacuggaucacaucuggcuguaacuuucauuauaaauucagagguguaauggaaaucgcauaugacuguuucuugagaaugugaguggauguacauuuuauguggcaaaacaucugccaguccacguggacaguugauccacauggacuuugagccugucauagaagccugagagccggggcagggagggaggguugcagaggaacaggcacaggcugcccuggcagggacagguguccggagaagccagcccaccuaccugccccuucuuccccucugggcaccucagguaucacaucauccagggcuuucuccugguugggguucuguggguggcccuggcugaggggcaugcucuccuuuucacuguccucugugcacaugugcuuugggucuuugaacugagauaaguucuauuccuagggcugcaaacacccugccucaccucgaccugugaccuugcuagagcagaggugcagccuguccccauccagccuggggagccuucugcccuaagccugguggcgguuugccugguggguguggcugggcgugcuggggucaguggauggggaacagccccugcucuggguuucucuggaacccaguucuucugguucuccccucuccacagcuauuuaacucccaacccccaccugcuuucccaggucuuuaaaagcagguguggaugcagauguggcacuacccuuguaaagcagcagugaggcugaaacagaugagcacgcgguuguuaaaggacugggaacacacacagaaaggugucagaaaugcccugagguucugcuguguagacuuucuugaguggggcaucagaagugcugccgcugguugucgggcaucgggcugcuguugcaugccccuucaggaggccuucacauuggaaacgugagcaugagugaccuacugagggccagaggccucugggcauucugggaugagaaggaagcugcacuugacaucuaaguccucuuccaucccacaguuuaaaauggcauacaguuaugggauauuuccuauggauaugaaaucugauuucauaugcacauguguaugagagagaacaauguaaugaaccuuugguguacacuccaacaugguauauuuuauuucauuguauaccccacuugcccucuaccucagcugguguguuuugauguuaucaaugugcauuuaaaagcauuuuguucauuuuucuucaaguguuagagguugcuuuuuuuuuuuuuuuuuuuuuuugggagauggaguuuugcucugucacccaggcuggagugcaguggugugaucuuggcucacuacaaccuccaccucccggguucaagcgauucuccuuccucagccucccgaguagcugggauuacaggugugcaccaccaagaccggcuaauuuuuguauuuuuaguagagacgggguuuugccauguugaccaggcuggucucgaacuccucaccucaggugauccacccguguugaccucccaaauugguaggauuacaggcgugagccaccaugccuggccggggguugcuuuuuaauuauauuuuguuuugcaauuauguaaaacauccaacuguuacguagagguguccucacucucugugcccuguguggcugcauccuggcuuauucagccaggccccuaaaggaagaacguuugagccccuucugcccugccauugugaggaacagauccccaacacaugggcuuuugcacccauccuuccuugccugcaguuuugauccagcaguucugaggcuugggggcugcgauuggaacucagaaggcaucucauggggaccaagcucagauagaccugggccggcguccuggcucucuuccucacuaguuuuguugucuuuugacagcuacauaaucuagguuucaguuucaucuucuauaaaaguggaauaacagcaccucccuugugagcugucaugaaaacuaguugggacacuaagaaccuaccacagugccaaacucaugguuagcauuccaucaacuuuaguuaucuccuguccucauuugaaauggggaucauaguccuuaugucaacuguuuuuguauaggaaucauaucaaaauauuuaguaguugccaagaaaguguucagugacauaaaaauugugucauuaucagcagcacaauccaauaaaaccagucuggcugguucugucucccaggccuugcugggcagcccuugaacuuaacaaucagaccugcuggugcugacaccagugagcuggacagccacgccugggaacucuucauccucccagguacuaaagcuucaacuaaaagcacucaggugugggcuccauaauuccccaccaaaguggggaccuccacccacugugugaaaaaaaaaaagaacuuuuuuuucuguuuuauugucuugguucauagcucaggcccuugccagcacuuugcagggcuucugaaaugcucuucugauuuccuuccuccagccuccuacuuuccuuauccaccccccauauugcugccaaaagcaguuugugaaacauaucccacugaccauuuaucuuccugcuuaaaacaauccauuugcucccuccuucucacacgugggagugcaugagugugagaccucgugggcccuccccaggccuccuggccugugugcucuugcucauaggagccuagggcuggagggugucucuugcaccuuuccccagugcaguguagaugacaggugcuguucacagguaggaccugcucccagggccacccucggcuugcggguggcuuccggugagcuggggggaacuccccaacuccacacaccaccacuuuguauuaaugagaauguggcuggcgacaccuccaugucucuuaacacugcgucagggccccacugaugucaguuccaccugcccugguguggagacgaggcucguccgugccucaccuugcccagcuuaccugcuggacacugacuucuuuuuccagaugcagcccagggcugcugccgguuccaguucccaggcuccuggcaaguugggucucaaugccucugggcccugcccugccuccuaccagggguugcugguagggcgugggcagugagggaaggacagcuucuucauuauugcccucuucauccuuguaucccagcacucacuccacagccacugagacugcccugggaccaaccggccccugguucaugcuuuaauacuggcaugucuucacacacaucugucauguaaaucacuuugauuguuugccccagacguccaugugauggugacugcauggcgaauguugccgccagcacccuguugguucacaggcauggcgacuuggcgcugccugucgugacuucccagugcauccuuccugugcgcucuuacuaggcuguccuaaccgggccauuuucccugagggucucagacccaguccugagucgcaggaguccuuucccauggccaccucgcuguggaacuguuuguaugguccuacugacuuccucucuucagcuucugacucugacacgguuucguccggaaacuuccuuuucugaccuuccuggccagggucucccuccucacuuuccugucaccuccuggggcuccuuugaagagucugccccuccucugucccugccugagacauugggguucccaggugugccccugucuugcaccugcacuucuucuucugccuuguguucucgaggauguggccuccuggggcugggccacugucagacuccacuuuggcucugugcccugagccagccagggcugcugugcggugagugcggugagccuggcaggagcgcugccacuggccacauucuuccugcaccaucagcacgggcccaccccucuccagcuccaucccaaccccucuccuggcagcuuuggacuugccugcccagagggugccucacagaaucuggagcuuagcguuccucaggcugccuucuuuuuuguuuugagauggaguuucacucuuguugcccagguuggagugcaauggcgugaucuuggcucacugcaaccuccgccuccuggguucaagugauucuccugcuucagccucccuaguaaggcagaugccacaauucccagcuaauuuuuguagagaggggguuucacgauguuggucaaggcugguuucaaacuccugaccucaggugauccgccuacuucggccucucaaagugcugggacuacaggcgugagccaccgcgccuggccccucgggcugccuucuuucaacaccuccagggccuguacaacugggcuuggugcacaggccagccauccucccugucaggcaucaccucagauuccuccauucccuggugcgucagcucuccaccaaacaugucaucacacugcuguguucuuagcucagacgaaaucaccauugguguuuuguguuucgcaguagcuuuugacucuagucucaccuucauucauucauugcacagauauuuacugugagccugcuacucaccagcauuuuaugcccugggaacacagccaugaauaugacaggugaggucucccugcaacucugacacauuauguucuagugggggagauagagaguaaauaaauaaaguauaauuucuggaagugauacugaguuggaagagaguugcaagggcugcaguuuuuuuauaggcgugugccaccacgcccagccaaaggcugccguuuuggaugggcugucaggagagcuucuuugaggagguuuugcuguacauguacgccucucagugaagagaggaguaagccaucuacuguguacggcagcaugugcacaucuccugcgguggggcugagcuuggcgugugugagcagcaggaaggcaggcaguguggcaggaguaguggggcucuggggagaauggcuggaggugaagcaggagagaugggcaauggagaagggguauggagguuuauaaaguucaugagaugcccucagaagguuuuggggaaaggcaggaugugaucugagccuacccucccuaucccuccagagaagucauggcuaaaugcaagugcccuguuauugaccugccuggaguccucugaggguuucugccaccucugggauaagauccaggcucugccgccuggucccugcauccuuuccauggcugcccugcugcacacugucaguccccagcugcagcuuaccugcgaucccaguucuucacacaucccacaaccuuucccaucuucuccuguagcgacccuuccuuaugcuagacauguccuuaucccauucugcaacacauagcucaaccagugccuuggaauuguccccucaggccacuacccucuuuccuagaaagagcaucugcuccacgagcauuguauaugagccuuucucauggcacaagccuuggugucuugaguguuuguuuaucuguguuuccuaccagugauggacuugcaucagggagggauccuguuauccucauuuguggauguuuagaaucuaucccagauacugacccauggaagauaaauaguaaaugucuuuugagugaaugaaagaaugaauacaaaucaugugaucuuucucccuuuuuauuuucaaugcaaacuuuacauauuauccuguucuauaaaugagauagacaaaagccacuucauaauuuauuuuaggucuuuaaaaauaguauauggucuugauagagugagugccaucuuccccaugugguagaguuacgcaugaucaguagcuacaacucuagaaagauaauggagcaagagcaaagaaaaaucccuuugguuccagaaaaucuccugaaaaagaggaaggcuuaucaaguccucaaagccacccaggcaaagcagacacuuuuggagaagaaggagcagaggaaaggaaaagggcucaaguuaaacgacuggaaucauuccuauaugauuccugguggcagaaacgugacaagaugcaucucagaugacuagaagugaaaccucaugccuuggaauugccagauaacauuccuuggccuuuauuguacgcauugaaaggauuaaugacaugaguuuacuggugcagagaaccauggcaagacuucgccuaaagaaaauuuuuagugguaucuuuguaaaagucaccccccagaaccuaaaaaugcugcccauaguggaaacuuaugugaucuggguauuuccacaucugaagucugccugggaacucauuuugaaauguggaugagccaaggucaagaauaagaccaucccucagacagacaacacagugaugaggagcaccaggggaauuuuggugucauuugcuuggaagaccucauucaugaaauugccuuccuggagaagcauuuccaggagaucucaugguuuuugcgcccuuuccacuucucaguggcccaucuugcuaccacaaauagaguggguuuccucaaggagaugggccccaccuggcugucggggugaacacaucaaucagcucauccaccagcugaacuagacccaggugaggcagggcugaaaacugcccuugggcugacuuuugaugggucaugccuugccacuuaaaagugcuuuuugcaguuacuaguauuccuauuaguaaccgugagauuggguuacucuuuuuuuuuuuuuuuuuugagcuggagucucacucuguuccccagccuggagugcgguugugugaucucggcucacugcaaccuccaccucccagguucaagcgauucuucugccucagccucccgaguagcugggauuacaggcaaucgccacugcaucuggcuaauuuuguauuuuuaguagagacaggguuucaccauguuggucaggcuggucuugaacuccugaccucaggugauccaccugccugggccucccaaagugcugggauuacaggcaugagccaccgcgcucggccgagauuggguuacuauuaaggguaacuuugagauugggaugacagaggaggcugguacuaauagaugggagaccuucugggagcgaugaaugccugauuaggacauuaggcuaugcauagccuaagaguuauaagcuuaaagauguugagugacuaaaaacuguauugcuguggucauuuagauggaaauggggaaggaauaauauuaauaacugauuucaaaaaggacuuaaagauaugaaucauuuauuuugcugaagaaaucuuaacucuuuuugaaauuacuuuuuauugcuauuuguuauuacucuuaagugccacacugcaguaaauuuuuuucaaugcaguagaagcauguguuuuugcuuuuuuggggaauuuuuaucaaguauguucaaagaagauuauuuccugcuuuaucuucaaaagcuggaaaggaagggucaaagaaaagacaguagguuauguucauggcaagcaccucucaucacaguccaauuccaaggaaaaauuucaguguuuucuacauuggcugccgccucgucugaaaucaguacauuccauggaggaaggaguccugcuuuguugugucaucuguccuaggguuuaaugucgguaaaugaguaacucuaccauuuguccaagggucccuaagacuccugcagugaucaaccaagcccagggacauaauugaaucuggagauuccuggggcuuuguuuugaaaaagacuugaaauauacauaggaagaauggcacaaaaauaaauguucacuugucucuucaaaaaaaaaaguauaugguuuuaaccauucauugaagaguuauacacuuuuaaauaauagcuuguucuuuuaauuuauuuaggguagucaguuauaacugucuucacuaauuaaguguugcuucuaguuauaaaaaaguauauuuugaaaagagcuaccuuauuucuaggaaaguaauuuaaaaauuagcaaacaaguacacuauauuacagguaaauaaauaauacauuuuccuuguuacaacgaauacacugugucuuaaagcuuagcuuuaaaguuuaauuucauuaaucaaaacauuuccucauugauuaucaauaccugcuugcaggucuuauaggaauagacagggaagauuucaucaaaaucugagugaacuuuuagugcuuuuguuaaucuaucuguuuuuuuaaagaucagauuauuuuacuaaauauuaaaauggcucuaguguacaaauucuuucauauuuggugugauuaaugccaaauauuagcaauauuuuuagaaaacagaauuuuaacugaaauauauuuuauguauacaucuuauaaaauuauguauauuuauauauagguuuaucuauaaauauacauaaucccagaauaaguaacuuggucucaaaugaaagcauauucaaucuaaacauugaaguguauaagccuacuuucuuaugcagaaugaaccuuugcauauugcuugacgguauucuggauauaccaaauuaauuccaugauuuauaaaaucgugguggugcuugauacaguucaguguauguguccacuguguucuauuccucuacuuucuuuagauaugcuaucguuuauccucagucaagccaaaccagaagaauggcauauucgacugcauuguuuggucucuguauuuaaugacuucuacugaguggagucuuggugugauguagguuuuauugaggggagaagcaacuguuggaaaaccaucuuuguauuuuuguuuuuuggcacguuguuggggacguaauucacuauugcacaccaugucuccagcaugagggcugcagggcacugguucucuggaucugucuucuuuuaucuugagacaugggagcuuugaaucuggcuuugcaucucaucuuugccaugaccgcuaggaagcucagagccucaucuugcuacucuggaaugcaggcuaugcaacaauauaugugacacuuccacuggacugguuuaguuucugcucuucugggcuuccucauucccuguucaagucucguguauauuuuauauaauauaauaaaugaguaaggaaaauuaguaaaggaauccuuagcucugcucuggugcuauauguaaaauuccaugucuaagaagaguggaauuacucacuuuaagcaguaaauccgggaagcagcugucagacaggaaauauuuuugaguaaaacaauauagugagguaauaaaacuucucauuagagcaccuaucaucauuuagccaguuggugaccuucaucaagucucacagcuucucugggcuuucauuuccucacugguggugguaguaacacuugcccugccucugccugggaucugugaaaccacgugacgcuugcaggagugcucuggaggcccuacuagggcgauugaguggauguggauccggguaguggugcugccccagggcaucuuccacgguguuuuuccaugagauccgaacuccugagugaaagcccaggcccacguggguguggucauugccucuucguuguguucugaaauuggacacagccugugaguuauugugugcacugaaagccccagcagugggcccuccugacacacaaagacuugcuuguggcccugggagucagcuuuccaaagagccugagaguggaauggugggacccgggcuccugcagggaauuucauggccugaccuuuugugccucggcuccagcccuuuauuuagugugcuacaguauauauagauugagaaugcuaauuuguucuuugccagcuaaaguacccagggcaauaugaugaggagucaauuuaaaggacugcugucuugggugggccgccuggaaacacuccugccuuugugcuugugcuugauagugcagcugcuacgacagugugacauggaauucagggucucagcugagccacacggcauuccagaacacauuucagaaauccuuuaagcauggguguguuagaacaaggaguaaaaauagagaccaagcuuuugguggagagaaggcuaggugcuggcccggguccccaggccucugguugugagaucuggccuugcccucaggagcugggcuucucaaacucugcacaaucuaagggacaaagcaggggcugggcuggagucucaucggucagcugaguggccgcaucagguggggcaacauucagggccugcauugcuccugcaucggcacaccaccuugaugugaggucaucggaaccuccugaggugacaccacugagugccuggcucacugcagccccgugauucauugugagucucugcucucuacccuaagcccuguggagcccuuguuuuugccaggaggaagugaucucggcagagaacuuuccuagucgugccacuggucauugcuagaguaugcucaguccccuucuuuguucucuuccaugggugaacccaggccuggccaaacuucugagcauguuccuccagacccucaaauaugcagacccucccucaugggaugaacacgaugcgggaaugaaagacaacuggucucacugcaagugaaggaggcccuggaggauacuguuccacauuguuucucuaguuuggucccuaauaauuuuauaaagaggagauauaggaagggcugcauugugguuguugaugaguuucccagagaaugaaucuuaagagucacacaauggguuggauguuacugucucugacaguaacacugaugacacugcccagcagugccucgggcagcaguuccucauuuuaucuuuguaacagcugaaggaggucgcuaggauuauucuucucuuaauugcaucauguauuuuaaauguuuguuuauacgcaagggaagcuugcauauucuacaaagcagggucagaaauaguguaaaauauucagauugauucaggcuucacauggauccugugauuuaguguuuagugugacuuagcuuucagaaauauauguuuggguagcagcuugaacuauccacaacguacuuuuuaauugaguggggagggauacauagagauugaaucaugguauaagauguaacuuuuuaaguauuguuagagcuuuuaaauaguaaucagcaacugagaaaccaguacaucaaccacauuuauucagcccuuugauaaggucugaggaagaucacgagaaaauguaacacaaauugaaaucagcugcccaaggguugauguuuuucaccuuaugcaguccccuucaugaggucagaugguggcuguggagcuuaugaaaaagcugguguucauagacaucagugcaucuuggcugcuggacucauaagaacucaguaggccacuuucuagagaauucuagguagucaaccauucuagaaucugauugagaagagugguggagaggauuggggguccaccuguaccucaaagaggauggaaaaaugggggauggaaagagagggaaggaagacagauaacaaggguauaugugcacauuaccaggauguuguuugaauguuggccaauuuguuuugguuugguuuaguucaguuuuagauuugauguugaaaguaguuuuugucuauuuguugcaagugaauaguguguuuucccuuauauacaagucuauauguaggacucaguuuagcacaaauaauacuucuguaccagaaggacuacaguauaaucaucggaggucauacgccucucauccuuccauuuucuucuaaaacaguuggucacagucuugccucaucuaugaaggucacuuuacaucagccauaaaagugaaagggaaaaaucauuaugagcugacauggagugauuugcaguaaucauugucaaugaagaggggacauggaaauuguuuaugguauauaucuuugugcaagaaagaagagaaaauaagaauaaacacauauuugcuuucuuuugacaaaaaaaaaacaacucaaaaaggaagaaugaggaugugugggaaugagguauccaacauaaaaauaggaauuagauuucuuugaauauggcuugcuuauauaauuuugauuuugaacuacacaaguuuuuauauauucagaaaacagaauagcaucaaaauugaaaaaggaaauuuuaaaguugaaaaacagaaacaaaggaaucuaacugucuaaaguugauaacacaacugcccagaauaaagacuuaauucugauaauuuugaacaguuuucugaccauauaucuuuauuggaacauauuuuaagaacaaaagaaauggcaaauaacuguugagauuuaucugguacaauuauaguugguaaugguguuguguuguaauucuuaaauuauuuuguagguauuguaggugguacaaaaaauaaaauacaaugauguuauugggaauggaaguucuaacuguggaagaagggcuacaagcagugugaauucucucacucuccuuuucacucucucuauaauuagaaauacaaaauaaauagcaaugauaccuuuccaauaguuacauuaacuacaguuucccacauggauccuuggagaaauggcugauuacagaucuugacaagguugugccugggguaucuugugcuagaaagcaagaagguguucaaaggccuguggaguacaucaaaacaaacccaggaguaggcuugcagggccuccugcuggcaagaguaaucguauuaauagauuguaauauauuaaaagauucaggagucugaaguguuacucaaauagagagaaugucaccuuaauaaauucagaagaaauaaugcauuuuauuuauuuauuuauuauuuuuuugagacggagucuguugcccagacuggagugcaguggccccaucucggcuuacugcaaccuccgccuccuggguucaagcaguuguccugccucagccucuugaguagcugggaucacaggugcccgccaccaugacuggguaauuuuuguauuuuuuaguagagacgggguuuugucauguugagcagucuggucucgaacuccugaccucaggugaucugcccgccucggccucccaaggugcugcgauuacaggcgugaaccacugugccuggcuaaaauuaugcauuuuaaaaaucaucauuuugcaaccuugaccugggcaagaaucauguuugagugcuaaaaucaccgggugaaagauuguuggagaaugagauauuuaugcguucucaaauauuaucucacagauuacuacuuauaaaagagaaaaaaaccauuacauuggaauaaucuagaggccagccucuuaaccuacugcuuaaauugaaccccuccugcuggggacaaccugauacuaugugccaauauuauacccuuguauaaugcuaggagaaaucaccuguacuccucuguaguguucuugccccaaaaagcuuuuaaucugaauuaugaagaaacaguugaacaaauugagagucuuuuucaaaacagcugcagugaagucuccucagagaacucagaaccuucaaaacauuaggcuaagugaaagaagccagucacagagcaugcguauuguaugauuucacuuaugugaaauguccagaacaggcaaauccauagagaugcaaaguauuaauacuggaucagugguugucuagggcuggggagauuggaagaaaaaaagggggugacugcugaugcuaauggguuugggauuuccuuuggggaugauaaaaagagucuaaaauuguggugauggucccgcaacucagugaauauaugaaaaacauguacaauauauugaauuguacaauguaaaugggcaaauuauauggugugugaauuauaucucaauaagccuguuuuuaaaaagccagugucaugaaaacaaaacaaaagcacaggggagaguguucuaaagagaucuaauaaugaaaugcagugcacgaaccuugauuguauccuggauugaaaaaaaaagcuguaaaagagcacauaaggacaucgaggaaguuuguguuugaauuauauguaggauccuauuuucuuagcugugauaaagguauugagcuuauguagagacugcucuuacucuuaggagacaugugcuaaaggacuuuagagugcagaacuguuuuuucagcaacuuucaaauaauucagaaagcaaaaaugguuguguguguguguguguauacacaugcaaguaugcauagaaagggaaaauggaucauggaguaguuugaggguaguucauuguaccaaucuuucaacauuuuuuuaggcuugaaaauuucaguugcuucucaucacuguguguucaaucugacagauauugguugaguguacaccguaugucugguacugugaucugggcaugcaguggggacaguaaacauugauguccaugccaggcaauaaucucugaaggauagagaaugcaauauaacuuagagauaugaucccugccuucaaggaucuugauauggaucuaaaucuugauaacuagugcuagaaauaaauucuaagcaaaucuaaacuuuuguaagcuaggagcagcuuuguaugagucauucggcagaggucauuugagaaugaucacacaugggugguuuaaguugucacaccuuuguauagcuggcagcguccugaaacgacagcacagaauccucucucaccaacaaguucccuguaacacaaaguuguuaacauucagccuucaccccuggaauauuaugagcuaauaucguguuggauauauuuuguucuuugagcuccuagaguuaauagcuauguaguuuacaggaagcaaaauaccuggcaugucauauacauucucuugguguccuuuucuuaguauauuuuacguguucuaauuugcagguucgaccccgguccucugccacucaggugaccuuuaacaguugcugcucgagauguuacuauuuaaaauuuagaauguauacuguuaucuauuauuagaauaugauuaucauuaaguagauuuaauagcacuguaaaaaucaucacaaauaggucaauuauuuucaauaguaauuuaaagcagggaaccauaaaauauaacaaguaauaccuuaguuauuuuaaugaaaacuuagagguauguuuauuggccaauucuuugauguggcugaggccccucuuuugcgugugggcagagcugcuguaucagucuuuugggccuuccagcauaaggguucccagucaagggagcaagagggacugaaauccagcccauugucacucagcaagcugugcauccauagcuuugugugugaaggacugccaccuuuuuccagcuuacauaauaccuuaguuauuuuauuuaugauggcuuagccauauggguccaauguuuaagguucaaggacaacuucguaaaccauuuuaguaauauaugaacuagaaauuucaguuuguuuuuuaaaaguaccuggacaauaaaagauacuugcacacaaauuugagaaguaaaugccucuguauuuuuauaauuccucccacucugucauuuucaguuuucuugcccacacucaauuaaauaauauuuuuuaaaaauaaagauagccuuuauaaaauuuguccacagcauuuuacaaaguuuucuuggaaccaucaacuauuuuuauuuucaaacuuuaauuucaucaguuuacauaauauuuaauuacauuuuauaauuauaauagcauaggcaacuggcaguaauaaauuggugagcaagacuucuaugcuuugggaauuguaaaggccaccuuguaggaugaguucucugaguguguaccagucacuuucuggcugcaaggcuguuuggugcgggguggacacaggcccaucagaaagagggcagagcugugauuaccaggcuggccagcugguggagguuugucaagggagugucuacucuguauuuucuuucuucuuuuuuuuuuugaaauggagucucacuguguugcccaggcuggagugcaguggugcgaucuuggcuuacuguaaccuccaccucccggguucuaguaauucuccugccucagccuccugaguagcugggauuacaagcaagcgccaccacaccuggcuaauuuuuguauuuuuaguagagacaggguuuccccacauuggccaggcuggucucgaacuccuggccucaaaugaucugcccgccucaaccucucaaagugcugggauuacagguguuugaaaaauguucuucuucaagccaguuccugguucaguuuucacagccagcucugcagaggguuugaaugugagccucugugcccaguuuaggucugguggcuccuggcagcauugucugguaauccaguuguuauucugaucaacagaagaauuguaggguggugaaaguggaaaaauaaagcuuuuauugaggagcaaaaguaaaaggaaggugucaaaucagaacaaaggugauuacgaagaaauguggguauucucugcuuggagaagagaaguuacaaaauuuauuauguuaauaaaaauguaauuagaaggagugacauuggaaucuuuccuugucuaaucuaucuuugaaggauuuaggaagacauguccauuucuggauuccaugcucugcccucaucucagacaugacucauccugugagaaugguuucacgcucaccuuuccaggcauauguccugugggaaggaugaugagagauuuccaggaauguuucaugcuuaggguuaagcaauagauuuucugugucuguuuguuguguucaccucauugccuucccuuucaaggauucuguuuugggguugcacguccucaugucaccuaauggauaguucccuggaugggggcccccucacucaccacaggucacagauagccuugccuugaacaccauucaucuggaucugauacacaggaguucugagagacaagagauucacaaauggguucaaaaguuccaucauuuaaacauauuuaauagguauauaugcagacuuggauaaauaaauuauacuaugucuguuuuagaaaaagauauguucagaaugggucuuaaccugguuuaucucaguaucuuuuccaaaucuuaauuacauaaugggcuuagaaaaaguaaauuuuuguucagacgauaaagauuguaaaguuaucccugaauaaauuuguaucugagguacuuuuguagcuuuggggaugacugaauaauuuucuccuuaaaaauuuaaucacuaggcaacauuguugugccuaugcccauuauucugucugaggcaucuuucauuuuuauuuuuuaaaauuuuguuguuaaaauauauuuccuaguucuuuuaaauuaaaaugauuuguauuuagauauuuacaaagacuggguagauugaggaguguuaaaacugauauaaaccaaagacauuuugugccauuagaaaauaaucuccaaagaaucauuuguguccuauuuguaaaauggggaguaauuuaccacuuguguaauuuacaugcacucaaaauacacauuuuuagaccccuauccuccgucuuguaccauccaacugaaugugagguugaauaacaagaaccaauggaucgucugacaguuuuuuuuagggggcuggcugugguuccuggggucuucugaagugucuugcuggugucuccuugaggaacugcaaagcccauggucgggacauuuugcuguucuucucuucccuuccaauuaaguguagucuuccccauaaaaucguaucucuuauuucauauucuaaaucaacgagauagagcaauauuauuuuauauguaaguuuuaugauaugaaucguuucauaaccacggaugcacaguaggaggaaaauucuuuauauuaaacucuuaucuuuugugccucaaagugguagacucuguguuacaauucugugugcaaagccuguuuugcucugucgccugggcuugaguguaguggcgugaucucggcucacugcagccucccccucccugacucagacaauucucccaccucagccucccgaguaggugggauuauaggcgugcaccaccaugcccagcuaacuuuuguauguuuaguagagacggggguuucaccauguuggccaggcuggucuugaacuccugaccucaagugauccaccaccucagccucccaaagugcagggauuacagugcuggaauuacagacaugagccauugcgccuggccuuguguuuguuguuuauuuauuuuuaacuuaaguagaauaacccuuuggcgucuucuuucagcaguaacucagcugauuggucugccuuaggauaauuucaauagggucgaauauggcaagaaccagccuggccacuguuugcuggagugaugcagaccuucuaaagaucacuuugaauagguggaggagaaagacuccccacccccugccaugaaugccuuuauguuaugggagaugggagcaagcuucagccaugagaugcuuccauagucaccuugucccuaccuguccaguguccaccuuuguauacuuucuucaaaagaaaaauaaagccaccaucuccccaauucauccaaccaguugucuugaaguguaagauuuuaaaaauuccuauuucguuuccaauuuucaacacuuccagggaaucuguuauuuauaccuugcuagcaggaaccucaggagauccuguccaaaagacugguucugauaguugagagggaacagagaacaugauuccacuggcuguggguaacaugaagagacagcaccacugagaaagcagaguggccccgaaagaagagagacuccaagcucaugguguuuguuagggccaaucccaauugggagucauuugggagagucuucuccauggauggccucuggccuuuaaggugcaagccugugacuuaacguggcagaugggagguagaaaggagcugaggcuucugccuugggcauggaagggugcacggucaccacaagauuccgcgaugaccacagguauccgcugguuuugugaggcacugaguccugcaggcccgcacugcuugguguuugcagggaggcugcaucuguguuggcuauggugacuuacuggggcgugcugggcucuaauguuuaggacuugguggggacagggguccacccuaggcuauuuugggaacacacucugauuuuucuuugaaucguucaauguagucauuuauuguucauguaguuuaaaaauaauuaaaaauguaaaugagucaucugcacaaaaaaagcccauuuguucuugccaaacucuggaagaagucugcaaguaugacaaucuguguaacugauagaaucuacaaaucaaggacaucauggaauugcaaccacaauaacucuuucuucauaaacauuauaaugcuucauuaaucagcguuucugcauuuuauuugaaugagauagaaguuauauggcccagaucuaauagcauggccugugcuacacuguacggugugcaggcaggauucucucuccaccucacgggggcugacagccagaccagcagggauguuggggcugggacaaggucagggcugggcugugugccaggggagaauuuucuccuggagcuuuggggagugagccaugauuggaagugggaugagaggaugggcaggaggcccaggggaggggaauugcuuggugcauguguccugcugacaacaaacagcauuuacuaugggcuucugagcugucagggacagaggaggcggccccugcugauggagauggagcuccugcuuggauagacuugcugcaggccauuugucucccugguccaaauuauacaagaaaaugccaucuucuucauagagucuuuugucuuuuuauuucaaguaggaaacuuacauacuugcuuuucugcauuaaggcuaggauauuuauuuuuuuaguuuuaaauucauggagugauaaaaagaagugugaaauauuuucuaaaugcuacuagauauuuuuaggccuuucuacuuaaaaauaaaugacacauacauaccacaugguauaauucauagauaucuucuuugcauuugcagagaucuuugccauaaugaaaacuaagucuuuggauaauauauuauuuuugcuaaaaucauuuccucacaaaauuucaaguuacucugcaggcaggauuugucccuuaccuaacuuuguuuugcauaauuugauaaugucaauaagaaaacuuuaaaagugccccaauguuugaauagugccauaugguuugcgaggugccuuuugcuuauuucacaucacuuaaucccagccuugcuuuuagcuaaacaguugugucuaucuuauugccccucuagaaccuuucugagaucugagaccauacacuguacuaucauuuauguuauagacucccuaggaauuaccuuguaaaugguagguccugauacauguuuguagaaugaaugaaacuguauuucuaauuuuauauauuuuuauauaucauuucuucuauggauguaauucauucauuggacagauaccuguugagcucacacuucagcaagcugcuguuagcuagucuggugguugagacagaauuguccaauccaagggaggaagggaaucaguacaaauguuguagagcuguggagaaaguguuuaguaccgcagaauuggaaucuuaauuuaggguuugcagaaaauacuucuaauuucagcaggaguggguagggaugaggagaaagugaagaugaaagaguaugggcuggguuuuagaaggggcugguguuuuguuggacuuugauggcaauuccagguagaagaacagcauccacaagacucuggagaugugaaagcaggaguuucagggagcuguggacuugcaggagaagggcgugugggaggcagggaaggucaucaugggaagaggcaacugaucagguccguuagaguguggaggaagccuggcuguaaaggcgcggguuucggaagcuaugaggaaauugggacauuggguguagggcuccucuuuggaggcguuuccucuuuugaauggaaggagguguggaaagaggaaggaaagaacagucucagcuagcgagccaagacagggagagacuaaagauaggagagcagagaaaaaaaugggugaagccuuagaagagaugugagcuuagcccuuuucuggaacugcguuccuugcaggaacucccuggggucucugcagacagaggcguggugaagguggagcccaggacaagaacauguugggcgaggucuuccgggacuuggaauggcugcagcaaugauauaauggggcugagagcaaugagcaggaacaucuaccugagggcccuguuggggucaccgcacgugacuuuguggggagggccuguuuccucuggcagugucuugcagccugggggaaagcugaggcacuuagggauuggaacuggagcaugcugugggugagagagaguggccguaggagaggcugggccccaugagacccuaucgguuuggugugaaagggaggaaguaccucuguauugucaaauggcagcauccacacaacucucucuaucuguggccagaauauagaguucccuaauugaagguuuuggacaugugaguggcuauuacagcagccuggcaaagaaggccgugugauugaacaagucaagaaaccaugaaguauuugaaaagucaguguuucuguuuaugccuugguggaugacagcagguguacaggaaggaggacagcaaauacccacuacagucauggggcaccggggcaugcugguccaggcgucuguagaggacuuagacauucuccuuggagugcggccuauucuuguguuuacauuuugcaguggaacaugguuugcagccucaguucucauuggcagguugugcacuggguuucauccuggagccuugagggugggagcugagcacacaugugugugcagaaaacugugcuggagaggagggcgugggcagagccaucuugcagggaccaacauggggaaagcauuuucacaugaugguuuaucuuuccuuagcugauauauuuuuuaauuuuuaauuuugaagauucacaggagguuagaaagcuggcacagagguccugguacccuccccaguuuccccgugguugugucaucuguaguauaggacaauaccaaaaccaagaagaggacacuggcacgggugcccgccacgugcacguccucacaccugaagguccaugcaggccagacacggcaccgcuccuucaccccaagaccucccucuacccccuuucaggcacagccaccuccuccugccguccccaacuccgacaaucacuagucuguuuuccauugcuaugauuuuugucauuuugaggauuuuauaucaguaggaucauacuguacgugaccuuccaagacugcuuuuuuucacccagcguaacguucuugggcuccacccagcuugcuauguugccuccuuuuuccugcugagggcuagcccguggcacgggugcaccagaguuuaacuguucaccaugauccccacaucauguuuucauagauauauacaagauuauaccuuagcucauuuuuaauuguguggugaguauauaauuuuaaauuuccaauagaucccguaguagcagcugguauugagugcuuugcagucccaugagggcagugacaucaccgucaccccugugucaccacuggaaccggagguacagaggggugaggugacucgcacauaagggggacaggaagucacaccccagcgucagcuccaguacuucugcuccccgcacacagcugccuucacaucagugcagcgaggccacaacaucuuuucagcuucauggaauagcguccagaauagcccccaccucagcacguuggcuugaacguguucucuuacaucaguucaugccauguuuugcccauccguccuuagugggaccaacgggacuggcucacucauccaagcagugccaccaaggcgaguuuaacaagcgcagaaaauuggucuggucccagcucugugucccuucauaccuggucauccccuccugggugccuggugacuuugggcagcuucccaagggagcacccagcccuucuucuuuggggccuggacuucccuugguagcgguuacccugggcuuuccucggugucagguaccuuguuggaugaaccagcugugcggaggugauaauguuggcauucgacagggccucccagagaggaagcaccugggcgagugggccucuucuacccaggagucggguucagcucugucuccagcucuuccagggcccaauucucagaacagagcagaugguggguaucuagcuguguucaaauccuaaguuaacauuuucuguuuguggaucuuaugaaccugaagaucauaacauucaacagcaucaaguaggugaccucagagaucagagucaauuuaugggugaggaauuggcguauagcagggucgguggacagcucagguugaugacacucuggaacuuucuggcaccuuuuuuauacuguacaacauggagcugaguccagccaggacagccugugauaccagcagaggguguccagcuuccugugucuugagcaaagaauuggacaaaaugcacaaacaaagcaaggaaagaaugaagcaaugaaagcagagauuuaucaaaaaucaaaguacauuccacaggguuggagugcacccgagcaagcagcucaagagccugguuacagaauuuucugggguuuaaauacccucugaagauuucccauugguuacuugguguacacccuguguaaaugaaguaguggcccacagucagucugauugguugugggaggggaccaaucagaggcugaagugaaguuauaaaguuacacccuaugcaaacuucugauugauugcagaaagugaccaaucagaagcugaagugaaguuacaaaguuauacucuuacgcaaaugaagacuuggccugagaccagacugguugugagaggggaccagucagaggugcuuucaguuuuucaucuguacgcaggaaaggggaguagccucuggucuuuuuguuacuugggagugcaaaguugggguuuuccuuuugauuuaggucuaggaagucagcgugaauuggccuuagggucccugucuccagacauuacucuccugccucaccuguguuaucuuaucccaugugagaggacuccucccugaaggaccccuagcacuucucugcaggauggaccuugugagcagcugaggaacgaggaucaugagucuggaagaggcuuuguuaccuuuuuaaaaccaugugaagugaggaaauacugacacacagcaguguuuggcugccagaguugucagccuccauuucuccuugccauacguguucauuugucacauguacagacuuccauuucaucaaacugcucuuccaaugacagugacuuuuauuuuuuuaaaaaauauagauuaacuuguuucucuuccucuggagcaggagcuacaucacuaaaauguuaaucggugaucgugggaacggccgaggagcauugguuucuuaaugggaucugcacaggggagcacccaggccuuccgaggggaccagcucugcccagcacugagugccuguggggagauauguucucacuggcauuugguucauuuauguucuaaaaugaguuuagacacugaauuguugucaugaauaacaugcaaaauaguguguauugggcugcaaauauagacauacuaaguaucaguuaguaaaagaauguuuaaaaguuuguguguaaucuuuuguuauuggagggacacguugagacuucauugaagcauuuaccacauugugaucaaaacuggaauuugcucucucuaauaauccuuaaaaaacaacagauggugcaggaccaaggugcugugcccacucguguuuguuuacuuagccugaacaccagcaggguuaccagguccuauucuggggcagggaaaggcuggaucagauacagcucugccuuuaaagcacucacugccuggaaguggguggguggcaaggcccacugcucaccagucaccaucaguaccucugggauagcccuugcuaggcuaggaacuguugaacagccagcucuccgaggaaaggguggucucguaaauuucacuuauaaaaaggauguguaguaccuaauuuaaaauaauaguaggcugggcacggugguucaugccuguaaucccagcauuuugggaagccgagguggguagaucaccugaggucaggaguucaagaccagccuggccaacaugcugaaaccccguauuacuuaaaauacaaaaagccaggagugguggugcgugccuguaaucccagcuacucuggaggcugaggcaggagaauugcuugaacccaggagguggagguuguagugagccgcgaucgcgccagugcacuccagccugggcaaaaagggucaaacucugucucaaaaaaauaaaauaaaaaaaaaauauguucaguacucuuuaaugcaauuuccguagagccaguugcugaucauagaugcuuuuguucacuugagccgcacucaaguccauggccacgcuguggcugcucugaugaaggagcucaguucugacaugaauguugauggauauuuucacuuacaaugaguaaagcaaagugagaaagcgaauguuagaauguccucuuuccuucagugauaugagacuuugcugaccuggauuaaguguaugaauacucacaguguuuccuuaaauuauuaugugauucacaauguggaagugacaggcaggaccacuugugagugugaucugcauugucaagauuuucucaucaccauccuaggucuuggaccaaggcuuggcaagcuguggucaacaggccagauccuguuuugguacagccugcaaucuaagagugguucuugcauguuuaaagguauuuuuuaaaaaaauuaacaggaaaauaauauuuuguaauauauaaaaaaauuauaugagauucaaaauuguguccauaagugagauuguauuggaacacagccaaguucauucauuuauauauugcauuuuugccacaguggcuaagcugaguagcugugacagagaucauauggcccacaaagccuaaaauguuuacuauguagcuauuuauggaaaauguugcugaucccugaucuagacaaucaauaaaacaacgugugccuugauuugucacauuugcucauuuccauggcaaaauaccaugaccguuaaccagccacuaaagugagacaugaguguggagcugggcagaggcuguggcaacucccaucgaguaguauucuuaccagaaaggggucugauccaaaccccaagaaaagguucuuggaucucaugcaagaaagaauuggaggcaaaucuguagaguaaggugaaagcaaguuuauuagagaaguaaagaaacaaaagaauggcuacuccauaggcagagcaguagcgcgaguccugguuggccauuuuuaugauuauuucuugauuaugugcuaaacaagguguggauuauuaauaaguuuuccuggaaaggggugggcaauuccuggaacugaggguucacccccuuuuuugacauacaggguaacuucuggacauugccauggcauuuguaaacugucauggugcuggugggaguguaggagugaggacgaacaaaggucacucuuguggccucauggcuuuggugggauuuagccaguuucuuuacugcaaccuguaaucagcaaggucuuuacgacuuguauuuugugcagaccuccuaucucauccugugacuaagaaugucacccagcaggucucagccuaauuuuacccagccccuauucgagauggaaucgcucugggucagaugccucugacaguauuucuagccccagacagaauggauuuuaauaaccccaaagguacagauaacagugaaaucaguaggaagugauaagggcugcauauuuauuacccuuauuuuuaauguauuuuauuuaaccauaaguuuauauaauuuacuuuuuaauaaugaguacgcuaccagcauuccagaagauuuaacaguuggcucuugagagcccuaugagcugguuuuagggcaucuguagcuggguggaggggaggcuccuucaccggggacucccgggaagaagaauuuccugacugguauauuuagggaugaggcaggguugccagggaaauaagagguaagacuucucugcagaggagacagcagucagggucacagggggaaagaggagcacagggucaggggccaggagcauuguggugggggcugggaggcugcuggauacacccugcacugaagccuugaguaaaaacacaaaaaagacuggcuaguguguauucaaaaccaacauuuuucccccuuugcuuuaacauaagaaaagacacagccuuauuuuacccauccccuauucaagauggaguugcucugguucggaggccucugacaauuuuguuagggcuggcggacaaagaguaacuucaguguaaguuacaacugcucuacccgguguugcugcaacugaagagagguuuucacaggggaaaugagagcucugccccgcuacugucauuuacugagggcuucacacagaagcccagggaagggcaggggucuccuucucaugagacccaguauguggagggaacugcagggaaaggaccccggaguggccuagccauccuugcuccaaagaacagcacuucuguuguucucuaagguacucagguguggaagucauguggcuuccgugcuucaggauacaaaacugguaguugaacaaaucuaccauggcaaauccaaaccaguacaguggaaggccuggaggcggccaagggagacccccaaagccgcuuggucccagcguccucucuggucacugcuggcugucagcaugguggcuggcgugggccaucuuggucagaucaggcucagguggaacuuccuuuuccuucuucguuccccuuugguaccugaggggcaugcccuggaggguguagcccuggcagguugugaggaugucaacagagccaccugugacaucagcaguuacuuccugggcuggacuuccagguguaagcagacagcucccagccuucagagagaaccacaaagcuucaggaacagaaauccugucacacccuuuuggggaccuggucacuguauaaaacaccauguaaauauuggucuauucuaauacacguuuuguuuucauuacugaacacguuccuguuucugaaauagaggcagcccuugaauuuuuuuguuuuuaacggaccaugacauggcccaaggcacccuagcauggggaaaauaugacaagcauucuguguuuuuaauaauacuacauuaaacuuucaaaagcuaguggcaaaaauguagacauauggcauauguauuacuacacccucuccuauuuuggaaguuuuuuuuuuuuuuuuuuaagaaaaaaaaaggguuaagggacucacaguuuauguauauugagaucggcaaaccguaaaaguaaauucagcuguuacaucuuagugaacuuauuuuucaauauuauugucauuuguguuuuaaacuuuaguaaaguuacaauguaauauuauuuucaacauaggaaacaaaaguguugucuauggacaaauuauuaugaggaugcagagaaguaaacuccuuuauuugcuuaaaaucuuuguuuuuuuucuaauaggcuagaauuaagaugaaaaaauuaacuuucagcucuugugaguuauuaaagaauuaguuuacuuugugagugcuaagucaaagcaaaugagggacaggguggcagaucuggagucuggggagggguaccauugaacucaugcacauugaggacuuccuugggccaggcccagagcugggcauuucgcuucaucauuucuguuuugauuugaaagaagcagucagggagaaacugcaaggaaggaaauauucccuggguuuuccucaggccaguccagugcagaccggaagcagggcacacagaaccaaaugaggugguuccuuccccacacagcccugucaagcucagcugugaagaggcgagaccguugacccccugaguuccugcuacagagggagggcaguggaggauggagacagggcagagguggguuuaggacaccgacccugcugcauucaucgcagacaugccuuguuuuuugagugcaucguguaccagaugccuugaccacauuauuuuauauacuacgcauugcaccugggaaguagguauucccauuccccuuuacaggugaggaaugugagcugcagagggacagcugggaaguagcagaccuaggauuucaacccaagccccucccuguuagugcccaggcucuuucccaaggcacuacccuaaauuucagcucaagccagggacuuugaguuugguucuggcugaugagaacaccaagcaauaaaaaguguaaguuuccagucaugagcugcuucauucagaaggggauggaucccuaaguuuucuuaaagucuccuucaccaggagugaauggguguacccuccugcugagccccaagccuccuccccgugacccagagcccugcccuguccuguccucugugaggccuucaugcaucuccccuggaaaaauugucucuuccucugaaugguucauaagauuucucauuucugcccagugccuguugcacuguaaccucuaccucugaaucccccucuauguuuuaaaucacuugcaaacagaaacuggauuuuuccauuucuuagauugucccagcacuccuuguaagggcucugggccucaguuuucugucuguuaagugggaugaccguuccuggcuagguugccgucagaggcuugguauguugguacauuugaguguuggucagcguuaguuuccuuccacuggaggacacaccaagugagcccaggccccugcuuacguaaaaggggaaggguuuuuuuugaaaacauuauguuuuuuuuccaaggggaugucgggguuucuguuaaguuuuucucauuucuuuagccaagcugaaguguucugccuuggcggggaguagaagguggacugugugaauggugggggcccucucggcccaggaagagugcaggaggggguggguagucagcuggaaaaguggucuguguuuuugcugaggcuagagagucagggccucccauguugggccaagcucacugccugacuuacaauguuuguugugcuuuuguguucuuuaucuuaaagaggccucucagacuguuaacuucaggccccuccaaaccagcaccugcccuguggugcaggguuuuguccagccaaugggaagccguggguggugggcaaagggaagccuucucaaggucagggauguccgcggcuguuuccggugcuuggcuuuaggcugaggugauauaauugcucucuggaaaucacgcacuugcagcaaaaguucuggauauaaaaguucugcaacaaaaacucccaccacaguuuuguaucugguuguucaaggugucugggggcuaaaggaagggcccaagagguucuuggacguaggaagagaugcagggcagcugcacuugcuuagccacaucacacagucccuucagaucccugaccugucagcugucacagcacagcagaccuaacacuggauucccucaauccaaucaagaaagacuggguacaucaaggaaucgcccguccuccaaaccugggggccacgauauaaaacugagagggguuaacuuggagaauugugguguuagggugcauacgaagaugguguguuucuucgugggcugucaacagguugggcugcuugacuucagagcaugguggagauuggaagugcagauuaguggaggaggaaaugccaggccaaggcuggagauauccauaggaacaggcaugagcguugugagggcugcagacugucccucaggacccccagagacagguuguggagggaacagaacuuuuggaguggaauagccucagagauaaagucuucucuuucucccuccauccuuuucucccucucuucucucucccucccucaccuccucuagugcucuuucucucugucucucucuuuccaaagguaacugagguucagguggccccagaucaaucaguaaacccaagcgacguguuccacagcaugugcccuggucuaguccagccugcuguccagcccuggcccuucagucaggguucuguguucugaacuuucuuuucuuuuucuuucuuucuuucuuuuuuuuuuuuuuuuucugaaacagggccuugaucugucacccaggcuagaguggaguggugccaucucugcucacuucagccuccaccuccugggcccaagcaauucuuccaccucagccaccagaauaguuggggcuacaggcacacaccaacacgcccggcuaguuuuuguauuuuucguagagaggggguuuuucuguguugcccaggcuggucucgaacuccuaagcucaagugauuugccugccuaggccucccagagugcugggauuacaggcgugagucacugcgcucggccuuuucggaacucuugauggugguguuauuugggaagugggcgagcccgaugccaggucuggccuugccgggcagggcugugccugaggguggguggccgcaggucuaacaguggacaagaagugcccagaggccacaugguugcucagcagugccugucagagccacucagcucagguuucgccagcccagggauccucugggaggcccagucucuauuuugagagacaguucacgaugaggugaucaagugucauauuuucaacggagaauuaaagguacccaacacuuagcucuuagcucagaaaacaccaguaucaaaacaggcuggcucugggccucuuauuucugcauauuuucacauacccuucuuuucugcuuuucuuacuggaaaguaucuuucaguguagaauaauucauccuaaauaaaauacuuuugccauuuauuuuaagcagugaaacuucuacuuauuaauagaggcagaaauaagauuguaaggugauuacauuugagguaauaaauaacacagucugguuguuuuuauagcaaacaugcacaaguuuguuagugggauugcaacgaaguagucaaaaacaaggccuggaaaucaggcucucuccauuagacauuggcaugugcacauccugaaaacguccguuucccugaacuguggugucaugugaguccguggccccaagugaagggaguugggguucauuuuccugagaaauucucacaguccguugaguuccaaucaguuaugcgcuguguggagagcgggcuagucagauuucacugcuuuucaguuauugacaaaaguacauagaaauggacggggcuuaucagcaggcggcagagaugccuuucagagcgcacggccugcugucucacgucucgcucugcaguuuuugucuuaggauuuccacucgguuugguucucuuuuccacacuuugcuggaaggaacucaauacagcucugcuccuuuuuuuuccccccacugaaggaaaaaacaaacauuuugggugccuuggugaaggcaaaucaccauccuuaauauguucuugccuucuaggucuggcguuucuguucuguugacuuuucuugccccuugcuggcucugugaguugaauccagaagaaaacugucgguuuugccaugggucuucugagcugaaggcagcacugauuuggccagccugucucugcagaugcucauggaaaaccaagguguuuucugucacuauacauaauuagaugccuguuaugccccaaauacaugaugaagccauuaaauaauuuuuaaaauuaauauuuguaaaaauucauucugacauauucaagugcuuaauggcuguuuguauuuauuuucucuuauaccucuuguggacuauuugucaugaccauuaugugugguuaaauuuacuccugaucacuugcauaguuaucuacgauuuaaugccuuaaucauuaaacuaacacacagcgucucugguacuuuucaugugauguggauguucauggccaaacaacccaggaagaaauugaauaaauguucaggagaaagucauaaaaauaucugauugcucuuucuuucuuucuuuuuuuuuugugguggggucucucucugucauccaggcuggagugcaguggcacgaucuuggcucacugcaaccuccgucucccagguucaagcaauucuucugccucagccucccaagugucugggacuacagaugcccgccaccacgcccagcugauuuuuuguauuuuuaguagaggcaggguuucacuguguuagccaggauggucucgaucuccugaccucaugauccgcccgccuuggccucccaaaguacugggauugcaggugugagccaccgugccuggcccugauuguuauuucuuaagaaaauaagaaucccccugcuggcugaaucucaauguagggaugcacuggugggguccucuccauggcucugcuuucucggucaucaguguggcuccauuuucaccccuuccagagcccacagccagauggguugugggaacucucaacucugcccuccccucauggucccccagaaaaggcaaaaggaagagacugauauuguauggugauucugugcuuuuccuuuuuuauuguuuucuucuuccuuuuuuggggggaugaggggagaguuccauuuuugacuaagaaagugaugaugaagaaggugaccauguguagugguuuguagaauggauuagacucaacagauuguagucauucuuuccugauucucuaucugggaugguguuuuggcagcccauagcacucagcucugcaucgucuaccagaacgguccuauuucucagagguuaggaaguucagccucuucugaaugacagcgucaaucccacauccagcugaagcucuccccuucccacccucuacugcacucagguccgaccauggcaggagcucaggccuggguggcugugguuagacuuggguccccuccccccgaggugcugcuuccauggcuggguggggaugaggggcagggucucuucuuugcugguggucagcauaccuucuggugcuacaggucuggugccacaugcucuuguggcguuuaucugcgggugugugggggucccacccucagcuucugccuugugagcccacagccucuccuggcucggcccacccugcacccagcccucugguucaggccccuucuaaguccucuugggucaccugagcccugcagcagcuaccugcuuccaggaaccaccuucugaccucucugucgcaugcugcuguggacagcccuggccagccacccucuggcgcuccuuaggacacaggcauuuguuucaagcuccugcacuuccccgauccagagacucacaucacagugcucccgggcagcuucaggccugcaguucugcagcuccaugucuguggcccuugacccagcccugcauauggcuccccaggaaccccugcuugguuugguagaggauggagaggcaccaggugaggggaggaggccacugugauguccuuacuagacagaccugcuggccauggagacacuucuuuuugcugaucauucaucaucucuuuagcauguuagagggggaagggaagcacacugggguuuccucugcacuagagcaaauagguaagaacagaaggguuugauuccacacuggguuacaauacuuacacuaacugaaggcuuagaucccagccacugugguauggguuuuacaagaaugaaauuacuuaauuuuugccuaauccuguggagaagguguaguuaucccaaauacaacccaaaggaaguuaaauacauuguguuaguucacucacuaguuagcgguggugcugagauuugaacccaggcaguguuaaccccucucccagucacuucccuaaagucuucucucccguaguaccccuuugaucuccacugccauugugggacacuucuagagucaagucuugugugacuuccucuuuugugacuuuacuccauucauucacucacugaaggcuggugaggguugauggagacaggauagcaggggaucugccccacgugcagaaacaccaggguucaaguaaccacgaugugggcgaugaggggugugguggaaauagccuugaaguuagaggcagaucagacagaggaguuugggcuucacccagugggcagagggaccacuaacguguuugcauuaggaagaauggccagauggagccguccuugaggaauauucaucuucaguguguggaaaugggacucaagaaggggaggcaggugaugcaggagauuccuucagaguccacuguaagagucugggggagagaagacaaugccccgagcagcaguggagcagggguggugggaaggggccagcaggaagucagauagaaucccauguguggggaaaggagcaacaguggagcaggaacgggguaaaggaggggcuggguuugagccuuggcagagcuggaaucagcuuggcagucuuuggccuugggaggaagaagagacagagaugacaaugagguagaaaccuuggcacauaaugaagccaugacugaaauggagaggcaggagaggcaguggugccccggagagcucuucauuggguguuguuaggccuagaaaccagcagacugguacagucuccucagguuguggcagcgagguggcagugugcugcaggugugguguccacguaggagagaagcuuggaggaggugugugucugaugggggcagcugggggcacacuccuugcuucucagggcugugcuggccuggccaugccucuucccugcugggggagcgaggucaaccagagcucuggggucugccagucagggacacgguuaaauucaggugauacugcagccugcacagauaaggcagcaggggcuaaagguaggggugugaucuagaggcaugaccagaucccuccauccccaaaccuacugugcccuugcugggaccuucgggcccuugcuuggacaggagcugggagcccgucaagcucacgguguauccaucugcacauauugagcaguuuggccgugucuuuguaguccugggacaaugguuggcagaaaccaaauacggcuuucaagcuugaaaauccaugcugccacauagagacuggcugcaagaaagcagugagcuucugguugcguaguuuugggggauaagagaagaaaaaaaucaaaacuccuuuaggaaaagaauguacuaaaucaugccugagagguggcaagaauugcuuuauacaaauucagcaaaugccgagguuggucagcuaagguacagagcugacuuggcucuccgggaauaauuaggcuuucuccugaagggaucaccugggcugccugcccuggaaaacuccaagaaggugguggacgaaugcaccuugggaaaaggaaguaagguugcugccaggcaucccgaugaaaggcgagcucagcccuuccucccucacaacucucgcggucucauucucauuuuccaggcuuggaggguuugugaacaagugaaccaagacaauucacucacugucuuucugcaaaaugacuugagauuuccguugccgggaguacaggcgccggcaccgcgggcuugcucggggaaaagcugcaucggguggcacauuuaugaauaagucacuagcugaauuggaucggaugccucugcuaguucucagggcacugcuucacucugcacuccucguccagggaagcccaaggagcgguuucuguccguuagcuccuggaacagcguuggcugugcgguagaaagcccuuugugcuccuuuuagggggcaaagcaaacccacuccaggcaagggcaggggacagcuugggauguaugcaaacauugccuggugguuugggaaucaguaaguuuucucugaucuauuccauuucauuuguuaagaauguucaaacuucaguaaacuagcacugcuuuuuuuuuugaaggagauauccuuuuucuauaauauugaacaauguaguaacucaggguuuuaucugaaacuuggaacagggguugcucugcucagcaugagcauggaguauuugccgauaguuaagugauccucaccgacaggcucuuucuucacuugcugggaguugaguaauagcugugggacugggcucucaaauguuccucuuugaauauuuacuugauguguugugagauaucaguguucccauaucuacaggcccuggaguuuaguuuggugaguguuauggauauguuuuguuauuaugucuuagagaauccuaucuagaaagcuaaucuuuuuauguugaguuacugaaagcuucccccacccccaggucaaaacugugaaauucuauuguguaggauuucuuaggcaguuaugaaugcauuugcugcauaaaugagcuuuuauuaggcauuuugaggagccagcuucuacucuacccucgcagagacaagaggccugcuucuuuuuuuuuuaauccaaaagaguaagcgugcuaauaauaauaguaaaaaaauuuguaauuaccaccagucauugagugcuaccugugucucggugccauaccagaaacuuuacaggggucaucucauuuaauccucccauuuacucagcugauaaaagcugaaaucucucucuguucagcucuuggggaaacugaggccuacagauuacaggagcuuaucugggggagaugcacagcguggccacgucguggcuggauuugaccugauguuuuuccagcucuagagcauguaaccaggaugugguggaugguguacagcuguggaguguccuggggcagacuuucaacagacagugccuuugugugcccugaaauguggcguuuugauggguaaagucguuucucccuggcuuauugcuccagugugauauuuauuguuuuuaugccacaauucugugggcugcagugugauuguuucauagacacauauuucagcccuuacuuaucuggaucuucuguugacuguuuuucuggcuuuccguuuuguuugcaggggccaagacaguggggaaagcuuugaugggauuuuccucugauagcucuucuccucuauuagaaggaauucuugucuucacaggaacauugcccugagcuugggaggugcugagcuccaagaaaagguauuacauggauucuuaaucuggagucccuggucaucagggugguuugcagaaauaauguacaaggaagaggcuuaggagucugagacucaggggcauguggcaguuuaaaaagagcagggucucugcacaagucuaaggaagucaucagagcugggaucuuuucuagcuccugcugggcacacccauagcaggugcuccuggcugguggcaagcaggcuggagugcaucuugccuggaagaagguccauggccuucaucagauacucaaagaaguaccugacccuaaagguguauucagggaugcuugagacuaaucuggggucuguuccagcucugccaccuaccucaugucaugccggggcacguccuuccaucucccugugacuccagucuuccucugucuccugaggcaguugaacacaguccccaugcguccaucugagccucguggaaccuugagcacugaaggaaguucuuggaggcccaacucaguuugcaaauaaggcuuguccagaccccacaucagaguaaagggggcgucucuacaacugugugcuggaaaccuucacugaagaguauucucuaaccucaccgcucaucagccggcacugcagggcaccagcguucuaguaugugucaaggaguccaaacauccuagcaucagucugccaggaaccccggugcuuguuuucaagaaguaauuaaggcuggaggcggugcaaaguguguaggugguguccuaggcucagaaagaccugggcuagaauuccagucuuuuccagcugugugauugugagaagguuacuuaacugguuggauacucagccacccugucuguaaaauggggagaauacacuugcauaugaaguugccagggguauugaacauacacaguguggcaugguggcuggaucauggcauguuuagaaaaugagggcuuaaaucagauuaguguuggacucagggaugugggagcugguacaggaugcgaggauuccucauuccccucuuugguaaccaguucugcaggcugcgguagcacucagcugucuucugggcauuuguuucuggacaucuuucugacuuuuuauuauugcugagaaaacugggcacugacuuggcagcugaaucccaacucacucccucacucacucacuuacucacucacuuagucacucacuuacucacucacucacucacucacucaacgcaguggugaccgaauuccuucccugggcccagcacuucacuuaccagugaugaacaagaaagucaugguuccucuucccuugguagagggaagucuacaacuguggcugcaaauaaauagccagacacaaaccagacgcagcuuauguaccgcuuguaaacaggaugaagcaaacauccuauugcugaagaaucucauggagagagaauggcaacucccuucugccugcagcauaaacagacucucuuagccaggagagccgggugugccugguuucucucugaaauucccuuuaagcacaugcgguuugccagcagccagccagaguagccaacaugguaaacaggcacccaugguguagaggugccauucaggucagcuggccucagcaucacuguggauuucccaguccacuuuucuuggacaguaagaaauuguuauaccuucagguccacagaugacauuuccaacuggaaagauggaagauguaaagcauagugcuuuugaacucagggucugggaaaguacagagacgcaugaauuuucccuuuucagcaugcagucccugucuaccucagccugaccagccuggcugggcaguggcugucaccuauagaguuagguuuuaauucagcuaccugggccucacaccugcgauuugcauucacugcaccaugucaccuaagacccucugacuuucagugaguggauuucaagccuucugcugaauguugaagagcucucagaauaaaaacccagcugggagcuuccagcugaugugggaauuaacaagcgucauccugaaacuuaguaaaugugugaugguuuuaagcuaaaaucauuuagagcuaugguugaugaccuuggaaauggcagaaauguuuucauauauauacuuuuucauuuuauaaacaguuccugccagggcacacccagguuuuucaaccugaauagaucaaaggaagcuugaguugugugugcugugauucauucccugcugagucccaaggaccugcccugccuccuacuggagggggugagaggaaggaaagcuggauuacccagccugugugcacugccagccgggagcaccugcgaugggugugcccagcaggagccgggcaaggucccaggucugauggccucuuuagacuugugcagaaggccuacucuuuuuaaacugccacaugcaucugagucucagacucaaccacaugacaucugcacagauguuugagaaaggcauccccugcuugguaagcuaaugacuuuucacaaccgaguacagauguggaguccccacguaaauagcagccauucuuucccaggcugagccacucacaggcagaggaagccaggcguuuucuguuuugugcugugacuguguuagcugcaggauggugccugcguuuaacagaagccacacugaaagcacgaaacagacaauggggaacaagccuggucuaaaccugugcaggccauccacgugcacaggccauccacacacacaguccacccacacacacaguccacccacacucacagccugcccacaugcacgggccgcccccgcaugcacgggccgcccacacgcacaggucacccacaugcaggcggaucaccugaggucaggaguagccugaccaacaugguguaaccccaucucuacuaaaaauaccaaauuagccggguaugguggcaaauuugguagccggguaugccuguaaucccagcuacuugggaggcugaggcaggagaaucacuugaaccugggaggcagagguuacagugagccaagauugcgccauugccguccaucucaaaaaaagaaaaaauaauaauaaaauaaaaaacccagacaccguggugugcugucugucaguugucccuagcccgggcaugcuguuuuagcgucuucuccugugaugugcaguacagcauuuuuuuuuuuccuuuuucucuuuggggacuucuccuccugccccaggcuuugucucuuuuucucauauaugaaauuucugcucaucuuuaagacuguucaaggccaccucggcuaggguguuaggguggauacuccacuaaugagguccacacagguuuuuucucccucagaaagcuuggcucguuuggaacauuuauucugcaaucucuuuuucauuccuaucucaggcuuuuauaaguacgcaguguuucuuguaagcaggaacuauguauaauuuucagcagugucaauaucaucaucaucaauaagcauuuuuaaguacggucauacauagcuuaaugauaggggcgcacucugagaaauguauccuuaagggacuucauccuugggugaacaucacagaauguacccaacacauaccuacaugguagagccuacuacacaccuagcuguaugcuguagccuauuguuccugggcugcaaaccugugcggcauguuacugugcugaacacuguaggcaaguguaacacaauaguaagcauuuguaugucucaacauaucuaaccauaggaaagguauuacagucuuaggggacuaccuuuauauauguggucugucagugacugaagcauuaugugguagaugucugcacccacaaauaugaacuacauuaugcuacauauugagaauacaaauguccuugcugccuucuagaauuguuaaauaauaauugaauugguauucagauuuaauugguccaugauaggaccugggcauauuuuaagcuccccaagugcuuccagccacagugcagccaacguagauaucacugaucucagcuaugugugugcccaggccuggagcacccagaaauggguucucugacgacauaguuuugagccaugucuuugagagcagaacaagugaggcagagaguacagugaggccaaggcaguugggggacugguugguuuccuggaaacuggagcuguaggccaauugccagaagaguggaggauauugaagaaugguucaggucuagggcugguggagaucuucagacucucuggaaguuuggaugugaguuuauagcccuacagggcacagaugugugacgucacugagccaacagguccaguggucaauagguccagauggaaacacacagccguuuuuuacugugaagauguccaggcaucaucaaaccuuuuuuccccaaaagcagcccaaaauucauuuuguuagugugacauauuacaauuuuuuaaauguuggcuaacuuuaauguguacacgugcacacgcaggcacacacacaugcauguacacacuaaugcucacagcacucugcugggcaaacaaaccucccugccgcccuugcagccugcugguugcagcuuaggccacagccagugggcccugccaggcguguaagcagugcgugccccgagcaaagucaggccugagaagacaacagcccucgcaggcugcuccuagucacacuguggagggaaggguggaguacacaccguaugugauucacgugacuccaccuuugugugugcuguagagaugagggcuuggaccaggguguugacacuggacguggggagggaggguggauaaaauucuauuacaagggugccucuggguagcuggggacagauuauuuguuggggauaaguguggggcagucaaaaccucucccgacucucuccagccucucacucccauuguggugccggcuaaaugaauaaaugcugcuuccuauuugaacuggugaguucuaaaggaguccaagccagcuaaauuggaaaagauacucuuuuccuaaaaaugaaaaacacuuuuuuuuuuuuccccugaaaacaccuuugggagguaaugcuaaugucuccgagccugggccucuaccccuagaccaaagggugguuaaugaaagaauccauaagcuguuucucucugucuugauuuuuuccaucucugaaaugguauggaaucuguucuuucuaauaaugacugaauaacauagugguuaaaauuucaggcuuugaaaccaaauugucuucaguuugucaguuuuaccucucugugacauugggaaggugugcucacacuuucagcuauaaaauaggaauaucaguaauaccuccuuaaagugguauacugaggaauugaauaaauauuuaguccuuacaauggugccauauauguugacuauuuuauuuuuauuucuauaaauugaaagaaguauauaauggauaaagauauaacaaaaauuauaaauauuguaaguauaagccuuuuaauaagaaaaagagaauuuauaccuacuuauagcagaggaugagaucugaauguuauuuuauuauuauuauuauuauuuuugagacggaguuucacucuuguugcccaggcuggggugcaguggugcgaucucggcucacugcaaccucugcuucccagguucaagugauucuccugccugaggcucccaacuggcugggauuacaggcaucugccaccacgccuggcuaauuuuuuguauuuuuaguagagacagaauuucaccguguugaccaggcuggacuugagcuccugagucaggcagucuggcugccuuggccucccauaaaugcugggauuacaggcaugagccaccacaccuggccccugaauguuauuuuaaugacgugaaugugcguaacuuuacauuaaccagugacaugaaugucaguaaguuuacagccucaucuaaucacuuuugcugucguuuuaaaugaccucuuucauuuuauaaguaauacauauacaagugauaacuauggaacaauuaggaaauguguagaaauaaaaauagcaaaacauaugucauacuacccaucacccaaggucauuuuugccaauucuuuaucuuucuaaacugcuauaugauccauugcuauaauuaauguagaccucucuuuaaaaauagaauuuuccuaaacaaauaauauucugaaacuuguuauuuuaaaaagccuguauugagcauuuuugcacauaaaacaauauacuuuuaggauauguuugccuaguucugguauaacauaauuuauugacauugucuuucauugaugcaugauuagauuauuuguuugauguguuaauuuauuaauguaugguuggguuauuuguuugccauuagaauuuaugucgugaugaccaucuuugagccucccacaaugcugucuugugggauuguuuagaguaaauuucuaggaaaggaauuccugugucucugaucccucaugccaaaugccuuuggaagaccacucugagcagaggugaaggugugcugaggcucucacugccucucuguggacccucuaacuaggguauggccagagcgggagggaggcagcgggagcaaacccucuggagucagccaggucugaguuccaugucugugcaggcaccggauaauuguaugccuuuaggugagccacagaucucucaauaagguaaacuugguaagguuauuauuagcauagguccuaguggauguuaaguaucgaguaaguacucgaccugcuaccacgacaauaaaauaccagggccuauauaaaguaagguucuuaaaucaaaauauguacauacauauauauacacacauauauauguauucuauguauaaaauaagguaccuguauaaaacaaggccaguugcuuucccuggcuaaucuggcggaaacaagaauuucuaaaaauguucaucagaaccagggccuacuugagggcggaaggugggaggagggugaggauugaaaaaccgccuguuggguacugugcucacuaccugggugauggaauaaucuguacaccuaacccuggugacacgcaauuuaccugcacguggaccccugaaccuaaaauaaauguuaaaagaaaauguuccucagugugggugacucaucagguguuuagaaauaccccacgaggugaauugagcauuugaagcacagucugaaauaaggugaaaacaaaggcaaaggggguuaugcguuaguaaucccuuuaccaucacccgcauccuuucccugccaaacagccgcaucuguccacgguggccguguggacaggugguggugugaucgacuuucuggcuaauuuagcacaacacauccucgagaucauggauccauggacuccagauccucagaacuggccauagauuuggagcuggggcaagauuuaauaaagugucacauguguuagugagcccaccugauucauugugaucauuaauucgugugaugugucaucccugugacaauucagaaagggucgggcgaaacccugcugcacccacccuccccuugaccagauccugugaauacaggcuuguguaccucccugacagcaagcauguuuuuaagguguuucuuuccgggaaugcuuccuuuuaauaacccuuucucuauuuuguuuacuuuauuaguuuuuacuuguuugggggacauugauuuuaaaaaggccguggcacuuggaaggugcuccugaagacagaccugaguauguguaagaacgaauuauuccgaggcagguaggaacauugccacugacucugugccuuuguguuguuguuuuuaaggaggaagaugaaggcucgugcucccccaccuccuggaaaggcugccacucugcaugugcacagugaccagaagcccccccacgauggggcccucgggucgcagcagaacuugguucgcaugaaggaggcgcugagggccagcaccauggacgucaccgugguccugccuagugggcuggagaagaggagcgugcucaaugggaggugagagccggugcugcaggaggagucgcuguacucacuuugcgaguauagcggggagaauggaaaggcggauguugauguauugcauuuuccuccucaucaggucugaccucaggaaccucauggauauaaaucgggcuuagugacuacuuagagcaggcugaacugucugucuuaccuggggugggcuuaugcuaauugauccagccaugauggcucaccagaugcuuaggagagcuggggcuccagggcugccuccuaugaggaggcaggcucagaaacgagggcagguacagcggugaccuacaccccugggugggacagcagccacagugugccucagguauccucagcucugaagggacgcagccaggagggcagccuccuaaauuaaccauucccacaccuacuugcagcaauauguggagguguguguacaacuggcaaucaacuuucuaaagugaaaauauuucagguuuagaugaaggaauaaaccaacccaaucauggauuuccaauuuaagggcuugaauuugagacccucaguucccacaugcacucuucucaggacugaucugcccguggcugagugucucacugcacuucacucacaaaaggugcggcugaaacauuggcaaagucuccuucaucauagcauuuugaguuugugaccaauagauuugcacauuuuauguuugacagugaucaaaauaaucaugauuuuauuguuuaaauaguuuugugcuauucuuacugauacuuuuagugauaacccaauguauaauaaaaaaacuaacaaagucacagaaaaaaguuaacuauaauuuauacguuuuacugaagagaaguaugauagaaugauuaauuacaaaaacuuucaagcauucauacauauuuguaugauucugaugcagcagugaauugaagcagcauuuauaagaaaacaaggagaauaagaaaugauauaaaaugggcugggcacgguggccuguagucccaucacuuugggaggcugaggcaggcgaaucacuugaggucagaaguaugagaccagccuggccaaaauggugaaaccccauuucuacuaaaaaugcaaaauaauuagccaggcauagaggugcaugccuguagucccagcuacuugggaggcugaggcaggauaauugcuugaacccaggagacagagguugcagugaaccgagauugugccauugcacuccagccugggcaacgagugaaacuucaucuccagaaaaaaagaaaugauauaaaauguuuuauucuuaugaagcaguuugcuugaguaauuuuaauggauaacggugaaaauuaaaucacucuggguguuuuuauucucacagaugccuuuuaaaaagugauguaagcauuuuauuuuaaaauaccaguauuuagauuauaguugaaauuaccuaauccuuugcaacuauuuuguuacuuuaucaaauuaaccaguuuauaaucaaaauuccaggugacagucuaauuggcaaaggggugcauacauuuuucaaaaguauuuuaugagauaagugaauaaaaauuuggggagcauugcucgaggccucggaauauaccuaggauuggaacuguugagucaugggauacaguauuucagcugcaccaggugaggccagccugcucuccaguguggugccacugggcuagaaugggagguugcuccucagugggggcccuguggcugugaucauagcaggagggcucaggcgcaauuaacugucuacaguggaucaaggugggaggugccugggcucaaagccugguccaccggaagccacuaucucuugcggcaguucgauaggcuuuccccccaggguucaugcacaguggagagacaggaguuucugugaguuucuuuguuuuauaaaguagucauaggccaaaguacacuuuuccuauauaacuuuguaacguaagaaauuagucgcauuauuauaguuuuaaaaaacacuuuaguauaugcaugaaauuuucucaguggguauauuaggguuuacucgccauucuuauauuuuagcccaauuccuagguacauauuuuguuuagaaaauggcauugugggccaggcaugguggcucacgccuguaaucccagcacuuugggaggcugagguagguggaucaccugaugucaggaguuugagaccagccuggccaacauggugaaaccccgucucuaauaaaaauacaaaaaauuagccaggcgugguggcgcaugccuguaaucccagcuacucgggaggcugagguaggagaaucacuugaacccgggagauggagacuguggugagccgagaucacgccauugcauuacagccugggcaacaagagagaaacuccaucucaaaaaaaaaaaaaaaaaagaaaaagaaaagaaaauggcauuguggaucaugucuuaauucugcaguccauggauccaguuuuacaaaugcacaaggaaagaauagaaugcgcauucuaaaaguaaaaauauuauuuuaaaagaaugcuuucauuucuuuuauuucccuuauaaaguagagguugccaccaugaaguuuuguaauguagugacugagaauaggugcagccuuagagauggaguguuaaaauaauguuaucuuucuuaaguagugaauuauuaucccuucucaugguuuccugaagcaucagugaguuauagcagcagcugugagcugccuccagugggucuuuggugggauaacuauugcggaugcaguagcuccuugcuuugggaauugguuuuauguuaugcucuuuauuaauauaagagugggcugcaguuaaauuccugacccuugcuuaaaauagaucuacuuguuuuuugucauugugguuucucuucugucuuaaaaaguggguuuaguaaagaacaugcaaccuuuucauaggguaagcaaggaguuuguaauuuauagucagccccuuaacuguguuauuuccugacaugaaggauuccacaaaggaaacacauuaguaauuggaugcugauaaucccauauggaaaaucagugaauuuuuuuuuuuuagcuucccuugaauuaagaaacauaaauaaaaguugaagucuguucuuacagauuaagacaugagaauuggugcucugagccguucauaggggaaauguucuggccuaccuuaaggaugguauuaccagcaccccacacagcugcuggacagaggccacaaucccaucauuuuaauugaggcacaagaacagaagaucuuuuggucaggugcaguggcucaugccuguaaucccagcacuuugagaggcugaggugggcggaucaccugaggucaggaguuugagaccagccuggccaaccugucucuacuaaaaguaaagaaaauuagcugggugugguggugcuucccuguaaccccagcuacucggaaaguugaggcaggagaaucacuugaaccugggaggcagagguuacaaugagcugagauugugccugugcacuccggccugggcaacagaguugagacuccgucaaaaaaaagaaaagaucuucaaagagcccuuuacaaaagggugucagguauuuagugugcuaggcugugucauuaugauauggucagugccuuguguccaaacugguguucaaggccaagggcuagggcagaagaaggcaagccuuccuuuugcagaagagaggaaaucugccucauauucaguccugugauucugccuuuacaggccauugcauccccuuuacaacagacaagcuuagaccugugcagggaguuuuaggucccugucugugugaaacagcacaggacucuugcagcagcagguguugggucuccauguuccuucuguagagggcucaccuguucucaggugcaagggaagggaggcugggagggacccucaucccucucuguccugugaagguauugauggagcacauguacagccucugaaaggucauggccuuggccuugcacucuuggaugugagguccuggccccagaggcugaaggaaguaacuuucgagaggacagcuuugcugccaugcacuguugaguaggccccaagaaggcuguuccaaaagucacaagguuaaaagucaggugcaccuuggugugauuaugcuucuauucgaagacuacccauuacaauagaguaaauuccugugagccagagcccacuuugguaaccugagcuagaagugagucuugguauguucaguggguaugaucaucuggaucuucacucaucauuucuaaugcccgccuucccaaccucccugugauguuucugccucauuaaggcuuuauuugugugggcuuaauccaaacaaagcugaaaaaaacaaaaacaugccaaaaagcccacugugauuugcagaaugcuaucaacauccgauuucuaauauguuuucuuuacgaaaaucuuuuuuguggggaagugacaagguuaaggagcuggcuauaaacuaugaacugcuuaucuucacaaaagguggacacauucuuccuaaacguucacagaaggugcuguugguguuuuugacauugguguuauaccaguuauacguaagggaggucucauggugugagaucuugauggauuaaagcaugugaucaugcuuauuuauucaugggucaaaauauauacugaguuuauugcuaacuuucgugaggcacugugaagaagacuccucagcaaguagaaaaaaaaaauaacacuugcaaaaugccgguuuaugugagaagcagggcauucaauauugcuugaagcuaggcugagaagcaggagguauguuggccuggacacugguauggccuguacugaagaguauccuguaggccucccugcagcuccaccgaucucaaacaagacugcgugugccacugggaacagugcuaggcaagcaaugaggaagcuguugcaucgcaguauuaauuuucuucaaacacaggaaaaauaguuuuauaugaaaaguagcauacaaaauugacaugcauuuuuaagcccaacacuaacagaugauuuuaaggguaacugggcuaugucaggggcccccaggguacauguugauugaucugcugagugagaaucacauagaaaacaacuaacuugcuuauaaucuggacacagaaggcucuagauuaugaaguaaggugaccuccaagauguaggccaaaaaaugaggagaucagaauuaagaaaggucacaguuacuguggucagcaaagggauuccuucaaggcugaagccaaccagaaugcacuccaugucugagaucgccuguucacaccuguccagguaacacaucccaucuggacaggguaacuggugguuuucccagguucccagacucugcacaucaccucucuccaugucaaaggacacaaccagcauugucuuuauuuauuuauuuauuuauuuauuuauuuauuuauuuauuuauuuuuaauagaugaagucuugcucuguugcccaggcuacagugcaguggcggcacaaucucggcucacugcaaccucugccuccgagguucaagugauucucuugccucagccucccgaguagcugggauugcagaugcgugccaccacguccagcuaauauuugcauuuuuaguagagacgggguuucaccauguuggccaggcuggucuggaacuccugaccucaagugaucugccugccucggccucccaaagugcugggauuacaggcgugagccaccgugcccacagccagcauugucuuuuaacaguuuugaaaugcggaugccuuuauagaaggcauucccuuuccaguuagcagcaacccccgcccccacuaaauucacaucaugagagcccucacagacugguagcagcugcuuggccccaggagguguguggguuugugagggcuuggccaacucucugaggucugacaccguccuccucacuguggcucuguuguuagucauggguucuguuuccggcgauguggcuucugauuugcaucugcgagguaggccccuacucaccucaguugacaggcccgggacccaggccucucagaaacugcauccuuacagagaccucagccucacaccuagacuucccugguucugggcuuccucaggucaccugucuccacacugacccuuuuuguguucugcugaugugucccuuuguguagggccccgucagcacgaacugccuguagugcagugggccacaagcuuuuuggcaucagggacugguuuuguggaagacaguuuuuccacagaccaggcuggggauggcuucgggaugauucaagcgcauuauguguaucacuagguucucauaaggagcacauacgcaguucacaauaggguugacucuccuaugagaaucgaaugccacugcgguuggacgggagauggagcucagggggaaaugcuuacuuguucacugcucaccugcugugcgaccuggcuucuaacacaccguugacugguccucgucuguggcaggcgguuggggaccgcugcuguagaggacccauauuaagcugucagacuggacucucucccagggcuugacucuguuaugccagagucugccucauccagagcuuagggccacagaguggccuuggucccacacaagaaacuaggccacucuggaccaguuuaagauuugacaguucaugcaaauuaaauuuguuuuaacauuguguugggaaguagcuacagcuacuuuaaagugauuuguaaacuuggcacugaguuaccuauuuacuuaacacauacauacuaagugugcacguccuggguacuuagagucuagcaauucucaaagugggguuccagaccagcaacaauggccucacuugagaacuuguuagaaaugcaaauucccagcccuuccccagaccugaguagaaaugcuggggaggagcccagcaaucuguauuucagcaagcccugaagguucagauugcguguuaaaguuugcaaucccuugcuauggugcaugccacuagcucugcuagaugucagggauacucgaugaguacgcaguccuaagaaugagcccaaggucucacuggugggguggcaugaacagggggacuguaggaaugauuugugucagcggcucaagaacggcccuuggcagccucaucacagaguauuuuucaguccauuuccacacugaauggggucugaggaucugguaggacagcuggcuuguaauguagaucgaaguccccucaauuagagaaggguaauucauuaauuggccagggucugauggaaauggaaguaggacuuggcuucucugacauuguguguuccccaagcagucuuuugcuguugccuacuuucugaggggcaguggccccucugcacuaggacggguauuggcacaggcucuccguuucuugucuagggcucugcuaagauuucaaaaagaaccaccuacaaaagaaaaccaguuuuuuucuaauugaagucacugacucaaaaaaauuuuuugaagucuguacacauuuggaaaauauuauuuuuaaagaaguauaauaauucuauuaaguuuaaaaucagagaccacaacaaauacaaaaaaaauaacauuuaccucuaucuuaugagcacuuaaaaggcauuugggguaacagagguaaagacguuagagguaaaaaugaugucgcggaggaaggggagagaaaccugaaaggccugcucucauaacccccuccaccccugcucucuugauuuuaagguaaucauuccauuuuguuacugucuuuuauccuuccauugaaccugagauuuaaccugaauguagauagaugaugagagagagagaggagaggcagagagagaaggagagagaugagauuuuucuugaugucuguguagucaaugaaaauggcgauccuaugggaucaucccugaggccagggagagcccuagaccuagucacuuuccuaacauaccugacucuuuguuugacauucugagagggucugauugucuuaguuuuauucuuuguacaauuggagaaacucuauucugcauugcuucaaagauguugcuuugaaagggucuaauaucuugguauuugcugagagcaggaugguguuuggcaacauacagauaggugauccucugcccugagcuaggcgaaugccuuacuauguagaauccaaaauagaaaaggugggagcaaauuaacucauuuauuuagcaaguacugaccuugugccuaccacaugccuggcacugugcucggugccuuaaaaauguuacuucacguaaaacucuauccacccugugaggugggcacugucauucugcucucaccaguaauaaagcugaggcacagaggaugcagucagccccacccaggucagagaggcagugagcagugguaccaggauuccaucccaggcaggcuguucugagcgccaucacugcacccagugcugaugugggaaaucacgcccaaucccuaaucaaugggcaaagcugcagaucaggauggggcugcuccaucagagguggugaggaggagaggucagacccaggagguggugagaaugugugaguggccaggcagccucuuccacuugcccauggcccaguggcacagugaccuacugaggucuuguggagggaugcacuuguaacacccaauuagagaaucauuaauccuuuguccucaggagaugagaggcagguugggaucugaugagcguguaaggaaaacccacagagaguaggcagcagcugugccucucuguccauuguugggcacugccauugucccaaggguggccucucugggugaauucuccaguagcaucaaaggaggcuagaaagaacuggcuguuuggaguuuggcauuugaaaaugucagccaguagcaacuuaaagggcguggugcaaaguagcagaaacggcauucccucacaccuugcugugcaaagacgugcuccagaaaaguguguaguggaaaaguagucaaucgagcugaauuuuacaugagacugggaagggucacaccaaguuucaaacccugcaggaaacaucauaagacgaguuccugcuuuuggacccauguccucacaggguugagcuuguguguguccagguucuuuaaugccaccaagucaggucuuccuuagaaagcuguguuuaccugacacaaauagaggcagccccagagagagcaaagcaagagccaaagcuggagcuccuggcagcccccaaaccucccacuuucauguggaagccccgcuguccugggugcggguuccagcccugggaagggauggugucugagguuuccuccagguugagaggguaacugugcccugcaaguaacuuaagcaugucugauaacucaugucuguggggacuggguuuuaguaucauguccuuauaggguuuggggguggaguuuugccuccccccaauuuaaauuugggcagguggguuguugaugaucuacucccacccucgacugcugaagauaucauggcagcuuucacaugaggagcacuugcugggcagagcugccuucacaggguggggcagggguguaaaggcccacauuguggaguauugaccagcagauuguggagauccauuuggcacacaagguggagauuugggcacucaauuauuuauuuggcugcaauuaauauacuccucugugagcacacugcauacuggcuucugccguggccaggugggaucauucucugugcuggggaaaagcuguggagccccgggcuguccacucccuuucaccucucuagaugcuccaaaccugucaccaguuauuggacuaaaagaacagaggaucacaguaguugcauucguguaauuuuuguguuugacaacugauuuguaucuguuuacuggguagagacagccucuugguggggauuagagggaaagcaagucaggucagacaagaguggaccccagcucccuugccucauggaaauccagggacccacuccccauccucagaccgcaggaggacuggaggacaccaugggcagugcaugguguggccacaggcucaucacagauacacaggauguggucaggagccugugguguucgcauuuuuaagaagucuguucgcuaugcugaggguucucuguggacugucgugucugcaugugcauagugauguucucccuguuuuguuuccuggagcucuucauugaguugaagguuuuuacccaguaucugaaagaaucagaacucaugguaguuauuaaccugcacgccccgcugugggguucuggaggguuggggcugcccaggccgcaccaggugcucccacugccaccagcacccacuucccaggggugucuaguaucuuccuuacuggcaccugcucuuccuuaaucacuuccuggagaguggaugaggguaaauauugucauggagauagcuuugagcguuguuuguaucaaugagaacauuauugaugcucuuuucuuguagcauuggcaugagaaagagggcacuuuagggauucuuguaggauuggguuugccuguggguuuaugguucaguguuagggcccugcagcucaugcucagggucacggaggaaugaacgagugccucuggcugaucaggcaccuagggcuuugcaaauguuuuuuuuuuuuuuuuuuuuuuuuuuaauugaucauucuuggguguuucucacagagggggauuuggcagggucauaggacaauaguggagggaaggucagcagauaaacaagugaacaaaggucucugguuuuccuaggcagaggacccugcggccuucugcaguguuugugucccuggguacuugagauuagggaguggugaugacucugccuucaagcaucuguuuaacaaagcacaucuugcaccgcccuuaauccauuuaacccugaguggacacagcacauguuucagagagcacaggguuggggguaaggucacagaucaauaggaucccaaggcagaagaauuuuucuuaguacagaacaaaaugaaaagucucccaugucuacuucuuucuacacagacacggcaaccauccgauuucucagucuuuuccccaccuuuccccgcuuuccauugcacaaaaccgccacugucaucauggcccguucucaaugagccgcugggcacgccucccagauggggugguggccgggcagaggggcuccucacuucccagcaggggcagccgggcagaggcgccccucaccucccggaugggguggcuggccgggcggggggcugaccccccccaccucccucccggacggggcggcuggccgggcggggggcugaccccccccaccucccucccagacggggcggcuggccuggcggggggcugacccccuaccucccuccuggacgggguggcugccgggcggagacgcuccucacuucccagacgggguggcugccgggcggaggggcuccucacuucucagacggggcggcugccgggcggaggggcuccucacuucucagacggggcgguugccaggcagagggucuccucucuucucagacggggcggccaggcagagacgcuccucaccucccagacggggucacggccgggcagaggcgcuccucacauuccagacggggcggcggggcagaggcgcuccccacaucucagacaaugggcggccaggcagagaugcuccucacuuccuagaugggauggcggccgggaagaggcucuccucacuuccuagaugggauggcggccaggcagagacgcuccucacuuuccagacugggcagccaggcagaggggcuccucacaucccagacgaugggcggccaggcagagacgcuccucacuucccagacggggugguggccgggcagaggcugcaaucucggcacuuugggaggccaaggcaggcggcugggagguggagguuguagcgagcugagaucacgucacugcacuccagccugggcaccauugagcacugagugaacgagacuccgucugcaaucccggcaccucgggaggccgaggcuggcggaucacucgcgguuaggagcuggagaccagcccggccaacacagugaaaccccgucuccaccaaaaaaauacgaaaaccagucaggugugguggcgcuugccugcaaucgcaggcacucggcaggcugaggcaggagaaucaggcagggagguugcagugagccgagauggcagcaguaccguccugcuucggcucggcaucagagggagaccguggaaagagagggagagggagaccauggggcaagugcgagggagagggagagggagacugcaaauguuuugaguucagagacaaaauuuuauuuauuuuagagucuuccaauugaccuaguaacacauuguacccacuaggugaucuguaaucgcuuguuaaauuaaauguguacuuuuaugucaguuuccuuccauuuccuuaaccaaaaaaaaaaaaaaauguccgcuguaccaaguaccuauugggaaaagugauuuucuuuuuuuucuuguguuuuauuuucagcuuuauugggaguguaauugacagauagaaaugguauauacugaagguguauaacuugauguugauauacauauauauuugugaaauagccacaaaguaguuaacacauccuucacuuuacagacuuguguguguauguguguguguguagugagaacacugaagguugacucucuuagcacauuucaaguauacagugcaguauugucagcugcaguccucaugguggacauuagacaccagaucuccagagcuuacuuguccuucguaacagaaacugugugucuuugaccaccucccuauugcccagccccugcaaccacucuucuguucucugcuucugggaguucaacuauuuuagauuccacauauaagugaaucaggugguguguuugucuuucugucuggcuuuuacuuaguguaguguccuccagcuucauccauguugucacacguggcaggauuuccuucucuuuuaaggcuguguaauacuucauuguauauacguaaccacauuuucuuuauccauucauccauugauagucauuuagguuacuuccacuucuuggcuauugugaauacugcugcaauagauacugcgaauagcgcugcaauagauaugggagugcagauaucucuuaaaaauucugauuucauuuucuuucuuuuuuuuuuuuuuugagacagagucucgcucugucaaccaggcuggaauauaguggcgcgaucucggcucagugcaaucuuugccuccuggguucaagcaauucuccugccucagccuuccgaguagcugggauuacaggcaugugccaccacgccuggcuaauuuuuguauuuuuaguggagauaggguuuuguguuguuggccaggcuggucuugaacucuugaccucaggugauccacccaccuuggccucccaaagugcuaggauuacaggugugaaccaccgugccuggcccauuuucuuuagaaauauguacccagaacugggauugguggguuauaugguaauucuauuuuuaauuuuuugaagaaccaccagacuguuuuccauaauggcuguaccaauuuacauuccugccagcaauguucaagguuuuccuuuucuccacauucucaccaacacuugcuauuuuuugucuuuuugauaaaauugccauucuaacaggugugaggugauauugugguuuugaauugcacuuuccugauggugauguucaguauaccuguugaccauuuguaugucuuauuuugagaaauaucuauucagauccuuggcccauuuuaagggaguuauuugcuauugaguuguuugaguucuuuaucuauuuuggauauuaaccccuuaauuggauauguggcugucaaguauuuucucccauuccauagauugcacuucucucuguugacuguuccuuugcuggacagaaagaagccuuuuagcuugaugcaguccuauuugucuauuuuugcuuuugcucucuaugcuuuuagugucauaucuguaaaaaaaaaaaaaacaaaaaaccaaaaaacaaaaacaaacaaacaaaaaacugcccagaccaaugucaugaagcuuuuuccuguguuuucuucucacaguuuuauggcuucaaaucuuauauuuaaguguuuauaaucuauuuugaguuuuuuuuuuucuguauagagugagauaagggucagauuucauuuuucugcauauggauauucaguuuuccuggcacuauuuauugaagagaugguacuuuccccauugugacuucuuggcauccuuggcaaagaucugcugacucuuaaugcauggauuuauuuuugggcucucuauuuuguuccauuagucuacauguuugauuuucugcaaguaccaugcuguuuuguacacuauagcuguguaagauauuuugaagucaggauguuugauaccuccagguuuguucuucuuucuuaagauaucuuugaguauucaagaucuuuuguuguucuuuaugaguuuuugcauuguuucuucucuguuucuguaaagaaugccaaugggauuuugauagggauugcauugaaucuguagaucuuuuugugagauauggaaauuguaacaauauuaauucuucuaauccaugaacacaggacagcuuuacauuuaucugugucuccuuugauuucuuucaucaauguauuauaauguucaguguaccaaucuuucaccuguuugguuaaguuuauuucuaaguauuuuauuauuuauuauugcuauuuuccuacuuucuuaauuuccuuuuuaaaugguuuauguauagaaaugccacugauuuuuuuggcugggugugguggcucacaccuguaaucccagcacauugggaggccaaggcggauggaucacgaggucaagagaucgagaccauccuggccaacauggugaaucccugucucuacgaaaaauacaaaaauuagcugggcgugguggugcauaccuguaguccuagcuacuugggaggcugaggcagcagaauugcuugaacccgggaggcggagguugcagugagccgagauagcaccaugcacuccagccuggcgacagagugagacucugucuuaaaaaaaaaaaaaaaagccacugauuuuuuuguauugauuuuauaauaagcaacuuuaaauuguuuauuacuuuuaacgguuuuuucuuguuguugaguuuucagagcuuucuauguguaugaucauaucacuuguaacccgggauaauuucaguuauuuuuugauguaugugccuuuuauuuauuuuucuuguccaaugccucuggcuaggacuaccaguacuguauugaauagaaguugugagagcggacauccuugcuuuguauggaccuuaaaagcuuucaguuuuucuccauugauuauaauguuagcugugagcuuuuuguauaugguuuuuauaauguugaaguaaauuccuucucugccuuuuuuuggugagaguuucagcaugcauggauauugaguuuugucagaugcuuuuucuguauccauugagaugauuauguaguuucuauguuuccuuguguugauguguuguaucacauugauuaauuugcaaauguugaaccauccuugcaucucagggagaaauccuacuuaguuguggaguauaauccuuuaaaugugcuguugaauuuuguaugcuaguauuuuauugaggauuucugcauccauguucgucagggauauuagccuauaauauucuuuuauuuugggaucuuugacuuuggugucagcaugauucuagccucauaaaauuuguuuggaaauaggcccucuuuuucuauuuuuuuggaagaguuuaaaaagcacuaguaucaauuauuccuugacuguuugauaguguucuucauugaaucgauuugguccuggacuuuuccguuugugaugagauuuaauugcuaauauaaucucuguauuuguuauuggucucuucaggauuucuguuucuccuugacucaauuuugguacaugucgaggaauuuauccauuuuuuucuuuuuuuuuagggaugaugugauuuguuaguguauuuuuguaauacugccuagugaucuuuuuuauucauauuucuaagauauuuguuauaauagcuccucuuucagauuuuaagucuucucucuuuuuuuaaugcagccaagaguuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgccacuacacccggcuaauuuuuuguauuuuuaguagagacgggguuucaccguguuagccaggauggucucgaucuccugaccucgugauccgcccgccucggccucccaagaguuuuuuuuuuaauuuuucuguucucuauuucaguuaucuuugcuguaaucuuuauuauuaacuuccuuaugcuaacuuugggcucaguuuguuuuuauucuuguucccugaaguguaaaguuagguuguuuauuugagaucuuccuccuccuccuccucauuauucuuauuuuuccagacagagucucgcucugucacccaggcuggagugcaguggugcgaucgcggaucacugcaagcucugcccucuagguucaaacaauucuccugccucagccuuccaaguagcugggauuacaggcccgugccaccaugcucagcuaauuuuuauauuuuuaauagagaugggguuuuacuauguuggccaggcuggucucuaacuccugaccucaagugauccaccugccuuggccucccaaagugcugggauuacaggcgugagccacugugcccggcccuuccuucuuuuuaaauguaggaucuuacugcuauaaacuucccuauuaguauuaguuuuguuccaucccauaaguuuugacaacuuuuguuuccauguucauuugucucaagauauuuucuaaauucccuuuugauuucuccuuugacucagugguugcucaagauuguguuguguaguuuccauguaccguaguccucccuuucugugggggauuuguucuaaaaccucugguggaugcuugaaaccacagaucguacuaaaguuuauauauaccauguuuuuuccuaugcauacacaucuauaauaaaauuuaauuauaaauuggauauaguaaaagauugacaaugaaucaauuuaaaaauaaaauauaacaauuguaaccauauuguuauaauaguuaucauacaccguggcuauaacuuuugcagauugaggcacaacugcaaaacuagcaugaauaucuuuuuucuucuucacaauuuuagggauagaagauucauuuuuacccuagaucuuagcaaccucaguguacuuuuuuuucuuuccuuauuaagucaggaacuuuuaccuuuucacuuaauggaugcacuuuauggcuuuucuuuggcauccaaagaaccagcaucauuacucuugaggucugaggccauuauuaaguaaaguaagggugacugaaacacaagcacugcaauaccaugacaagcgaucugauaacggagauggccaugaagugacuaguagguggguagaguauacagugugaauacauuggacaaagggaugguugaugucccaggcaggaugaggcaggauggugcaagauuucaucacacugauuaaauuugugaguuguucauuuaugaaauuuuccauuuaauaucuucagacuguggguaaaaugauaucacagaaggugaauuccauguuuguauuuuuuuuucauucuuagaaauacuguuauugauugcuaaugucauuccauuauggcuggaaaaggcacuuggaagauuuugaucuuacuaaaauuuucagaccucuuuugacaccuaacuuguuauauacccugaagaauguuccacaugcucuugagaagaaucuguauucuucugauauuagauggacauuauauauauuaggucaauguggucuauaguguuuuucaguuauucuguuuacuuauugauugaucuuucuaccagaauggucuauccauuauagagaguaaaguuuugaagucucuucauauuauuguauuauuauuguauugcugucucuuucucccuucagauuuaugaauguuuacuuuacauauuuaggugcuuucauguuggugguuuaaguauuaauauuuauaacuauugggucuuucuguugaauugucccuuauaucauuauauaaugacguuugucacuugugagaguuuugacuuaaacccuauuuuauuuaaugacaauauagcuaccccugcucuccuuucuuuucuuucauucuuucuuucuuuuuuuuuuuuuuuuugagacggagucucacucugucacccaggcuggagugcaguggcaccaucucggcuuacugcaaucucugucuccuggguucaagcaauucuucugccucagccucccaaguagcagggauuaaaggcgcccaccaccacgcccagcuaauuuuugguauuuuuaguaaagaugggguuucaccauguuggccaggcuggucucgaacuccugacaucgugaucugcccgccucggccucccaaaguguugggauugcaggugugagccaccaugccgggcuccuuucuuuaaccuuuuucaugaaauaucauucuucauucuuuauuuucaaccucuauguguccuuaaaucuaaaaugagucucuuguagacagcauaguuuauuauuauuauuuuauuuguucaucuacgguauuucuuuugauuggagaguuuaguacauuugaauuucaaauaauuauuaauagguaaggacuuacucuugccauuuugucauuuguuuucuaccuuuauuauaguucucuuacuccucuugguaucuuucuuugugguuugauuaucguagcaguguacuuugauucuucucucuuaaucuuuuuugcaucuacuguacaucguguguguauuugugugugguuaccauagaguuuacacugaauaauuuauaguuacagcagucuguuugaagcugauauccacuucacuucaaucauauacaggcgcucuacaguuuacuucccccucccacagacacuuuauguaacugaugucagauuuuauuuuucuguguuguauuuccauuagcaaauuuauguggguauauuuauucugacaacuugccuucuaauuuguauacuaguguuuaaagagauuuguguguaccauuucaguauuacaauauucuguguuuaccuuuagcagugagauucauauuuucauaugcuuucaugaugcuguuuaucaucuuuucauuucagcuugaaaaacuaacuuuagcaggucuaguggugacaaacuuccuaguuuugacaggggaagacuuaucucuccuucauccuuaaacuacaguuuuucuggauaaaguauucuuguuuggcauuuuuuucuuucaguacuuugcuguaucaucccauugucuccuggccugcaagguuucugcugauaaaucuuacaauguuucccuugugugugacaaggugccuuucucuugcugcuuucaaaauugucucuuugucuuuuauuucugaaaaacucuuaauauuugagacaaacuauaaugugcuucagaguagugcucuuuuuguuuaauauauuugaagaucuuaggacuuuaugucaacuucccucuguagaguugggaagauuuuugccauuauuucuuuaaauaggcuuuccaccacuuugaugguguucuguaaguuucauaggcuuucuucacuuuuucuuuuuuuuuuuuucuucuaacugguuaauuucaaaugaccaggcuucagauuuacugauucuuuuuccuacacgaucagguuuucuguugaagcugucuauuggguuuuucaguucaaucauuguauucuucagcugcaagauuucuguuugguuucuucuugaugcuucuguuucauuauuaaauuucucauuuuguucauguauugauuuccugauuucauuuaguuuuaaaaucuguauucuccugaagcucauugagcuucuuuaagauggcuauuuuggauuccuuuucagguaauuuauggaucuccacuuuucugggguugguuacugggguuuuguuaguuaacuuuggugguguuauguuuaccuaaugcuuugugguccauguaaacgugugugugucugugcauuugaaggagcagacaucuccagucuuuacagacugguuuuggcaaguaaggaucuacuccuagcucaccagacugauguuauugccucugguaucucagucaagcugaguuuggagucagguaaguuggccguuucagggucugcaguugggacugagcuuggggaaccugucaccaaggguaugaauagacgugucucccagcaggccacaguggagaggggcugaagccaggucacaugacuacuuuaguaucugcaguugggucugaggucagcgagcauguuauuggggggauagguuggguauggccccucucaggaaauggaagaugggacuuuuggaagcaccacagcuccuugugguuggagcugaguucauaggaggacagggaugcuuucaguccauagcugguaccaaagccuaugagccugccagcaggcugugggccugauuucucaguguaucccuccucagucuggggcucuaccaggguuucacaaccuccuaucuggaucccaaagcucuuacaaaggaacuucugugcauggcaggcugccaaaucauuuuuuucuguugggguacaugagccagagacuuccuguucuacugucuuacugaugucacucgcaccuguguguuuaccagugcccugugaguucccaaucuucaauuuauuugguaacaucuggaaaccauaauuauguccugcaagaauuaugcaaguuacuuauuaaggaauagaucagaggaaaaaaaccugugcccaacuucuugggaaauucauaggaaaagagaguuuagcuuuaaauaaauagaaacauucugcuaggaaaauguaaaagaaauaaaugcagagaaucccaauaagacacuucacaagaagaucccuccuaagauacauaaucaucagauucuccaaggucaaaaugaaagaaaaaauguuaaaggcagcuagagagaaaaaucaggucaucuguaaagggaagcccaugagacuaaaaauggaccucuuagcagaaacccugcaagccaaaagagauugggggccaauauucaauauccuuaaagaaaagaaauuccaacccagaauuucauaucuggacaaacuaagcuucauaagcaaaggagaaauaagaucuguuucaaauaagcaaaugcugaaggaauuccuuaccuccaaaccugccuuacaggagcuccugaagcaagcacuaaauauggaaaggaaacaccauuaccagcuacuaacacuaaaguacacagacuacugacacuauaaagcaaccacuaaacaagucugcaaaauaaccagcuaacaucaugauaacaggaucaaauccacauauaucaauacuaaccuugaauguaaaugagcuaaaugccccaauuaaaaggcacagaguaguaagcuggauaaagaaccaagacccauugguaugcuaucuucaagaaaccugucuuacaugcagugacacacguaagcucaaaacaaaagggacugagaaaaaucuaccaagcaaauggaaaacagaagaaagcaggaggugcaauacuaauuucagacacaacagauuuuaaaucaacaacgauaaaaaaagacaaagaagggcauuacauaaugguaaaggguuaaauucagcaagaagacauaauuguuuuaaauauauaugcacauaauacaggagcacucugacucauaaagcaguuucuuaaugaccuucaaagaaacuuaaacucccacacauuaauagugggagacuuuaacaccccacugacaauauuagaccauaaagacaaaaaauuaacaaagauauucaggaccugaacucagcacuggaucagauggaccugguagacagcuacagaacuuuucauccuaaaacaacagaauauacauuuuuucauugccacauggcuuauacucuaaaaucgaucacauaaucagaaauaaaagacuccucagcaaaugcaaaacuuaaauaauaacaaccaaucucucagaccacagagaaucaaauuagaaaucaagacuaauaaauucacucaaaaccauacaauuacauggaaauugaauaaucugcuccugacuuacuuuugguuaaauaaugaaaggaaggggaaaaucaagaaguucuuuuaaacuaaugagaucaaagauacaacauaccagaaucucugggacacagcuaaggcaguuuuaagagagaaauuuauagcagcaaaugccuacaucaaaaaguuagaucucaguuuaacaaccuaacacuacaauugaaagagcuagauaacuaagagaaaaccaacccuaaagcuagcagaagacaagaaauaaccaaaaucagagcugaacugaaggagauugagacacgaaaaauuauucaaaggaucagugaauccuggagcuguuuuuuuuuugaaaaaauuaauaaaauagacugcuagcuaggcuaauaaagaagaaaagagaggagauguauauaaacacaaccagaaauagcaagugaggugucaccacugaccccauagaaauacaaauaaucaucaaaauauuaugaacacuucuaugcacauaaacuagaaaaucuggaagaaauggauaaauuccuggacacacacacacucucccaagacugaaccaggaagaaauugaaucucugaacagaccaguaacaagaucugaaauagaaucaguaauaaauagccuaccaaccaaaaaaaaagaaaagaaaaagcccaggagcaaacggauucacagcugaauucuaccagauauacaaagaagaacugguacuauuacuacugaaacuguuccaaauaaauaaauaaauaaauaaagaggaaggacuccucucuaacucauuuugugaggccaacaucauccugauaccaaaaacugacagggacaccacacacaaaaagaaaacuucaggccacuauccuugaugaacaucagcgcagaaauccucaacaaaauacuggcaaacugaauccagcagcacaucaaaaaucuuguccaccacgaucaaguagucuuuauuccugggauguaagguugguucaacauaugcaaaucaauaaauguauuucaucacauaaacagaacaaaagacaaacaccacaugauuauuucaaaagaugcagaagaggcuuuugauaaaauucaacaucccuucauguuaaaaacucugaauaaacuagguauugaaggaauauaccucaaaauaauaagagccauauaugacaaauucacagccaagaucauacugaaugggcaaaagcuggaaguauuucccuugaaaaccagcauaaaacaaggaugcccccucucaccacuccuauucaacauaguacuggaaauuuuggccagggcagucaggcaagaaaaagaaauaaagggcauacaaauaggaagagaggaagucaaacuaucuccauuugcagaugauaugauccuauaucuagaacacccuauagucuuggcccuaaagcuucuuaagcugguaaaacaauuucagcaaagucucaguauacaaaaucgauguacaaaaaccccuagcauuccuaaaaaccaauaacaguuaaacugagagccaaaucaggaaugcagucucauucacaauugccacaaaaaaauuauaaaauaccuaggaaugaagcuaaccagcgaggugaaagauuucuacaaggagacuacaaaacacugcucaaagaaaucagaaauguuacaaacaaauggaaaggaaggaucaauauuguuaaaaauggccauauugcccaaagcaauuuauagauuuaaugcuaugccuauuaaacuaucaaugacauucuucacagaacuagaaaaaacuauuuuaaaauucacaaagaaccaaaaaacaaacccaaauagccaaggccauccuaagcaaaagaacaaagcuggaggcaucaugcuacuugacuuaaaacuauacuauagggcuacaguaaccaaacagcaugcuauuuauacaaaaacagacacauagggcaauggaacagaauggagaacccaaaaauaagaucacacaccuacaacuaucugaucuuugaugaagcugacaaaaacaagcaauggggaaauaacucccuauucaauaaauggugcugggagaacuggcuagccauaugcagaagauugaaacuagaccccuuccacauaccauguacaaaagauaacucaagauggauuaaagacuuaaauuuaaaaccuaaacuauaaaaacccuggaagacaaccuaggcaauaccauucuggacauaggaacagucaaaauuuuaugacgaagacuccgaaaccaauugcaacaaaagcaaaaccugacaaauggaaucuaauuaaacuacagagcuucugcacagcaaaagaaacuaucaacagaguaaacagauaaccuacaaaauaggagaaaauguuuuccaacuaugcaucugacaaaggucuaauauccagcaucuaaaaggaacuuaaacaaauuuacaagaaaaaaaaacaaaacccauuaaaaaccugcacguugugcacauguacccuaaaacuuaaaguauaauaauaaaaaagaaaaagugggcaaaggacaugaacagacacuuuucaaaagaagacacacaugaggccaacaaacaugaaaaaaagcucaacaucagugaucauuagagaaaugcaaaucaaaaccgcaaugagauaccaucuuacaccagucagaagggcuaucaugaaaaagucaaaaaccaacagaugcugguaagguugcagagaaaaaggaacacuuauacacuguugaugggauuguaaauuaguucaaccauuguggaagagacaguguggcaauuccuccaagaccuaaaagcagaacuaccauucaacccagcaaucccauuacuggguguauacccaaaggaauauaaaucauucugucauaaagacacaugcauguguauguucauugcagcacuauucacaauagcaaagacauggaaucaaccuaaagacccaucaauaguauguuggauaaagaaaauguaguacagauacaccauggacuacuaugcauccauuaaaaaaaagaacaagaucauguccuuuguaaaaacauggauggagcuagaggucauuauccuuagcaaacuaaugcaacaacagagaaccaaauacugcauguucucacuuauaggugggagcuaaaugaugucaacacauggacacauagaggggaacaacaacaaacacuggagucucucagaggauggagggugggaggagggaaaggaucagaaaaaauaacuaauggguacuaggauuaauaccugguugauaaaauaagcuguacaacaagcccccaugacacaaguuuagcuguguaacaaaccugcacauguaccccugaacuuaaaaguuaaaucaaaaagauacauuauauuucugaauaacugaaaauuuagugucuuguaugcaugaaaaauauuugugcuaacagaccuuagaugauccaacucaacauacccuuggauuuaacuaaaaauauaacuauuuuccaagcuauuaauuaugauuuuucucuuucaauaguguuguuuguuagugcugaaaauguuaacauauugcucuacaaccaugcagaaggaauuaaugagcuucuguugucuuuuuucauaagcauaucuaauuugcucauucauccacuuguucauuuguucuacccuuauuuagccaggcaaaagagagagugcagucauuccuaauaaucaugauuuguuuuccuuuuuucagccaugcgaugauggaccuacugguugaacuuugccuucagaaccaccugaauccaucccaccaugcccuugaaauucggucuucagaaacccaacaaccuuugaguuuuaagccaaauacuuugauugggacccugaaugugcauacuguguuucugaaagaaaaaguuccugaagagaagguuaagccuggucccccuaaggugccugagguuaguagguaccuacauggaaauaccugugucugaauguguggcagguccugaguaggggccaguguggcucuucuuaucaaaguacagugcagagagcuguggcugaggcugcuacuuucaugccaggcaaagcuaggcacuaaacagaguuuguuuuaggagacaaaauguacacaauugaauaauguuuauuguuguaacauugcuucuuuauauauuauagaagaggaauugaucuacaguggagcuauccauuagaccuucauucaaagaggggcauggucuuuaauucuguacuuucuuauaugauagccacuggcugcaugcagcuuuuuuaaaaauuugguauguuuauuauaacuuaaauaucuaaaauauucauguagauuuuucuuuuuucauuuuaauugacacagcuuuugaacacuugaaauguggcagguaugauugagaaacugaauuuuuaauuuaauuuuaacuuuaaauuuaaauugccacuagcuaauggcuaccugauuggacaguguaguucuagaauucuuccugacucaggaagcaguugguauccauagaagauuuaaacaucuucccagaggaagagaaaagaaagggaaaaaaacuuuuuugaaaaacugaugucagaaauauuuauucauugcauuuggagaauaucuuauauacauagcuauauuccaggcuuuuguuuauuaauuaaaauuaauucuaguagcuuauuauauacuuuuauuguuuuuguuguuguuguuuugagacggagcuucacucuuguugcccaggcuggaaugcaguggugugaucuuggcucacugcuaccucugccucccagguucaagcaguucuucugccucagccuccugaguagcugggacuacaggugcaugccaccacacccggcuaauuuguguauuuaguagagacaagguuucaccauguuggccagucuggucuugaacuccugaccucaggugauccacccaccucagccucccaaagugcugggauuacaggccugaaccaccauacccagcuuuauuguacuuuuaaauaaggcuuugauauuaaucuuuuagcuaaaauuaaaagcaauguuacuuucauauucuuagcagaccuucuaaauuuuccugcuuuuaaaaaugguaaugcagccaacauuaaucuccuauuaauuucuaggauugauugguuagugcauucucacuguuaucuggaacacucugaccagagauuuccccuuauuccucaaguaaacaguguuugaggcagagcaucucuguauauaccuugcgucuucccuugacuuccugcuucucagggcaggugagcccaggcaucugcaugauuccacuuguuagggcaggagaggaccaguaaaggagcaguagguuccgucuuuucucccaaaaugcauuguuaucccagccacugggcccugguacgcaggcuggaagagagcgugaggccuuccuuugcugcucuuuuguucaaucuacauuuacuguguccagcucuacagugucuuagcacaauuagagugaucaguaaaagcggaagaaaaauaaucaaaaagugggagaaaaaugacuaccacuuuaucugcagucauuuagaauuagcauuagucaacugaguguuuuucuuccugauuauuauauaugccugguguuuuuuaaaauauauuuauagcuuaaauacguguguguaguguguauacauaaauacauguaggucuguguacacacuguauauguuucauauauguguguauauaguacauauauacaguauauauguauuuauauauauauauaucuauguacauauauagauauuccuguauuuauguggauauuuugacuccuuaaaacuuugaugucauguuuuuggaggguuuuucuuuaaauuauucauacugcuuccaaacuuuuuuuuuuagaaaaugcauauaagugccauguguucacaucuggccagaacccuuggaagacaguaaaguauauguguuggauuuuaaauguagagucuucccugauguuuauuucgcuguguuguuagcagcuuguucacuagcaagagauucuaaaccagauuuauuauucuagacauuuguuuuucaauauucauuaugcuguuuucccccauuacucacucaauuuguggaagaaggauucaggcuacacacaauccugccacacccaauugucaaauugacacaagaguugaaggcuugugggaggauaucuuacugaauucuuuuugccuguguguucuuccagaaaucugugcguuuggucgugaauuaccugcggacacaaaaagcuguugugcgugugagcccugagguuccucuccagaauauucucccagucauuugugcaaagugugaggucagcccagagcacgugguucuccucagggacaacauugccggagaggagcuggagcuguccaagucccugaacgagcucgggauaaaggagcucuacgcgugggacaacagaagaggugaggccccgcugcgucucacgcaccugcccauaaucacacggaugcgcggcguguacauguccccuguuggcucuccccagcacucucaguagcgccagggagagauggguacaugaaguuccaggcaagucaaguugaaguaggcaaaaaagaaaucuggccuguuuucauuccucuggauugagcugugccuccuuucucccagcccugaacauguccuuuauccuuugucucccugcaaacuuccacgacauaaguaaaaggggaaaaggugaggugagauuagagcuuaugcucugaaguaacuacuccaaaccaucuauaauacuuucuuguggguugguggcucacacuuguaauccuggcacuuugagaggcugaggcaggagaauggcuugagcucaggaguucaagaccagccuggacaaaauagugagaccccgucucuacaaaaaaauuuuaaaauuagccagacgugguggugcauccccauuccuguagucccaucuacuggagaggcugaggcuggaggauugguugaacccaggagguugaagcugcacugagcuaugauugcaccauugcccucagccuaggugacagagugagacccugucucuuuaaaaaaaaaauuaucuugauuuucuuuuucaguugccauuaacugcuguucccagguuucaaacauugcucaugucuaaaaccaguggcagaaauucauuuagcuguucucuaaaacugaacaauuacagugcgugagauccauuccugaagauaacuuuagggccaccuuaggccuccucacuguguugccagugucauccugcuugcucaucaugugaaacuggcuuuuaguaugaggccacaguuagagccacuggugagaguggcagcccagaggccuugcuggugcagagacuguuauguuguguaagcacauguuucugauugauauagagugcuaacugcuacugucaggccaaaggaaauguuauauuccuugaccuuagaaugaucaaaauggacuucguaaaaguuucucuucuaauaagccucauuugaugucuguugucucuguuucauuauuccacaaauauugaauagguugaguuuaaaaaauauauacauauucaaguuuuuccuguuuuucuaugacuuuuuuuucuaauuuuuuccaacaaaaauguauuuuuucucuuuuuuuuauuuuuugagauggaauuucacucuuauagcccaggcuguagugcaauggugcaauaucggcucacugcaaccuccaccucccagguucaagugauucuccugccucagccuccugaguagcugggauuacaggcaccucccaccaugcccggcuaauuuuuguguuuuuaguagagacgggguuucaccacguuggccaggcuggucucgaacuccugaccucaggugauccgccugccuuggccucccaaaaugcugggauuacaggccugagccacugcgccuggccauauuuuuucuuaauaccaaguuuauugugaaauccaugaucauaguggaaucucuguccagccuuccucuccccgccaaguccgcccuugucuuccuggguaucuggcaucuagaucugauuugacauucaagagaggguuuuggcucaguugaguauaagauacauggacuguuuauuucuucaaaaaaaguacucugacauuugagaauaaugcaucuuguguuuuauccagugucuuuuuuaaaacacagacagaaauagucucaguauugcugcaaaggccugguggcacugaguauaucagcacuauuuaaauuugguuuacaugacucuuuggaaacagcuuccauuuguuaagauaaaaagaaaaauaaagggaaaacuguuucacguucagguaucugaaauaaaaaggcuuacaaguguuucuguuacaugcuaccacuuggauguaucuugaaagguagauguugaaccuggcacuugggagaagugauauaaaaccugccugucugugaaggagaggacccaggauagcccauggucauugggaauguaggagcugaaguguucauguggucaggggcccagagcaucucuucugauccucauaugggacagagcagaacaagccggugcggucagcuuggccguucagauuuggaagcacuucugcccuugguuggaacuagcugcucccaaaccuccaagucccccucucuacuccuuuggacauuuuggcccuuuccaccccacccccaaggcaccacgagcuuccccaccaugggggcucugcuccagccuuguggccagcaccccuuucgucuggaccaugccugugccaugccagcugugacauuugauuaccgucccugccaaaugccugccuccugcucacugucaaauauucgaaaagaaaagacacuuguccagaggccaucuccgaggcucccuuucuccccuacaaccgcccugggcaggccugcuggguacugcuggaggagcccuuacuuucaauccucuugguaggcacuuggaggggacagacguccacuccugagcccuaccacugcuggagaacagaagggcagcuggcaggaggugaggcauugcuacgcagaggccugcccuccccuggaauccccggugggagcaucuugauaaagccaagggcucugcugccaccugcguccucagcggugcuuagcaggcuaugcagcuguggcccugagagggccagcccagagaggcaagcugacccagcaagagaccuucucacugcugcagcaggacagccccccucugaggcuugugagggccaaggccugggucagggacucccacacaucucaaagcuggaccucacucucucauugccugccuuuuccaguucgucugagcaaaacucaguccgagccuucccugagcugucaagguacagugaaccuggggcuucccgcucccgcugugaggcugcacuaugcauggcucuggggucagagcugcacagaggugauguuuuugugccagacuccaaggaauggaaguuuggcuuggggcccuccugaaggugcaugcgaggcugacaugagauuuugguuugguuucuugauucccugguugguucagauaagaaugcuucuuaggagaauuugcuguguggcucuaauugaugagaaaugagggaggcuguuacagaaaacaaauucuguugcccaauaauucagggcagaucagaaguggugugcgcaggaaaggcacccuuuccuuuucaccucugccugcccaugcuuaccugccccugaaggccauccugcaugcuacagaauuugggacaguauggauuuuaaaauuuaaccuuuucugucauagacaaguaugcaaaugauuaguccagauuuugcauuuauuccaacaucuauuuaaguuucauagagauauuucuauacagaaagagauguuuauauguauauauaggcagauauagauauauguguguguguguguguguguguguauauauauauauauauauauacuuaaacauauacauauauguauauacauauguagaaugcccauuguacauuugcagauguugaccuggucccccgcuuccauuuacuccuuauggccuuguucuggucacugagucuccuccucuagacaagugagugguuuggacucguuggucuuuaaggguccuucauccuucucugccacucugcaauucaucuuuaacauuuuucaaaucauuguaaugcuucagaaaguaaaacuuucuugcagacugugugaguucccacacuuuucuuaauauuuaauuacguguaaauuagaguaaauucaaacaaaauaaaugccacccucagcuuaucauaccauaggcaccauggguucuagagcucacuugcguguguucgagggcuggcuaugcaucaguuguucauuguugcucugcuuuauagcugggcagccucuggaaauuuuggcugaugggaacacugaguucuccuacuuugcucccaaaccaguucuucuucagugucugccaagccucuagaggccucauaggaggccccuaucagucagugacugagaccaaagccucaccucuaaaaauagaccaucaguguuaggcgcagcucagcacugugagucacaggccccuggugccuccagacagcugcaggcuguagcugcaugagaaagugucucucccacuauugaggggcauucuggugccggggcuguccuggacccuucgucagggagccgaccucaguccuuagaggugaugaucagccacuguccucauucaagaagagaaacaacaggcuagaucucauugcaguuuucugaugcagucuguccuuucuguggucgguguaauacagcuuguguacuaggaaaaugcucuacuucucgauuaucaguaggauacuaugaugucaucuguuucaacauagacaauuucucaacuuaagauuuuucaacuuuaccauggugugaaagugcuaugcauucaauaugcuccuggacuuacgauggggucacaucuggauaaagccgucgugaacugaaaguguaaccccaucgucaguucgugagcauccguugguccaugucacauaccacucaauucuagaaacauccuugguuauaaacauacauauuaaagcauauaauaguuuagaugcagucuuaacugugugcucuguuuuccucuuuauagcucuguaccuaauagagggcuugcugcaacuaacuuuacagcgcguuugcacacaugcauuggugcugcugcaccauguugcagugggcccucugauuuggguacugugcgauguggagccugcucagugccuccacuggagccuccugcauguaaccaaguguccuggcccugcccugguggcuaggaugugcaccuuugcuccuacagcgugauaucaggagcgugugugcuggguuuuugcuuugcuguguggacgcuaucaguguucacgccuguguuauuaaugcacugacugcuguguguguucucuaacucaaaugugaaaucauauauuagcaggucaagaaguuaauugaggguuaccuuguuugcauuaauagucugauggcagaauuuguaaaaucccaguccaugauucugccaccaaugguauagagcucuugcuaucaguuggcagugauaugggaaaaaucauuuuucuauccuccaggaacaccuccacuuuccuucuucuugucauaucuguaugcccuggcagagaagaauggaaugaaguaaugacaaaggccuuuccugagcaaaucaugacacuagugagcagugugcugagcugugugagugccgucugcgugcuugaugcacucacccucaaccugcagaugaagcugcugaggcuuggaggagcuaagugguuuuccgaagugugccucacacaugggcgcucuuaaucucucagcaccacucccaagcguguucuccagacccucagcuuaagccuccuuaggggcuaguuugacuguguagugcugggcccugcacccagcguuucuuauucugggggucuggagugggcccaagcauucgcaucucucauaaguucccagcgaugcugaugcugcagguuccaucucgcuuugggaaccacaucccauggcugucuugucagcugacagacacaucugggcuucagugugcuugucuggaauuuggaagguuccaaccuggcucuagaauccugaugaagaaaaauucaagagggguugaggauuuagagcuucaggaaaaagaaagaagaaaacaauugcuccccuagagaauguaauuugaaaggaaaacguucuggaugcagcagaggaaggaaaaucuggaaaggugguuccugggagauuugaugcaguuguuucaaauaccaccuggggagcccauagcuguuacuccauuuucuggaaaugagcaggaaagcugcugauuuauuucauuuaguuaaaguuuguaccucacucauaauucuuaaagcagguguauugcacugaugucgcagucuuagagcugugcugauuuggcagccacaggccucauguggcucuugcauguaccgaguccacacugauaugcuguaagccuaaagggcugcuggauugugaagacuuagcaccaaaaccaauguaaaauaucucaucaauacuuuuuauauggacugcaugauagaaugacaauauuuuagauguauuggauuaaaugaaauuauuacaauuaauuuuacuugguucuuuuuaauguagccacuaggaaauguaaaauuacauguguggucugguuuagcuuucuguuggacagcucugcccuagaacuuuauuuauuuugucauucuccaaaagggcacaaccacacccagagaaaaugccuccaucauuccuaaaagacuguguaagaaccuguagugauuucccaaauggaccugaggacuugaaguggcucggacagcuuugaaagaaauaguugauggcuuucccucucuuacaagaacuaaaaguuuaagaguagaggauucauuuauuaagauuuuuuaaguaaaguauugaaucucuuguuucagaugcugaaaaauaacuuagugcuuuuuuuuuccagaaaccuuuaggaaaucaucacuuggcaaugaugagacagauaaagagaagaaaaaauuucugggauuuuucaaaguuaauaaaagaagcaauaguaagguaauggauuaaauacacauaugauuuuguaucauguaaaaaaaauagucucuugaaauacaugcauucaaccuguccuggaacuuuucuaaacaauucuauuuaagaauacuaauuccuucagguaaaagagagcuuauuaguaugcacuggaaugacaggcugugcuuccacacuugauuccaaaaggaguaaucuugggugauggugguuuauucacuagggggacaggaagccugugggcuccugaugaccggggccaugagcccuucugccuguggguguuccgguacuuccacagaacucugccuguggcugaaacucaguaaaucuuguuuagauuaaugaaugagugaauggauguuauaguuaaguguaaauagccaauauugcuaucagugaacuguagcuuaugccucguggcagagaagaguaucagucauugaacuugucuucuugcuaguaauuuuuagauguucuuugguccuccugauaugaucugggaauguacuaugugauaaguuaauuuuauugauuuuguugguguuuaugaaacacaucucagagucauauuuuggauacaguauucuagaguaauuaagucauaguacccagaauaaaaaugaagauuuuuauaauuaauuauaagauuaucaaacccauaaaugccuucugacuaccaagaaaagaaaaugcucauuauccguauuuauauuugcuucacaaguauauuuuacuaauaucuaguauuuuauccuuacuaauaaguaagacuaaaaaagacaaaacuguuccagugaauguuagguuuuaauuccacuagcucaguuuggaagugugcuccaucuguauauuucuacaagagaugugaagacuggggacucaaguuugugugcagaccuucucagugccauggugcagauaggugcauguagcccaaggccggacaccugauuuccugcccuucaguggccuguggugcagccucugcuguuagaauugugguuuacccagguuugcugaugaggauaccagggcucagagaaauaaaguaaccuucuuagugucccaggcuuagacacagaugugucugcgugcagagccagcacgucccuguagcccugugguguuugggaagggaggaggagagugagagccagaugagaacagaagguccaguggagcucggccgaacuggcagacuuccugucuuuaagaguuuuucacaaaccucagauucaccucugcugaagcuucgguaaugguuuugugauucucuuguacuuaagagauugagcuuuuccccauguugugcuuuucuccauguuucugcauguccuuugaaaaaucuguacuccaugcaugucuauguaagaccuuuggcucccugacauuuucuauccccucccacucuccaacuaucccuuccucucccccucucuuccccccuacucucccuccuccucuccuagcuuccuuuccugucagaauuacuugaaaucacagaagcagaauuuuguggccgggcgcgguggcucacaacuguaaucccagcacuuugggaggcugaggugggcaggucaccugaggucaggaguucgagaccagccuggccaaugcagugaaaccccgucucugcuaaaaauacaaaaaguagccaggugugguggcagguaccuguaaccccagcuacuugagaggcugaggcaggagaaucgcuugaauccgggaggcagagguugcagugagaugagaacaugcuagcgcacuccagccugggcgacagagcgagacuccaucucaaaaaaaaaaaaaagagaaucagaauuuuguauuugaauuuuugcucacucuuugaauguugucuuguugguuuuuuuuuccugacguuuuugagauaaguuggcugggacuguguucacccuuguccuccuugauccugaggacaccaguucacaguaaaauccaccauuccucauuccucauuccucacccuuagaccucaaguaguuguucucuuugugucuucuuccuuguaaaagaugaaauggccagaaaaaccaaguaaaaaaucuagaaagacuuucguuuuuagcaaaguaaggucaccuaaaaagcuggagauguggagacugacucagcuucugauaguucaggguguggggagacaccacaucuggcaacacagcagugaaggcgcagucagugauccagucccguccguggauugcaagggacuuucugucuuucaccauuucgauacagcagugaaggcgcagucagugauccagucccguucguggauugcaagggacuuucuguuuuucaccauugucgacacagcagugaaggcgcagucagugaucgaguccucucuguggauugcaaggggcuguuuuucaccauugucaaccuaaagaaagaaacugacucaaaauuaauauagauaguuuaucugggccaagguugaggacuguagccugggacacacuucguuugccuuggggaaugcuccauucagccguaguuacaagaagguuuuuuagggcaaaaaggaagaagguguggcugacacaaaguuguuugacaaggauucucacuaguuuacagaaauaacgcugauuggugauugacuguacacuccugaacugcggcagaugaguuauggcauccaguguauggcauuuuguagcuacuuggcaaaaaauucacucaguguuacagcucaaguagcaauuggcuuuaagagcuaauuauuuagcucaggcgggugugggacaugaccaccacugcauuucaaugcuucccugggccugauaauuaaaaggagcucacauucuguggauaaaaaguguauuuauuucauuucccucuuuugauacaaaauauuucuucuugaaagcauugaugauuaaacgcugagugucaaggggucccuugucacugggaagggugauucucagauagcccugucccauguuagggaggaaagaaaagauguuuuagugaggaauuuuaagggaaccccaaagccaaauuaggauggcauuacagaguggcaagaaugaaaccucagucacgucagaaauuuauuagcugcuguugcuuguugaaucaucucuagucuuuggaauaccauuuuaguuuucucagaagaaauaaaaccacaagcaauauauaguauuaauaaucugaacaguaaaagcguaaugcacacaggauuggauuauagucagaaagauaauuuauaugccagaucaaacaaaccugaauuccauuagggaacaacugaaaacaucaggcagaacauuacauccugcuucuucuuuagagacuuguagccaggagguaauucaggauucaguccaaauugugggcaaauaauaauaucacaaaaacaauagucugcuagaacugaauaacagguggguuauugaaaaauaauuuuuccaguuccuccaguuuuaccaaagauaaaucauaguagaaccaguuuauuuguaaaauuaguuuuacacuuauuauacuuggcaugauuauuugcauaagaugcagcaauaagaguggccauacugacucauuuuaguuggcuuugcuggaacuuuuugguuaaggaaucucagauuagauuuuuaaaagccucuuguggcuaggaagccaaguuaaggauuuaccaucuaacugugccgguaauaccuguaugaauucagugaauuucuuucuucucgagaucucaaaauaucuugagauuacugggccugucagaaagugacaugcuuuuacuuacugcaaggucagcaaccuuguaagggaaccaugucgacaaggaaccgggccagccauuuucuaaguccacuggcuauaaagucaacuucagcccuucaaaccagucuggucauaucugaaaaucugucauuccagucuaagccuuguaaaauaaccagugcuuucaaugugucuuguuaaaaaagaaaacagauccuuguugaacuuaugcaaguaaguauauugccauaaaaugaaaauacaaauaguuucugaauuuuggagaaaucagguagaaugaaagauaaaugucucaguuugcccaccauaguguacuuuacccaauugcuguaagcuauaaauagcucaaaaagaaaaguuuucuugaugcuagaaaacaaaacaugaaaagaaccuacuguguuucaaacaaaaagaagucacaaaaaucauuucagugcucugucacuucagugccauguacuuagcuuuuauucugcuugaaguuggguuagcgaucuuuaugaacucaucagguuugaaauuagauuacuggauuuuuucuuuuugcguuguucaacggcaugaucuccaaaauuaucagaaacuuguauucagagugcuuuuugugaucuucuucauaagguuccuugaagauacaaugcuuuggcauuuacaaagaacuuuuaggaaaagagagcaucagaauaaagcaauuuacuguuuaugucaagacacaucaaauuuuucgguaucuuuuauaauuauagaaugcauauuaauagcauauucauauaaaaauaaccugaagaaaguuaagcaccaucucuuggcugggcgcgguggcucacaccuguauucccagcacuuugggaggccgaggcagguggaucaccugaggucaggaguuugagaccagccuggccaacauggugaaaccccaucucuacugaggaguacuaaauacaaaaauacaaaauacuaaaauacaaaaauugcuugaaccugggaggcgaagguugcagcgagccaagauugugccacugcacuccagccugggugaaagagcaagacucuguccccaaaaaaaccaaccaaccaaacaaacaaaaaagaaaguuaaacacucuuauuuaacaaugcuuccaguaugauuuucacauaccaaauaugccuaauaugccgcuuuuggaguuccagggucccuguuuggauuuccaggagcccuaaucuccaaaaguuaguucaaugugagaaagacucauuagaauuugaaguuucauuuuaggaaguuugucaaaugucaaaggcuugaaacacuugauuucaaaaugagaucacaguaaaauaauauucauuuagucaaagugauuuuuuucaaagauuucaaaaagcaaaaacauuuacucuuugauuaagaggagacuuggcugggcacaguaggucaugccuguaaucccagcacuuugggaggccaaggcggguggaucgccugaggucgggaguuggagaccagccugaccagcuuggagaaaccccgucucuacuaaaaauacaaaaauuagccgggcaugguggcaggcaccuguauucccagcuacucgggaaacugaggcaggagacuagguugaacccagggggcggagguugcagugagccaagaucauauccagccugggcaacagagcgagacugucucaaaaaaaaagaagagagacucaguuuucagaccuaauaaagacacggugagugugucuuccucucucuucuuuuuuuauugcagcuuauucaaaagguaaauaaaaccuuuuauuauuuuuuaucaauacuauaugaaaacccuguucaaaagagaaaaacaaguuuugccuuuguauuaauguauuauuaccaauaaaccuaauuuuaauaaaaccuuauaaacaaauccauccaaccucauucagcuuugaccacacagauaaguuuucuauaaaucuuuuauaaccuuuugcaauauuuuucauuuuuuucuaacuuccuauacccauuuaguuuuaucuaucauuuuuguauuucauuaauuuaaaacagcuuuuaaauaaccuuuaagccaugcaaaauuguuguuccuuuagcaaaaaccacauaaaaccacauguauauauauauauauagagagagagagggagagagagagacagagagugagagaguguguuucacucuuguugcccagccuggaaugcaauggcaugaucuuggcucacugcaaccuccauaucccagauucaagugauucuccugcuccagccuccgcaguagcugagaugacaggcacgaaccaccaugcccagcuaauuuuuguauuuuuaguagagaccggguuucaccauauuggccaggcucgucucaaacuccugacucucaugugauccacccaccucaaccucucaaagugcugggauuacaggcaugagccaccgugcccggccaacaaaaacuauauuuuuaugucuuuuuuauaaccuuuuaaauuuuuauuuauuuauuuauuuauuuauuuauuuauuuauuuauuuuuuugagacagaguccucucugucgcccagacuggagugcaguggcaugaucucagcucacugcaaccucugccuccuggguucaagugauucuccugccucagccucucaaguagcugggaucacaggcgccugcuaccauggcuggcuaauuuuuguauuuuuaguagaggugggguuucacaugucagccaggcuggucucgaacuccugaccucaggugaucugcccgccucagccccccagagugcugggauuacaggcgugagccacugcaccuggcuauaaucuucuuuaaaaccaaaaaugcauuuuacuuuucuugugcucuuuggauacaaauuguuucucuuuuaucuaguagauuuaauuacauauauuaauuucaauguuaacucuuaguaucccaaauauuugugaaaagucuuaagaaguaagcaauuuuaauuauguaucuugauacagagcccagaaaaaaggacagaguuaugaaagcaaugccuggagaaccaaccccucccagcauuuucaggaggcacaagugagccagggaagacauguagcguagcucugccccacagcucuuggccuaggugcugcagacauccacguguccccaggccuucccguggccacuugucuauaccccagaaucaaacagguaucaacaauaucacagaagcaacaguuuuaugaccuuaaacaccuaccagaaauaggcuaaaccuauuugacuaguagacccaggcaaaaaucucuaaauuaaauucugaaaauauuucuauuuuauuuuaccaacaauuuuaaaacuagccucauuuaccaaagauuacugaagucacaugaacuugaaaagcauuugggcuuauuuacuaaauuuaugagaacugauuuacuuauaagucaguuugguaccauguagacaauauacaaacacagacguguacacauguauacauacaaacauagacaaaaauaaagauuucauagcuuugauuuuaagauuuuagccacgagucaggugaaauucacuaguucaaaaggacauuuggauucaaacugugccuuuguaaauggaacaaguuaaaguuuaucugucucauaugccuaaagcccucacaaaauuuaacaagguagcaaauuuacauuucaaagcagagagagaauuuaagcuuuuguaaauaccaaugaauuuuacauuaucuuuggcaaaaaucauguccucaaaagggaagcagaccaagggaguauauuugguuagcagggguuuaagaagaaagagauucaaucaacugagaaacuuuuauagagagaacagaggacucaaaaaauaugggugcauauaugugugugugugugugugugucuguguguguauacauauauaucccaaauaucaguuauucauuaaguuaccuuuugacuagagagcuccugaaucuuuucagucucuuaucagauuuuagccaggacaaaucagccaauauccuugcuuuuguauuuuuuaauuuuuuccucuuuuaaaccaaagguaccuuuccaagugacucaccaaaacuaacacgacuuaaccaagguuaugauuuaaccagagacuugccaaguaucuccaaagaggugcaacacaguccucacaagacccagagccaccagaaaaacuucaaaauaaggaagguuuugcuagcugcaaaugggguacaagccccaucuguccugucuagcguauucccuagggucucagcuucucagcugaccgucuguauacaagguccagacugaggauuuaaagagacagugggaaagacaggaaaacaaaagcugcccguggggguagugccaaaaggcaggaaaacgugggaagguaaauuuaugggaugaauaaagacugcaccuagauucccuggcacugcugucucugagcccauaagcaagucuuauaauggagccuaucuuuaggugagaauggcaggcaggaaaaccuuugucuuucuaaauugccucucugccaucaggcaagccagaggaaggggcagugucucccuggauguuaaccuucuucagcuaccaaucaccaguacuuaggagaggaauauuuugguuuccuucaguagauaggauuauaaaugaguauccgagacaaauaauucaaauuaauuucuuauaaauguuucuuuccugagcaagagauacccacugaggaaauaaauguugugguaugucccaagaacauuaacgauguaucaaaccuguucucagcuggaaugcugcuuagcuaauacaaugcauguuaacauuuccaagacaugguaagauuuacaucuccaagggacugagaaaggucugcaggcaguuuaggcauuuaaagaguuuuucuggggguuuaaggagcggucucuaaaaaaauucucaaaucucuuaauaugggggugagagaacucacguucaugcaccuuuugguauaaaacuaauaggaauuggucacaaauuuuuuaaaguccaaauuauaaacaguagaaagcagcugcaguuuuaaaagcgugcuauguaaagugauaucagcagugcaaaacugccaauaccuugaccuaccugcuccaagguggaaaagguaguuuuccucuuuaaucacugaugccugaaucacuugccugcaaggcaaagauagaaccuccauuccagaaagggagcaguggaaagggcagcccaggugaaaaucauagggugguccggauucaggaggucucacccuuugcaccccgggauccucuggagcuggggacccaauauguugcugguaccaagagcugggucugagagaaaacgcugggugcuguugugaggagcacucugaaugcugccgacuuagaccagauaugucggccuaaaaaaagaaacugaggcaagauuaauguagagaguuuguugggcaaaaggugagccucacugccuaggacacacuuucagguugccuuggagagauucagccaugguuauaagaagguuuuuaaaggcaaagggggacaaggagugggcugauacaaaguuguuccacaggaauugucacugguuuacagagaugacauugguuagugauuggcuaucccuuguugggcuauaggguaggaguuaugguguccaguguguggcauuuuauggcuccuuggcaucaguuagacuggagcccacauagcagauggccucaagaagucaccauuugguucaaggguagagugagacaugacugaugugcauuucacugccucuuauuuuucauuucucuauaccuuaucuuucauuuaucacuuuccuucucauuuauuuuacuauauuuuucucuagacaucccuucuucagucuuaucuuuauuggauaauuuguuauuguuuuguguuaaauuuuagcuucuuguuucucuugauuuuuaugguuugagguaccgugcuaaaugcagccucauuuaguuuaucuagaaaccuggugagagaggcauuaucagcuccauuuugcagggaagaaacuuaggcugagcagcuccaagccgagcauagugcggguaaaugccggaauucauaaacaccagaauucaaacccaagccugucuuuccaaaguccuugccauuaaucacugguuuacauuguauggugugguaucaauuucuuuaucaagaaaaaggauuggaaacaaauaauuuuuuaaaauaauuuguaaaauccugugaugucagucugcagaggucucagugaacagaugcuaagaauggagaauuauugaggcauuuaaaacuuaaggugacucuuuacuacaucaccuuaaaggaaaaaaaauuauagguauguguguauauguguaugugucauaugugugugaauguguguauaaaauauuaauaggaaauauacuuaaaggaauaugauacuggcuaaaauaaaggauagcaaauaucuuuuuuguuuuaaagcuuuuguguuuuaaaguuuuaaaagcauuauaguuuuauaucaucuugacauuauuuauucuccuaacacagcaguucucaaaaguaccuaagaaucaccuugagaccuaguuuaaacauuggauuguugggucauguacccaaauauucucauuugagaggccagguuggggucuagaaauugaauuuuccaauugcaccagaugauuuugguacaauagaaagaaauauuaccauuuuucuuuucuggaucauauggagugagauauuuggugaaauuuuucuguguacacccaaugaauuagcugggcagugauuaaaacugaaguccuugggccaggagcgguggccaacaccuguaauccuagcacuuuuggaggcugaggugggcagauugccugagcucagggguuugagaacagccugggcaacaaggugaaacccugccucuacuaaaauacaaaaaaauuuauccuggugugguggcaugugccuguagucccagcuacucgggaggcugaggcaggagaaugcuugaaccugggagguagagguugcagugagccaagauagcaccacugcacuccaaccugggcaacagagugagacucugcucaaaacaaaaaacaaaaaacaaaaaacuuugaaguccucaaaaccuaauuaauuugcuugcugaccuaacuccaucacuucaggcccacuacuguuuuaaaauugcauauuuuugcugggugagguggcucacaccuguaauccuagcauuuugggaggccaaggugggcagaucacccaaggucaggaguucgagaacagccuggccaacauggugaaacccugucucuacuaaaaauacaaaaauuagcuggguguggugauacacacuuguaaucccagcuacuugggaggcugaggcaggagaaucacucaaacccaggagguggagauugcagugaacugagaucaugccacuacacuccagcccgggcgacacagcaagacacugucaaaaaaaaaggaaagagagaaagaaaagaaagaaaaaaagaaagaaagaaaacucauuccuaugaguguggauuucaaaauugugauuuccgaaucagggagcacuuugguucaggucuguucauaaacuggcagaagugguaaagauuacaccuauuaagugaaggguuugcugccuuguggccacacuggcauuuuugccuuaaugaucgcuaaggacuauguuuucugucugaacuuucaccuggagaugauguggccuggugcuuguguuccaggcugagcagcucgugcugucgggugcagacagcgaugaggacaccuccagggcugccccaggaagggguuugaacgugaguacuaaugccccagcaggugcuuccgcuaauugcuuggaacuucuugcuuugcgcgaccuuccagauagugaaaucacagacugguuuaguuuggugauuuguuuuuuguagucuagauagagucgaaagccgccuauugauucuuuuuuaguugcccaugcuacuuuuggaauacguggaauauuuuaguuucuacuuuucuauuugccagucagugugaucaggagaagccuucauuaggguaauugaauucaugcuucccgaaacuaccaucauaaggaguagccuggugguuuuggagcuacucaguccuguuuuccaacccuauagcucucagcugcuaaacucugagccuacgcucuguucacggagccuuugaaaggauuucugaaaacuaccugugcccucacauugcacaguuggcaucuauaaaguuucuucauaguuucaaauacucaagagaauguaauucaugacaucuuauaaauauugacauuuuaaauguaucuaauaaaaguuggaucuuuacuaucaccuauuaaaaauuacauggaaagacucuucuguaucaguaagaaaguuuauauuuucuugauuucacauuuccaggucaguccccauguaaaauuuuauucuauucaauucauauuuuaugcuugaaagucuuuaauacggacuuuaaguaaaauauguuauaaaauuaaaauaucuaaguuauauuuuuuauuugaugugauuauaaaacuguaaguagaagaauauuuuucugggaugaguucucauaaaaauuacaaaauaaaucaaaacaguauaaauauauuacaacuauugacauaauuguuaaacauggaaaguaaauuuuucuugaaaagacauuaauaagaugaaagacaauuaaaaaauuucauguauccauuguguuugaacgugauuuacugauaagaaaagguucaacauuaauuaugugacucuucauuuuuauugaaguaagcccccaggaaacacuuuacauagauaguauauaaggauaaaaguucucuuauagcagugcuuuuuaauuccucaaguucucaggaucuaacaugccaaaaaucacauagagaccuguccucaaaaauuaucuugaaugauccuuugaugauccuugaaugauaccugauuagauuaucuuucaaauuugucaauagcuaaaauuugggagccauccgacuugcaaagugauuuguuacucauucacacuggauauuaacuucuggcagguauaagaaaaaaaugccuuauuaagacuuauaaaaugacaauuauacuuaaggcucuuuugcucauaggcacucuuuuggagaaaagaggguguggcaauggcucuuuaaaauuuucuuaaauuugauuuuauuuuuaauugauucauaaucauuguacauauuuaugggguaaaguaugaugguuuugauacauguucacauuguguagucaucaucaggauaaguagcaaauccauuaccucaaacauuaauuauuuccuugugguaagaacauucagaacccuuucuucuagcuguuuugaaauguguaauacauuauuauuaacuguagucacacaacuguaugauagaauaccagagaguauuccucuugucuaacuguaacauuguaccuguugaccaaucucuccccauccuucuacuccgcucuccagcuucucucuacuucugugagaucaacuuuuuagauuccacauaugggagcauggaauauuuuucuuucuaugucuggauaauuucacuuaacauaauguccuccaguuucauccacgcugacacaaaugacaggauuguuuucuuuuuuaaggcuaaauuauauuucauuauauauauaugugauacauaugugacauauauauauguaugugauauauauuuauauauauauauauauauauauaucacagugucagguuuuguuucagagcuaaguuaauuauaaaguuuucuuggaaaaauaagcaagaauaaggaaaaccccgaaaagcaugaggaauggguaagccuuaccaguuuuaaaaauagguuuuagcaccuuuauaauuacaguaauuauaauuacaauuauacuagcucaaugaagcagaauagaacauguagagcuaauuguauaucgaagcaugguauacaacagggucaacacaucaaauuuguggggggaaauaaacugauaaguagaguugugaucaucgaauagccauaaggaaaaaagaaaaguguagauguuuucauuguauacaguaggaaaaaaaaucgaaugaaucagaaaucuaagugugcaaauggaaaccauauaaauacuagcagaagauauaagugaauucaucuauauaaugagaguggguaaugcuuuuccaauuaugacuaaaaauccaaaugugauaauggaaaacauugauaaauuuguuuuuuuaauccauuuuuaauuguggguauagacuagguauauauauuuaugggguacaggagauacuuugaugccuccaugccaugugaaauaauaacaucauguagaauggaguauccauccccucaagcauuuauauuuuguguuacaaacaauucaguuacacucuuaguuauuuaaaaauguacaaguaaguaauuauugacuauagacacccugucgugcuauuaaauaguaggccuuauucauucuuuauauacuuuuuuguacccauuaaccauccccaccuccccagugaguuccccacuaccugugccauccuucuacucucugucaaugaguucagucacuuugacuuucagaucucacaaauaagugagaacaugugguauuugucuuucugugucugccuuauuucacuuaacaagaugaucucuaguuccacuccuguuguugcaaaugacaagaucucauucuuuuucauaguugacuagcacuccauuguguauauuggaaaccaaaaaguaacugaaauaagucucaaucaauuuagaaaguuuauuuugcuaagguuaaggaugcacucaugacacagccucaggagguccugacgacaugugccugaggggguugggguacagcuugcuuuuauacauuuuggggggacauaauacaucaaucaguacacguaagauucacauugguucaaucuggaagggcagaacaacucaaaccaggguguugggggacuuccagcucauagguagauuuaaacauauucugauuggcagucuguugaaagcauuauuaucaguagaaaggaaugucuggauuaaaauaagggguuguggauaccaagguuuuaugcagaugaagccuccggguagcaggcuucagagagaauauauuguaaauguuuccuagcagacuuaaggucugaguugauguuaaugcuggaggguguaaugaggcauguccaacccccucuucugucauggccugaacuagauuuuuaaguuaacucuggaauccccuuggcugagaagagggguccauucagaugguuagggagccuuagaauuucauuuuugguuuacaauauguaccacauuuucuuuauccauucaucugcugauggacacuuaggucuuagcuauugugaacagugcugcaacaaacaugggagaaugcagauaucucuucaauauacuaauuuccuuucuuuuggguauguacccaguagugggauugcuggaucauaugcuagcuuuauuuuagguuuuugaggaaccaccaaacaguucuccauaauaguuaugccaauuuacauucucaccaacaguguaugaggguucccuuuucuccacaucuucaccagcauuuguuuuugccugucuuuuggauauaagccauuuuaacugaggugaaaggauaucucauuguaauuuugauuugcauuucucugaugaucauugauguugaccaucuuuucauaugccuguuugccauuuguaugucuucuuuugagaaaugucuauuuaaaucuuuugcccauuuuuuuuuuuugaaacggagucucgcucugucacuggugcuggagugcaguggugcgaucucggcucacugcagccuccaccuucuggauucaagugauucuccugccucagccucucaaguagcugggacuacaggcauguaccagcaugcccaaagugcugggaguacaggcguaagcuacagcgcccggccuuuugcccauuuuuugauaggauuauuagacuuuuuccuguggaguuguuugagcuccuuauauauucugguuauuaaucccuugucagaugaguaguuugcaaguguuuucuccuauuaucuggguugucucuucauuuuguggguuguuuccuuugccguguagaagcuuuuaaacuugaugugaucccacuuguucauauuugcuuugguugccuauacuugugggguacugcucaagaaauuuuugcccagaccaauauccuggagauuuuccccaauuuuuuuuguaguaguuucauagcuucaggucuuagauuuaagucuuaaaucaauuuugauuugauuuuuguauauggcaagagguaggagucuaguuuuauucuucugcauaugaauauccagaccauuuauuaaagagacgcuguuauccccaguguauguucuuggcaccuuuguugaaaaugacuucgcuguaaguauguggauuuguuucugaguucucucuucuguuggugugugugucuguuuuuaugccaguaccaugcuguuuugguuauaauaauucuguaguauaauuugaagucagguaaugugauuccuucaguuuuguuauuuuugcuuaggauagcuuugacuauucucgcucuuuuauaguuccauauaaauuuuaggauuuuuuuuucuauuucugugaagaaugucauugguauuuugauagacauugcauugaauuuguagaaugcuuacgguaguauggaaauuuuagcaauacauaagcauggaauauuuuucaauuuuuugguauccucuuuaauuucuuucaucaguauuuuauaguuuaaauuauagagaucuuucacuucuuuaguuaauuccuaaguauuuaauauuauuuuugacuacuguaaaugggauuacuuuuuaauuucuuuuucaaauuguucacuguuggcauauagaaaugcuacugauuuuuguagguugauuuuguauccugcaacauuacugaauuuauuaguucuaauagguuuuuugugaaacuuuagguuuuuccaaauguaagauccuaucaucugcaaacaaggauaauuugacuucuuccuuuccaauuugaaugcccuuuauaucuuucucuugucugguugccuagccaggacuuccaguauuauguugaauuacaguggugaaagugggcauccuugucauguuccagaucuuaggggaaaggcuuucaguuuuucuccauucaguaagauacuagcugugggucuauuguauauggcuuuuauuauguuaagauauguuacuucuauccccaguuuuuugagaauuuuuaucaugaagggauguugaauguuaucaaaugcuuuucaauaucgauugaaaugaucauaugguuuuuauccuucauucuguugauguaauguaucacacugauugauuugcauauguugaacuauccuugcauccccagggauaaaugucucuugaccacaaugaaugaucuuucuaauguauuguugaauucaguuugcuaguauuuuguugaggauuuuugcauuuauauucaucagagauauuggccuguaguuuucuuuuguugaugugucauugucugguuuugguaucaggguaauacuggccucauagaaugaguuuggaaguauucauccuccccuguuuuuuggaauaguuugaauaggauugguauuaguucuuguuuaaauguuugggagaauuuagcagugaagacaccaggccucaggcuuuucuuuacugggagacuuuuuauuauggcuucaauauuguuacuuguuauuaauuuguuuuaguuuuaaauuucucccugauucaaucuugguacacuguaugugucuaggaauuucuccuuuucuucuagauuuuucaauuuauuggcauauuguugcucauaguagccaccaaugauccuuugaauuucugcgguguuaguuguaaugucucccuuuucauuucugauuuuauuuguaucuucucucuuuuuuucuucaucuggcugaagguuugucaauuuuguuuaacuuuuaaaaaaucaacguuuuguuucauugaucuuuuguauuauugucuucauuuuaauuucauuuauuucugcucugauuauuauuucuuuuuccuacuaauuuuggguuugauuugcucuugcuuuucuaauucuuuaagaugcauaguuagauuguuuguuugagguuuuucuucuuuuuugacauaggcauauaugacuauaaacuucccucuuaguacuccuuuugcuguaucccauagguuuugguauguuguguuuucauuauuauuuguuccaagaagguuuuuaauuuccuucuuaauugcuuccuugacccagugguaauucaggagcauguuguuuaauucccauuauuuguauaguuuccaaaauuccucuuauuacugauauguaguuuuauuccauuguggucagagaagaugcuugauauuauuucaguuuuuaaaaauguuuuaagacuuguuuugugacuuaacauauggucuguccuugagaaugauccauguacugaggaaaauaauguguauucugcagccauuagaugaaauauucuguacauaucuauuagauccauucgaucuacacuguagauuaagucugauguuucuuuguugcuuuuuguuuggaagaucuguccagugcugaaauugggguguugaaaucuccagauauuauuuuauuggguccuaucucucucuuuagcucuaauaauauuugcuuuauauaucuggaugcuucaguguuuggugccuguauauuuaaaauuguuauaugcucuugcugaauuaaccccuuuaucauuacauaaugacuuucuuaaucucuucuuacaguuuuggucuugaaaucuauuuugucuaaguauagcuacuccugcucuuuuuuugguuuccauuggcauggaauaucuuuuuccaucccuuuauuuucaguugagguguauuuuuauaggugaaguguguuucuuguaggcaacagaucagugggucuuguuuuuucauucauacagccagucuguuuuuugagaguuuaguauauuuacauucaauguuauugauaaguaaggacucaauccuguuauuuuguuaucuguuuucugguccucucucccucccucccuuccugucuuccuuuagugaagguguuuuucucuggugguaugauucaauuucuuccuuuuuauuuuuguguaaccauuguauguuauuucguuggaaguuaccaugaggcuugcaaauacuauuuuagaacauaacgcugcauaaacaaauaagcaaaaagaaaaugaauaaaaauuaugcuuuaacuucaucuccccacuuuuuuacuuuucguuguuucuauuuauaucuuauuguacugucuaugucuuuaaaaguugcuguaguuaucauuuuugauugauucauuguuuagucuuucuacuuaggauaagaguaguuuauacaccauaguuacaguguuaucauauucuguguuuuucuguguucuuacuauuacccgugaguuuuguaccuucaaguaauuacuuauugcucauuaaugucuguuuuuuucugauuaaaguauucccuuuagcauuucuuguaggucagauuugagaaauuccccagcuuuuguuugagggaagucuuuauuucuccuuuauguccgaaggauauuuucgccgaauauacuauucuaggguaaaaguauuuuuucauucagaacuuuaaauauguuaugucacucucuccuggccuguaagguuuucccuugaaaagucugcugccagacauauuguagcuucauuguauauuauuccuuuucucuuccugcuuuuaggauccuuucuuuauccuugacuuuugggaguuucauuaguaacugccuugcaguaguauuuggguuaaaucuacuugguauucuauuaccuucuuuggauaucgguaacuuucucuagguuuaagauguucucugauauuauccuuuucaauacauugauaaauuugaccucagagaaaauauuaauaaauuugauuuuagggaaaacaaacaaaaaacccucuugaaugacaaaaaagagaaaaugaaaauaaauaaaggaaagagauaaaacucuuacucauaaugagaaauguaaaugaacuacagugaacacuguucaucaccuaugggauuggcaaaagcccaaaaguuuguuacuacaccuuuuucauuaaacuguggggcccuuaaaugcauugcugagcaaaaugcaaagugcuagcuuuaugguggugaauuuggcaguaucuagccaaauuacacauacauuuaguuuuugacacagaaauccuaguuuuagaaaucuacccugaagacucacuggcaaaaaucuaaaaugauucauguguaaggcuguuuauuguggcauuauuuguaacaacaggagaugaaagcaauguucaugcccaucaggaggggauugguagaugaagcuaugguacaugaagaugugguauagcuacaugauugaauacuaugaaucugugaaagaaggaagaaguuuguuauauuauugauaugagguguuuucugggauauauuuuuuccacuuuuaaaaaucaagggugacuuuuccuaugaaucaaaguaauaaggcuucaaugugauagauuaauauuaacucauaaauaagaauauacuggguuucaagcccuagggcaguacagcacuuaaaauaauaauggcucccagugaugaccaugccugcugcuucaguccugucuguucuaggcacugugcuuaguugugugggcuuauuugaucuuccuuauauagacacagaaaauauccaaaugccagaggugaauugguugaucagauuuauugauaucuacuuauguuggcuaugaugcucucuucaauuaaggauguuagugacguaauauuucugaagagcacucugccguuguuuuuacauauuuuuuccacgccauugauccuagucugcacauuuugaugccagugcuugcuuaaucuuaccagaagaggggaucaaacggaggcaugagucacaucauccuuuugcugcuuugaauguccucuauuuuaagggauuuugcagcucuuccuucccuuaguucacugucugggcugugagaggcacuccuuuuguguauauccggugauaaaauguaacacugauccaucuccuugugaauuccuuccuuccuuagcuuagcgcuuagcuuagcacuucuugcuuuacaggaaacauugcagugaguauuggcuuuauuggugcucccccugcuggcuguuucuaugucuuugugcaaacaggguaacagcuucagcuucaagucauagugaaucucugaugagcacagaggcuuagccuggcggaggccgagggcaagccuacaucauugggguguuaaagccgagcuuucaauucuggcccagcaugcagaaccuaucuucacuuuccucaucugcuaaacugcccacuuuguagguucauuguagcgauuagaaauuauauagcucaucugacacucauaggaaauguucugaaauggugaguaaaccugaccggagcccuccagaaaguuugcagauacuauuauguauuauuuuuucuugagaaaauguaagugguuuauuaugucuguaacuugaagacucuaugagaauagauuugcauuaaaaaaauccuaauguagauggucaaagaaauuugaucuucucuggaaaaguuagugaauuucuuagaaacugaaguuuacucuguuccaagauauaucuucacugucuuaaucaaagggcgcuugaaucauagcaaauauucucaucuuucaacuaacuuuaaguaguuuuccuggaauuuuacauuuuccagaaaacacuccuuucuguaucugugaaagaaagugugccucaggcuguaaacugggcugcacuggacaccugcgggggacucuggcuuaguggggacauggucaguauugauuuuccucaaacucagccuguguagcugugaaagcauggaacagauuacacugcaguuaacgucaucccacacaucuggacuccaagacacggggaggucacauagucaguuguggaugccgguuaaugauaaggugugaguuagcucucgggucucuguuuccuaagucacacaaacagcagugauaaacugugcuaacggaugagacaagguaccugaguuaauuugcaauucagcacacaaaaauggaaaagaaauuauuauaucagucugauaaagugcaaauguucugauguaggaguaaagugacguggguucuaauccugguucuguuauucaccaggacaacagaccagucauuagcaggccuuucucugaagaaugaacuuuugaaaguaacuggccuuuuaugggcccugcuucuugguuucuugguuuuuuaaaaaauccaaauucuauaaauuugaccaaucuaaagguauuacuacaugcuucaucagauaucucugcauuucuugauaccauaaaguuaaaguucuucugguaaaagaguuaaaaaucacugccuuauaaaacaagcaaacaacaaaauaaaccugucuggagacauuuuguccauuugcccuguucaggcagugacagaaauagugucauuauaguguuucacagauggacggagcuuacauuugaagugauuuccauagcaaaagcccuaaaaaaguuuccagaauucguguugaguggcguuguuucugauggaagccucugcaguauuggaggcaggcauuuacagggaagcccaccaguaaaauaaaauuuucagaaaaaguuauuaaaagcuacauuuuaaaggaaacuccauaauuucagcugcccugaguccuaugcuuacagagagccugcauuuccacccagcugauccgggucuccagggggauuacagagaacuugcaaaugcggcccaaagcauguguggagcugugcugccacaggguggcaguguugucacacacacagcaaauccccucgcgagcuuuucugggccuggaaaagcucaaaucuguucuguuuuuggaguguucaucaguugagaacaggaaaauguguuccgagggcugagccacguguuuaugagguagaacuaauuuuuguuauacaucaguuguguagagauauuuuuaaaauuuagcuuguaccuuuagaaaaugcuuuauaaggcagagguugcagugagccucgauugcgccacugcacuccagccugggcgacagagugagacuccaucucaaaaaaaaaaaagcuuuauauucaaaacaaaauaaauugcauauggcagguuuuaagaguagaguaggagaaucauguccagugccuacaagucuaacagaguuucuuguuccuuguucuccugagccuuucucaguaucugcauaguucuuuuaaagguuguaugaucuucuguguaaagggaaaagcguggcuuuuguuuuuguuugcuugaauuuggauucugaauuauucacauacaguuugugaccucuuagagccuugucuucccguguguaccgugagcucauaaucaccagcacccagcauucuuaugaggauuaaaugagugccaagcacaggaaggagcucacagcuagcacucgaugaagguuggcucggcccuguugcucauugcuucuuuuauucugguauaaguaaugugaaagucacuuuaucccaaaagccuuuuuucauuugggagguuuucuuuaugaaagacaccugcaaauguauucgugaaucaaaggauaugacaacuuuauggcauuacugcauuguuucccuugaugacugugucaucaacaacaaauaacaauauguuauuauggccacucaacucuccauuucugauucagagccuuguguauauaaaacuccuaucaacuauuggaaaguaaauagaccuuaauguguaaucuagaaaaaucauucuaagguucuuuccauaccuauuugaccauuaaaaauaggccagacaugguggcucaugccuguaaucccagcacuuugggaggccgagguggguggaucaccugaggucaggaguuugagaccagccugaccaauauggcaaaaccccaucuguacuaaaaauacaaaauuagcuggacgugguggcaggugucuguagucccagcuacucaggaggcugaggcaggagaaucacuugaacucgggaggcggagguuguagugagcugagaucgugccauugcacuccagccugggcaacaauagugaaacugucucaaaacaacaacaaaaaaauaguuuuaaaaauauucuuaucauaugaucucuaaugcaaaccuggaacccaucagaggaggguuuugguuuuaaagcuuugaugaauuuuuuucccagaguguucgauucuuacaaugggaguaguauacacauagauccugaagaguugauaaacagggccuaaugccaguaccaguucucggagggaaaaaaauaaauguagauuuuucaccacuuggcugaaaaugugauguuuguaaggauacugagguagaaaacgucccuuucaaauacugguuuuccguauguuccccuaaaacaugacuauuauuuccacugucuauguuuccuuucuggccuuccccugcucuuugucagacaaguauaaaacaagaaucucacuugccugcacauggauuuaaguugcuucagagaccagagaaggugagaagcagagcucucugucccucgguauccuuuccugucuaggagaugacaucuccgccaucacagugccucgggccagaacccugggguccucuuugcccccuuugcucucccacuccaccugcaacccucauagcgucugucgccuucaagauacaucuaggaucucaccacuucacacagccuggccuugucaccuggcccaggccuccuggcggcuccacuucccagcaccuguggucuccaaagccuccuccccaccucccugcuuugcgcccugcgguuucacgcggcauccagagcgcagcgcgcgcggccgccaggugcgcgcggccgggggcugcagagagccugcaacgccgcccccgcugcccuccuccaagcuccuggccagcucuucgugugucuugauccagguucuuaaaaaaaggaaguggacuauagacagggugucccacacacuggcagucccagggucggcccuuggggcugcuguuucucagcucgccucccugcccacacagccccugcacccccgcgcugugccuucccuguccccggcgcugugccuucccugucccccacgccuucccugucucccaccccgugccucgcuuucccugucccccgcccuauggacaccccuggcucaggccagugugcuugucccagcaucgcgcucaucuccuguuuuuauuugauguuacagauuucauuucauuaggaaugaguguuuccuccccgacuuuugccugcauucuuuuccagcuccucccuggaaaagggcaggggcggacacuuucccagccucccaccgugcucuguuccuaguggcaccugccccagggucugggccccuagggaugcguccucuacccuggagacugggaucuucuuaaauccccacugcucccuuguugucuccucagcuagcaccaccuuugcuuccucuuccaggguugucacauuuucuugauuucugcaucuuaaauaugucccaggcggaccuauaguccuucccuuuucuuccuguugagcgaugguuacaggcuguggacgcgugugagugaggaggcuccuccccgacccugcccuuccgccauccgguagguuuggguccauucuucuccauucuuucaacauaaacugcaccuugagggucucuucuccuuuuugaaauuuugcaugguaccaauucauaguagauuacagaguaaaauaaauaaaauaaacaaauagaaaauacauagaaauaguaaaauaaaaagaauaauaaauaaacagucccauaucaaucauccaccauuaacaaauguuaauguguguuuagcuacauuugcugcauugucuuuuuguuaacgacuaagaaacacagcagacacagaugacacugccucucuaacacaacaacuggcucucuucuuccuuccccaggggcagcaacccuuuuaaaaguuuuauauuuuaagaaguauagugaaaggcugucuguccauuaacaacacagagcauauuuuguauguuuuaacaaugugugugaugauugucuguauuuuguuuauuucaauugacaaauaaaaauuauauaucagugcauugugcaacagcuaaaucaagcuaauuaccauauccaugaccucacauacuuauauuuuugugguaacauuuaaagucuaccguuuuaguaauuuucaaguauauaauacauucuuaguaguuauagucaccauauaguacaauaaauagacuuccugaagugauuauuuauuuuccaaagucugaauuuugacuuagagaauaagaacaaugaauauugagggggaaaaaauaaggaaagaaagaaggagaaaagaaaagggagaagagagcagagugccuccacuaaaaucccuccccacauagacacucgccucuccaaccacuugcccugggcacacuuugagucugucccaucagcagaccagggggcacuggagacacacagaggagccaggccaacccccugcccucagaagacaccaaggaaccccuugccggugcuacugaaacuccaaauucucuggcauugccaggggccuuguuuauuuuuuuugaggcggagucuugcuguguugcccaggcuggagugcaguggcaugaucuugacucacugcaaccucugccuccuggguuuaagcaguucuccugccucagccucccagguagcugggauuacaggcccacaccaccacgccuggcuaauuuuuuuguauuuuuaguagagaugggguuucaccauguuggccaggcugguuuugaacuccugaccuuaagugauccgccugccucggccuuucaaagcgcuaggauuacaggcgugagccaccgugucuggcuagcccuggccuuguuaaaacucugauuugagguauuggggcagaugaggcaauaggagaaucaagccugaggcccuggcgaggagguagagucagagggcucgguucuccuugugagaagggcgaaggaaggucuguacagagaaggcaaagccucagcuaagcugcggaugcagcuguguggcucccucucugagaggggaauccagcuuaggggcaccuguguuucuauuuuaaguacagaacaguuuaagggggagaggaaggagaaggguuaagaaaugaaaguucccauucuucagcaguuccauuuagugauuugaaagugcaccuuaacuacaguucauugugugugugugugugugugugugugugugugugugugugugugaagggugguuuuuuauugacuguacauuggaaauguguguuuaaaaauagccugaacaaaugacuagcuauuucucaauauuugacccuccauguggggugagaaggaucagagaauucuuuuauuugcuuggcuaagaauguuugccauccgagaugauauauucuggaucuguaauuauauggugagcguaacuccuuugaaugacagccuccaauaaaacugaauaauucugggugaugcuuccugcugggugauuccuggggaaccugaugucuccuucagaagagacacuucggugagcuuucagaaagggacauuucggaaguauuggcucugagcuucaaacugagauaauuugauaaacuuggacaagaauaacuacugucuggacaucauggggagauaaaaaagaggaaaagaaccacaacaagaaaaauaaaaggguaagaaaggaauuaauuugccuucuuggcuuguaaauuuugugugugugugugugugugcagaguauuuugguugaacuacaaaaaucaacauuuagugauauauccuaaguggacugucuuugauauuuguuuucuuuuagcacaaugaauuucuguucuaugucgucuggaugauuuucuagcuuuauagcaaaaacuauaagcaaauuauaaauacagguguuuaugaagcuuauuucuuugaaaauacagugguuuauggagaaacuaugauucccaguugcauuugaauuuccuugaucucucuguguuuugcuugguugcauggagauuggcagaagucaauguugauauuuucauuacugaugaugcaggcucccuuccguaagaaccaucacaaugggaccuagaguagaugcuucaggucaguucuaagcaauucacacaggagggcuuaaauaguccugagcagauaacguuuuucuguuuagguuuacugacuuggauaccacucuguuuaacacacacuaccccauagguguagagcuucugaguguuccuucauuuaugguuaggggaguugaaaucuguagaaaugaaaccagggcuauauaggaacugugcagucuucuuuuuuuuuuuuuuuuuuuuuuuuuuuuugagauggagucuugcucugucaccuaggcuggagugcaguggcaugaucucagcucacugcaaccuccgccucccagguucaaaugauucuccugccucagccuccugaguagcugggauuacaggugugugccaccaugcccagcuaauuuuuuuguauuuuuaguagagaugggguuucaccauguuggccaggcuggucugaaaucccugaccucgugauucacccaucucagccucccaaagugcugggauuacaggugugagccacugcucccggcuggaacuguacagucuuucuauuaccaaguaaaacucuuuauuguccuaaauauugcauauuuuaugucccaggcagaguggcuucugauccugucuuugcagccauauauugguaauugguuuggcuguguccaaaaccauuucugccccuucuuccagagguuaucuucugaccucaacaaccauuuauagcugaauuuuguuaaaacauuggaguuaauuggaagcaaacaggugaagugaauuuaagcucuaugaggacagagucauuuauuauuaauauuauugcuauuauuucugauuguucaacuaaugcagugccuggaaacaagaguaggaacuuagauguguucauugaacgcaugccugcuuuggucagaaguauagccaaugagaauugaucucuggcgcaguuuguuaauacuuuauaucccaugucagagacagucuccaguaguguaagcaaaaguuacacacggaaaaaggaaaauggugaaugcugaagcagauggccugguugcccagaacucucaauuuugaugcagagauuuugaaugauauuuucuugaguguuuugugaaaauugcccaugcccauuccucuccucuuaccugcuggcuccacaccuuuagguugggauugggaugugugccagugacgcagacccuaaugauacccauggcccagccacggauucucagagaggaggggaggugcccacaucccaccgggaguuauucguacagaggcugaugaaagagaagccucauuuuaaugcuuuugcugggauauaaugacaucuauuguuuuauugaaguacagucaugccccagaucaggauuugcugccuccauuagaauccuauuugcucccauggaacugugagugaugucagcucuguggcacccuugcucuaagccucucaaagccccuuugugccuuggcccuccgugcccugaccauguucucugcuucaguuugcgcucauagcacauuggucugugccuguucuuaugagguccagcagccagccuuagggcuguagcuuaaaaccacccucaugguuuuuccucuggcuuccuucuauguguggagaauaugcauggaacucugacucccuugacuguggccaacauguuaguaagccugggcuaagcugcucucauaaaggaaauccccagaauucagaagcuuggauucagaggcuguuggugacucucaggguacuuggaagguugcaucugccaagguuggaggcacucaucuuucagcgacacgggccuccacgaugaacacggccaucugcuucuccaucaguuggaggggacgccauggaaggacacaucugugaggucucuacaggccagucuggaaguuacauguaccucccauccagucucauuuuauuggcgagaacuuaaggacauggcucuauauugcugcaaaggagucugggaaauaaaaacguuagcuggccgcugcgugacagcacugauauuggaaucacugaaagggagaauagaggugcuacucagcuggcuguccugacguuacccaccaagcagggccagagacccugcggccuccuuaccacagcagcuuccauggucuuguccccauuuccuugaugacaaggaagggaaggauguaaagaagucgugugaguucacuggcuaucagcagucauauugcccaucuacuguguaaaagaagagaagagaagccuaucuaugagauuguaggucacggagcaugcuguucacagcaaauagcagucacaaugaaaucuucagcaauguuauuuaaauaacacauaccugcaggcagcuucucaguaaugaaacauuaauauacaaaugcauuaggaaugauuacauuuaugguugcuuuuuagcauagaauagggaugacuucuuguuuuuacuuuauucuaguuauuuuaaaauuauuugcuaaccaucuuaauuauuagcuagauaucuuuaauuaucaguaauaauuaauugguaacaauaaagcaaaauuaacaguacuauauuauugagaaacaagagucauagcauuuuaaagccuaagaccaacuuuuguaugaugccagugaugugcuaauaaaaaaguaucuuuuuuuuaugcuaugagcuucucaccggagugugcacacauuugauaagaucuuuacaaucccccauggcagcugggacccacagaagaggacaaaauuagaauccagaguaaauucuaacuauguaugaauuuaaccuuacgauauacaauaguaggcuagugauaaguagcucuuagccauauguaaaaaugaaaaucuucauaacaaaggauugugguuugguucaguucauugcuugcucuuucagaggauucuugaucugggggccauggauggcagaucuaaguuagagaaugccugggcugaaccguuggagcauucccauucaggcaugagaaacagaaaugucccuaagaccaucgccagccucugccccaacagggcccugaauccaccagacaaaucauacaacaaggaugagaaaagaugcugcuuucaagccuguuuauauugucaauuaacuuguauaugaaaccacuuuuaguuuuggaauuauuuucugccuuugccaacucuuagcaacagaaaacauagguaggguuguaggaagcaacagagaaagcucacagcaguggauuuaacugaaggagaagaauaccugggaaaccuugaaaauguuaauagcuuauugccauuuuuuucucuugcuuuaggucugacaaaugugccaacagaaggggcuggacagagaugguuucuauaaaaaugcaaucagcccuguaaauguaaaugugggagucggcagcuuggggguuucaugaggcuuaggaggaugggacaaaagugaaccaugguaccaacuaaauuugacuggagugggauucaggguagcuaagaaacaagcuacagaugugagaacuuuccuaguauugcaaaauaauugauuuuuauuugacuuaugguuaaaugguccccucuuccuaaauuuugucuuaccuuaaaucagaauugaacagcugucucuggagcgcuggucaucucugcucauuugucuugggccugucccuugugcguagccagaguguuccuuuucuggucuuggaguauuagucuaucuuggcacuuuccuguaaugccauaguccuuaaaccuuuaaggcaucguuauggaaugugugcaucacaaagugugacuuuuugaauaagagcagaguuuguccugagaucauaugauuugugagcaggaaauggcuauuaagccaaaaucagaucauuaaagagauguuuugcuaauacacugaguuaaggaauggccacaggcggcugagggugcuggccauuggugaacagcuggugggcgacccuggcuuguccguggggucucccaggaggacgcugugugucuagccugagccaggcacacagagcccuuucugcucuugaagaaaugauucaaagcucuguccuaaccaaggaagcugggaaauauuccuuuuaguauuugcugguaugauuguuuuucaguuuguccuaaagccugagcuuccucuugaccaggaaauuacagggcuuacuggacuuugaugcaggccagcuguaauuacccuaaauguuuauuccgccucucuuuguaugcuuuugugaagcuaccaggucaugaaggauauacucugaaugguuaacaaggcucaaaucucuuuuuuaaaaaaucagaacguuaguuuuucaccuucuucuacauucuuagccacaccagucacuuguuaauaucuuauggggagacucuggaagggcaggugcgacgccagagugggggcagauuucuuccagugggcauuuuuuccugaucugugaaagccuagaggagagauguccacuugcaucccagggcacgggaacucaacauacuuccaggccgcagguuguagauaaagcagaacugggugggauagcugcugagcugacauacagcguuuauacagaucuuaguugccugugaugcaaggccagaggacuugaacauaaaucagugcaucaaggcugaaaauguuucgccuauguacagcagcugaacugagauaggauuugacaauaguaugggaaagagccgaggauuuucaguggcagaaagauccacaucugaaagagcuguguuuuugucugcuucaugcaagcacagggugcuuacugacucauuuucuugcccugaccauggucagaggucagaacaauauugggaggaguugucagugcugauuuggggcggggaggggggcaggugacucuugcuccugaagaaggggcucucugcgacuagaaagaaccaacugagcaucugaaaagaguuuaagcgugggcccauaucuggguaagaacaugacaucccagcuauaauuuugugcuaagaaaaauagagcacucuccccaagaucuaguaccucuuggccagaagcagacacuucccuuugaguugugcagccuguggucucugcccaaucuugagcagccauagguggucuucaucuggacaaugaacucaacuagaaucaucuacugaaaguggcgaaguaguugugucaaccuggucucauugcuguaggcugaaagaaggucaguuauaguuucuguuuucuccuggaggauuggagaauugccugacucccauaguuucuccaggaaaccaagagaaauguugccauuuauguugaggacaaucaaaaugugagaagaggaguauagccauguaauaauaaugaugaugauucacggcagcucuguguauugggggagcuuccugaaacacugaauggagaagguugcugggguugacuagugaugucucucuuggugugggaugaguaugagaggcaugccgagugacuucucuuccuuuccuaacaccuacguucaaucaugagcacuaucagaaauguaggaagcugucuaggcugcaggccuucugaguaagagcaguagacacuggacuaucagagacuguaguggaccagaagguugggcuacucugcuaaggcacuucugggauacacaagucacuuagcugaugagugagcccaagguguacccaucguucuguagcucagaggggcucggcuccucucccuuccccuugcaguguuuuuuguguguguguuuucuguggaagggagacuuaccuuguuuucuguaugagaacuugugcaugcaugccuggaaguaucucccuggaaaaugccagcugccaggguuuaauggaaguaaagaaaacaugagaaguuccaaaggaagugaucauuuuuguauucuuauuuuagacauucugggcugguugcaguggcucaugccuguaaucccagcacuuucggaggcugaggugggcggaucaccugaggucaggaguucaagaccagccuggccaacaaaggugcuauuuacaaagaugcugaaaccgcagcucuacgaagaauacaauaauuagccaggcgugguggugggcacauguaaucccagcuacucagaggcugaggcaggagaaucucucgaacuugggaggaggagguagcagugagcugagguugcgccacugcacuccagccugggcgacacagugagacucugucucaaaaacaaaauacaaaacaaaaagacauucugagacaaauagugaaauaauaaauuuggaacuggguuaaauccauguaagaguaaguucaccaaacacucuaaaagcaaugagaaaaucaguuuauuugcuuauuuuugcaaguguaccagccaguuuaaaaguugcucagaaagugggagauaaaauuguagacaaaguagggaugggguuuugcuuguagugugaagauagguucaggaacacauggcccuugaagaaagugugacuggggaggaagccuggagccuggacagaccugucuuugaccacagguggggaaagcaccacagacgccaguuccuguccuuucaggagaagugaugugccccugugguauucagaaaaugggugucugcagcccuccggcaagcaucaggagaugacucuguucaugagaagugacagacacuugcacuucacauugccucacagaaauggaaacaaaaucaagccaagcagcagagcaguguagcuguggggccauauggggaagauaaaugccccuucgggcuugggguuuauagcaaaccuugacauagaggaugucucaggaacuuggaaaaccacaccacccagaaauagggagguguggucccuguauuaaaauuggaauugugggcucgaguguuuacaaagauaagagauuuuuuugugguggggugaaguuauauauguguauacauguuuacacacacacagaguaaaugauaaggggguuggggaugccuggagcagugguccuccggggggugucugaauggccagcccuggcuugccucugcuacagcccccgcugccagcaccccaccucccuucccacaccuuggccuggcucugaagggguauucaggggaguggaucucagacaggugaggucagaaugccaagagccauggucauggagggauaugcauuuccaguugguaggauucccaggaaagggagcuaaggaaauucaggaaugagccacggaaagucaagaaaauuugggaguaagucaagggcauuuauggcagcuaggcaggagaggggccaggacaagaccuuagcgacauggacagcauccaugggccaaggccuuggaagccgcugugucagagagaagauggagggcaacaggacccagugggccgcugagggguaccugcaacuuggggagagggagacauugaauagcaccuauaguuuugcuuaaaagccaguagaguuguaccuuagaaaccaaccaaaagagaaucuaacaggagcugagguggagcgugagcugugagagaaagacaaagcgagggaagaugaggggaaauggguccccuucccuuuguagcccaccccccagucacucuggcugccucccaccugcccugugcacaaacguguaaauaguaaaauagagguuccucuucaaagagacucuccucuccgucuaauuaggaauaaauaguaacuucucuuagaagcaauauuuauucaaagaccugugcuaacauucuuaaauaucugcuagccguaauaaaucaauguggcugggugugguggcucacaccuguaaucccagcacuuucggaggccaaggugggcggaucacgagauccggagaucgugaccauccuggcuaacacgguaaaaccccgucuauacuaaaaauaaaauaaaaaugcaaaaaacuuagcugggugugguggcgggugccuguauucccagcuacuugggaggcugaggcaggagacuagugugaaccugggaggcggagcuugcagugagccgagaucgcgccacugcacuccagccuggaugacagagugagacucuguaucaaaaaaaaaaaaaaagaaaagaaaaaucaacguacuuuauguucuuaggucccgcaauuucgccuaaauauuugcccuggcaugcuuauacuaguccaagcgggcguuaggucauagccuauuccucuuccuuauuuggagguguuuucaccuuucucagcauuccacaaguuacuuccuccucccuuuguucuccucuaccuuugcucuuuuaaaaaguucuaaguugcuagccaaucaggacaaauacagaaagcgagguccuguucuggccaguggaaaccagauacagcaguaaggugaacgcgucagguuauaaaugacccugucuccuuuguucgguguacucuccuggcaaaacugcuggugaguguacccuuucugcagaaaguaaaaaugaccuugcugagaaaauuaaauuuauguucaagugcuauuucuuuacagcaccaaguaacaagcauuucuaacaaaugugacccauacaaggcugagggaccuuuuugugagcuaggacaaggaagggcuuaguggauggccaugggcagguucucagugcgcuggcucccagcuguucucuagagagggaaggccacacccagccacaugcaaguccagggcugacacagcuuggaggucacagcugccccagggcugcggaguccugacuggauucugagaggaaagccauuccccuccccucugcagugccuucugcugucccuaugcagggacccuggccugcagaacacuuccugcagguuaaugagcaacccccugcuggcuccccaucaccaugcccaagguggggagcugagaaugucacaccccuccuggggcugccaggggaucagcagccguaucugcucuccaacuucccaauggaucacagcccuccuauuaaguaacuuuuguaggucuuggguuuuccuccugacugcucugaccugcucaucuugaguuggaaagaagugagggaauaucccguauuccuugcgacucccccucugcaccaccugccuuuauaugagaaaaugcacagcucuucaucaggccuuauuucuaacucucccagcuuccuagaaaucugggcuauugccccccuccccccgcccccacauuccugcacuagcagcuccacagcggucaccuuccucugucuccucuuuuuauuuccaacaagagauaauaucuuaaugggagaacggaguggggcauggcagaagcgcuacagaaucugagucccacaggucaugcuagaaaauaggaaaggacugagguuaaaugacaagauugccaagagaaccucaaggaaacugccgaucgcuuugaaggugaacuucaugggugaccuugagaugaguaugccuggcagccccucccugcagucauggggaugugcacuugaccagccguuaugcuuugcagcaauucuaaaaggagguggcaagggagccccaaggaggggcugauuaauuauuuguuaauuaauaauagaguacccaaauuugugagugauuuacuuaaacagacaaaagccauucaguuucaccuggaaaacaugauuauucccucucugauacacuuuuugaagaagacagaaggauggaguugcagcucuugcacagaugcugcucagaggcuggcaccuugcaugugaaacccaugcauaugaaaucauggggcuuggggccaguaaaaauauugauggcugaugcucuaaggcacuguuccuuaagagagaauaaaaaugagccaccuccagccugggcagugugcugugauggucaggagcaaaggugagagcgguggggcccacucuugauucccaaacacagaugccuagugggaguaaacaaacggaaagaugccuccaccucauuaguagugggggaagugcaguucaaaaccauagugagacaccgcuucacacacacgaaagacggcuguucaaacaaaaggaaaacaaauguuggccaggacguggauaaacuggaacccuuguucauugcuggugagaauguaaaaugguacagccacuguggaaagcacuuuggcuguuccucaguaaguuaaacagaggaauaacaggccagguguggcggcucacuccuguuaucccagcacuuugggaggccgaggugggcagaucaccugaggucaggaguuugacaccagccuagccaacauggcgaaaccccaucucuacuaaaagcacaaaaauuagcugggcaugguggcggguaccuguaaucccagcuacucaggaagcggaggcaggagaagcuugaacccgggagguagagguugcagugaacugaguucgugccacugcacuccagccugggcgacaggagugacacuccaucucggaaaaaaaagaaaaaaaaaagaaaaggaauaacauaugagccacaauucuccuaggaauauacccaaaagaauuaaaaacaggccgggcaugguggcucacaccuaugaucccagcacuuugggaggcugaggcgggcugaucacuugaggucaagaguucaagaccagccuggccaacauggugaaacccugucucuacugaaaauacaaaaaauuaguugggcgugauggugggcaccuauaaucccagcuacucaggaggcugaggcaggagaaucgcuugaaccugggaggcagagguuucaguaagcugagaucgcaccacugcacuccagccugggcgacaagagcaagacucugucuagaaaaaaagaauuaaaaacaagugaauaguacacaaaugcuuguagcagcucuguucacaguagccaaaaaguagaaacaauucuaaugcccaugaacagaugaguggauaagaaugugguauauacaucaaacauucggccuuaacaaggaaugaaauacugaugcaugcugcaaugugagcaaaccuucaaaacauuaugcuaagugaaagccaaacacaaagaucauauauuguuugauuucauuuauaugaaacauauggaacagguaaauccauagagucuaaaagcaaacugggguuuguccaggacugggguggggaaaggggauuggggagugucugcuuaauggguacaaggucuccuuuugggaugaugaaaacauucugaaacuagauaguggugaugucuggaugauagugucaauguacuuaacaccacggauuguaugcuuuaaaauggcuaacacgguuaauuuuauguuauuacacacauuuuguuaucauaauuuaaaaaaggaaaacagccaaugcuugaucuggcuccgggguuucggauaugcuuggauuggugugcagccugggugugugcaucauuaaagcuccagggaguuccgugcagcugaguuuucgaaccucugccccagagccagccugucuggcuccaccacuuccuagugugugaccuugggcaaccaguaacucgcuguaccugaguuuccuuagcugugaaaugaggaccauguaauuaccuuccuauagagcugguaugagggucaaguggguucauauauguaaaauacaugucugcacacgaaucuaucaccauuuucugagccuggaguuuagauuuccucccuaaccggcuuaguuguucucuuugcaccuggcaggugucagcucacaugccgcccagguggagagaccacacuucugcuagccugggacagucccagcaaugcugaugucacugcauucuuucccauuaggcuuacuuuagaucacuugaaaaauaguucuauuuuggauaauaaauuauguggccacccucuuaacccucuucuauagcaugcuacauauagguagugaugaaugguaagucccuuagaagauuagagagggcaacauuauaaacagugcaucagagaauuagucugcucccccagaagagaggcucuugaaccacacagcuacuuuuccugcuucuuaaaaaauaaauccuacuuuucuugaaaagaaguuuugccaaggaagaaaucugaucagcuuuuuuccuccacucaugacucaguuaccuggaguuacagggaagccuuccugauuugguacacguuuuagaaacaaucauauuuauugcacaggaauuguucccuuuuuuguuuuguuucuguguccuguaguggugcccuuucagucggcacccagaccugccccaugcacaucuacagccgaguuucucauuccuuuccugaucuaguccaugguauuauuaaaaugcucauuaacagaaugcccacuuaacacgaaauacuugguuucguuuggagaaauccauuuaucuggaggagggcuacacauaaaguaucacucuugaugaaguauagaaaacugaacuuauaagucaguuauucaaaaugugucaccacauaaauuauggcaaauuuuacaugugcauuugagagggaaaaaccuucccuuuuucauuaggauuguauuauuuuuauaaguuggaaccucauuuuucccugaaacuguaucuaauugaguuugccucagcugaaaucucgcaucugaccgcaagcagucacacagacacacacacacgcaugcagauugaggcaugcccugugaacauccuuucccugaugcucuucucugcugcugccaagcccccacuccuugcuuuuuaauucuggucagucacuaugcugcacauuaugacuuaacuuuucauaacauucucuugccuuauccuuccccuuugaugcccuuccucuuacuuuuccuccuccaccugcccugaugaaguuugcaccaugcacugcaucucucccucccccuggcuuggcuggaaaugagcuucugcggucugcuguggccacugucacaggauccugccugccugaggacacacaucgcaugucauccaucuuugaagcaccccggggcucauuuccuuuuaauuuacaagcuuuucagaaacuucugccuuucugaaauugucauuguuaagcauucuaaacauucaaaugccuggcagaugguccugcuucauaagacugaaauacugucugauagcucaccuucaaucaugucuuccaguuauguuaagggaaaauaaaauaccagcucgggcgcuguagcucaugccugcaaucccagcacuuugggaggccaaggcggguggaucacuugaguucagcaguucgagaccagccuuuccaagauggcaaaacccugucucuaguaaaaauacaaaaauuagccgggcgugguggcacgcuccuguaaucccaguuacucaggaggcugaggcaggagaaucccuugaaccagggaggcagagguugcagugagcccagaccacaccauugcacuccggccugggugacagauucugucucaaaaaaaaaaaaaaaaaaaaaaaaucaaauaccaguuggauacucuuuguuugcucauuuuaagaaaaugucuugccaggcgagaaaccaucagagagcuugugugacacgguauuuuguuggcugaaguaugcauccagaccaaauagcuucugccacuuuucuucuucuaaauacuuaaaaugccaucccccaggcauuccaugggguacuuggccaaaaaagagcgaucauuuccuacucgccucacccucuagaaaugagauuccuaaguuccauuguccugcccauucauggugaucaguucacaugaagcuggcaugcuucaugguucuuucuuugccgcuuccucggaaucagugcaggauuuccaggaugccagaagacagcucaggauuuggcucagggauucagcuuaaggagugucugucaggaaggcugugcccugaggauaaggaaaugcaaagacaaagacagagaacacccucuugggaaggaaaguuggccuugcccuuacccaagacugugccagccaccacagaugagaagcagcauucuccccauucucaccucaccaggagcuuugacagaccugagcugcucugcccaacagaccccagggagugcccguucgccucaucugguuuaugucacauuguucugccuugaguccugucaacaccuguaucugaagaaaagccaguguggauaacagguucuggaaucuucccucccacucgauucuuuaacaaagccuuaaaaaaaaaaaaaaaaguuguaaagccuuucaaaagggggcagcaucgucuaaggagaggaggcugcaggcagcaacaggaacauauuucuaguuucaucuuucuaguuuauucuaucacuagggagcugagccauccugaguagcucugucugggccucaguuuuucuaauuuauuauaucacuagggcacagagccaucuugaguagcucugucugggccucaguuuuucucaccaucaaaacagcaaacaucauguccuucuaagaggaucugaucccauuuagaagagccucugcugagaggauuguugauugccagcucagaguauacuuauuguaaccaaaacauaucccuuaaccuugaaacagaaaucaacaucugaauuccucaauagccaugucaaaagaucuacucaggcuuuuaguagacuugauuaaaugagucaagguauaauuguauuuguaggauggacaccuuugagaaauggaaacaaaaugaccauuucucuuuuuuuuuuuuuaaaucgauuuaaacagaaagauuucagguacagcaucuccuguuugucccuggaaguguauugugcaguacaguaagggguugaaguacaccaagccccuuuuuguuguaugaacagauugauccaucuuaggcugugugaugggugugcucgugaggcagcucugugaggauaucuucaagaauuuuggcaaagggaaauggaccauggcagucugugcugacucgaaauagggauguuuacguugaacaugcucagcuucuugucugguacugaucucugaucaauuauaagucaaugagcgagggagacaacguguucucugcgguaccugugagcccugaaaguauuccaggaacacccugcacucucagugcccuaucagguucuauggggcacuugugcugucagggccgugccccugcugccuggugcuagaucugcauagcuccuugucccugucaguggaguaguguuuugucgucacaaugaaagucaaauaaaaggaaaauaagcuuugcugagaugaguacauuuuaaacagaagcaaucaaauauguacauauauauauacgcacacacacacccaugcauacauaaauguuuguguguguguaaauuuaaaauuaggacccaugucaaaagcacuuguggcagaugauacugguuuuauuuugagcuggcacucagaucuggaaacgguuagcuuccucuucuuccugucuucucuccccagaugcgcguaugagagucaaaucacugauguuuuacacugaauguaaggaguuaauuggcuaucagugguguggugacauggacacagagaguuuugcauugucuuuggugggcgccauugaauucgacuauccauugaaugacagcagcuggccuggaggaaguuuaaaucccaccaaccuaagucccaugaagccugagauagaagguucuguuugcuuaguuuucuuuucuguuauucauugcuuuuucuuaaugauuuaucugguugcacuugcaacuccugagaaaauuugauaagaucaugacugccaacaucuguggauuuuggugccaaccuuuggugagagcuaugacucacuucccuacaaaaaaagaacuugauauuaaaaacauguauauauugacaagcuuggacaggaaaucaaaccucucuugcaggcaagcaguggccugucccucaugaacuuugccacuuuguagcaggagacaaccaaggaaacugggauaauagggggggccaagcuguuuugacuccagacugcaugcauuaagcucuugguuuucccuuugacuucguauugauaugagucaggacuuuaaaggacucaauacuucacaauguuuuccucccacauuauucuguggauugcuuucuaaauucugcgcacaaauuccaaaaguagggaaagaagauagaaaugaagcacaaguauucgcuggacaacauaaaguuuuuggcuucccauggguugaagguugagaaacacuguugaguagcagaacugagaagagggucugguggcucaggaccacuggacccugcaaucgaccuccuugggagcauugugggaggugggaagagauauuuguuaauuguguagagcaaauuaggggagaaaaaucaucuguucuauugaaauucaguuaaguuccagagucacagaugaaggccucaugaggagcccauugucugaagauaaucaauaucagaacuucuaggaggacugggauggggugcacuuccgccuucugacuuucugccauucaaggucaucucaguguggcccucaugaggucauggccacccaaaauagguaucagagaagaaggaaaccacauauauuagacacuucuaaugugcuuuaucuaaauuacuucauuuaaugcuuguaacaacuuugaaggaaauggauuuuuccccauuuuaaagauggggauguaccuacuuuauggggucuauucccauuccuuaccuuaaaaaauagauaaugcaaaauguccaggaugcuuaugacagcaaaaaaaauuaugaauuaaaaccugaaaucaauaugaaauggaagggggcuguaaaguucuuuuaagggaguauucugcacagaccuuccuuaagugcucagggcacuuacaggacagagguggauucacagcaguauugauugaucagucaggcaggcauaguuguggugaggaccgaggacaagaggaacugggaguuccaugucuagacaggguggaaugaagacaagcaauuagauaugugguuguggaaugcacugccauggacaucguguuucugggacgucagauggggcaugugugcuuuagagauagcagguggcauggguacagguguguaguucuuugacuaccacagcuuuaagcauccuccaaaauguguguucacaugugugagugcacguuugugagugugugcacaugugcgugagugugugcaugugcagucacugucagcagacguuauggaugaggaaacagaacaguguggaaggucccaguguccaugcucuggccauaugcuaagugacuacugaugaggaaagaugggguuugcauucccccuggaucuggggguguuuguacaaaccagccauccagcaaaacaccuuuccagcuccagaacugugaauagcaaaaucccuucucugguuugcuuccugugcuucauuuagucuucuagauccugcaggguuaaauaaaucuugaguugcaucucccugaguccucccuguugccauggagguggauguaaggcagaguuuauuuugcauggcuuauuugcuuaguaaugacuaugauggcugcagaacucaaggacucaagggaacaauuuacauuuuucuguaggagccuaaauaggcauugacgaguguucuggguguuaguuucuuuucuguuauaucaccgucaccuguuuccuaugggaacucugcaccugauagccaaagcaucgggcaucguugauauucagugucugcagggaagcacuaauggcguaaaaagcagccuucauggagugcuuuguccuuuggcuuuaauauuuaagcacaagaaaaucugugacucaauuuuuuuucaggaaaacaaaugauaguauaacugguagagcaacagcauuugugucugagcacaaauaauacugggcuauuguuuaauaugauggauuuccuuuauaucuucauuuuaaauauggagaacuaguuguucaaaugaaaucuuacccacaagcuuauuauguaaaauaugaaagcauagugacccagagggucaucugucuauucauugucucaggaagguugacugaagggcccuccaccuaccaggaacuguuuggagcugggauuacauacaguucucaguaaaaaucagugauaauuacugucuucauugaguucacaucuuaaugggagacaaagauacaaacaagcaaguguaauaaucauaauagcuaacacauauuggguacuuacuuugugccaagaacuccuuuuuuuuuuuuuaaagaagugggaucucacucugucuuccaaugacaccagcauggcucacuacagccucaaacucaggcucaagagauccucccaccuuagcaucccaaguagcuagcacuaaaggugagcaugaccacacccagccaaugugccaagaacucuuucaagcucuuuuacauccagucacucauuugauucacaugauagcuuuguaaugcaggaacuauuauuuaccccaguuuuacaggagauaaacugggguagggagaaauuaaaaauuugcccaagguuuguaucuuacuccugacaccaaaaaauaccucgucuaaggucaaaagaaggaaucaaacccagguagugucuccaaggucugugggcuuaaccccuauacugcauuggcucucaguguugacuguguccaugguaacagguggaagaucugccagggcuaggagagaagaggcaccaggacacagcaugguaccaucuuguuuucaguuugaaguuagagugcugguucugcugguuccccgaaugcuuucugcacuagcacuuacaugauucuauuaagcagaccuuagggagaaaaaagauucaaaaaguuuguguguccuguagccugcuccgccugguguagaaauugucccuugagagcaauuaguguguuggcuuguauuucuuucagcuuauuggguaucugucacuaaguacgguacugaugguccuagacagucuucacagcauacugcuuauaccacauugucaguuuucauaacuucugaaaauuagaagaaacauaagcccccuccuggcaacaaguggaguacuucccaagaugaccaagacuguuggugucuuccucaugaagauguauuucuugaucaguuccuuccucuuuuuagugucuaagagcucauucugacaauggguuaaaguuuuaaggaggccaguucacaccugcagguuggucaagaaguuuaaaugauucuagcugcuaaguguucucuuaauggcuuaaagagucugccauggccuucaugauuaagaaagggagccucacagcaugagucuguccugcagcaucuucuccaguuuucccuggaaagcuacaggcagggcuugcucagaccauucaagcugacuguagaaacagcugccguucaagcucagguggacggauuggaacuuugucuucaugugagcauucauacggggagaagucaucucauacugauuugguuuucuguuugucucuuccccaacagggcuguuuaacgacccccaacuccccauccaugcacucacguucucuuacgcuggguccaucccucucgcugggcagcaucucagggguguccgugaagucggagaugaagaagcgccgagccccuccuccuccagguucagggccaccugugcaagacaaggcaucggaaaagguagggcagugggcuguucucacaaccaaagcaucuuuucagugacacaguugauuguuccaaagcucccugggaacacaguaauccuucauguuuguggcuguagcgacuggaguguugggggcaaguauuuaagcuuuauuuaaaaguaaaggcaagaugccaggaagggcucaugauuuuaacucugagaagcugaguuccccaaggcagucaggauacacccagcagcccaguccugcuccccacauacccuaauaugucagauccaccaugcagcuguaaagauaaggaugcagucuucuucccuggacugagauuuuucugacugacugcaucccagcuuccuguggaggcagcaugccacaaaugccaacauuuacagaaagcaaauucagaguccauucauucuguggcagaacuuuauuuccuaacucuugccgcaugugucauguggccuagcccaguugcauaguuugagagugucacgccccugcuagucuuuagguucaaagccccuuuuugcucauuugcucucaaaauacccuaaaaacuaagucugugccuccugaaugugaggcuuggucccuggaucuugauaaaaaguuauagcagcagauaccaaauggcgggguccugacaugucauguaauuuccuuaucagccugcuugucguucuguccagguauguccgucuguccaucuauuuuugcaagucgguccucuggucauccaucucuguuccuucaugguuguucuuuaucccugggucucagagaccauccugcuuccauccuuaguccuucauaucccuaaaaaucuaucugaaaagccuguaguggaacacauuuucaaagaaaauauuuuuauuuuugcaucucuuaaauauuuucuaggccgggugcaguagcucacgccuguaaucccggcgcuuugggaggccaaggcaggaggaucaccugaggucaggaguucaagaccaaccauggccaacauggugaaaucccgucucuacuaaaaauacaaaauuagccaggcaugguggugcacgccuauugucccagcuacucagaaggcugaggcaggagaauugcuugaacccaggaggcagagguugcagugagccaagaucacgccacugcacucuagccugggugacaagagagaaacucugucucaaaaauaaaaaauaaaaaaaaaaggaauguauacauauauccuaauguaacugacuuauuuugaguucuucaugauauauuagcuguguuuucauaaaaauaaauuuaggcacaaaugguaccuuuuuguuguaugcauccaugauaagaugaugcaaauggaaaacacaaagcuauuucuucugauuuucugcagugugucucauuaauuugcuuggauguagauucugaacuuuuuuauaauaugcagaccauauugauagcauuggccuuucccagcuacaugccccugggaauaucuuuuugcuuuggcuuaggauagguuucuuuaguuaguaauaaaaaguaugacuuccaggaucaauauuaugucagcuuuuuucuuuuaauaagaauuguauuuuguuaaugcgauaaaauguagauggugaacuguaccagcauuuuaaaaauuucuuccacccagaagagauguuguauuuuucugcauuuaaugugcuuacccacaguggauaaagccugcuugagugggaaaaugugcaguaaguagagaauugggaauucugaaugaaaaauaaauaguacuuuauacccuguagaaugaacagaguuuccucugaggcaguaaaagcuuuuugcugaaaucuguuuuauuuggcacagaaugcguggagaaauuggcucauggaaaccaucuuccuuuuuaagcauaugaguggcauauggauuagauuuaagcauuugcuaugaacaugcuuuuuuaaacugaaagguauuuuguuauuuacuaauuucuggaaaaggaacccaaaaauguauugucgucguuguuggggaagaacgucaauuccuucuucaugaacuuccuuccauauaaagauaagauguuuguuugggaagccuuauuuauaugcaacuguuacuaacaccaguguccugaacaaggaggaaagguucauuuucagggacaugacuaguuuguaagaaaaugagaaugccuacauuuguauauuuuaaaauauuauuuuguaucaacuaguuuaaaaaauucaauauuugcuucuucaaguccuaacggugggauaauauuagccauccuccaguucaucugaaaauuuucuaaaauuuguaaccauaguuaguauuugucaccugauuauguauucauaauuugaucauguguguuuauuauuucuaaagguauuuuuugaagagguuuucccagagguguuagagccuggaggugaccgaaugcucuucucagaucccauggcucuucccacaguacugugaaugcagcuuuuauuauguggaaacuucagaccagaaugauugauuguacacauuaaggcaccuuaugcucucaggauuucugagacuugagcgggcaucagaucacccaaagggcuuguuaaaacacauuuuccugggccccaccugagcgcugauucaguaggucuggauggggccugaacauuugcaucuuaagugcugccgcuccggugaaccccacuuugagaaccaccccuucauagcaaacuaccucccucagcugcuggcucugaauuuugacuacucaaaggcaacagaucugcuaagagauucuucaguaggaaaguuaccucaaaaugaauccaucugugcuguagaauaauaauuauaugcaguuuuccauaaaguuagcuuaggccuaaaguuauguguuaaaacacaucaguagcguccacuccuucucacugggacccagggaacccucaucugggaggacagacgaauugucuguucugcacaggauuuucuuccugcuucaucuccuggggcccacacuguccucucaccaucgugcuguguagagacggugaacucucccuuuguccuggacccuaggcagcugcuggaauucuugcucgcugcucuugcauuuggguuagagcccccuuccuauacugagugauaugguuuggauguuuguccccuccaaaucucauguugaaaugugaucccaguuggagguggggccuggugggagguguuugggucauggagauggaucccucaugaauggcuuggugccauccccauggggaugagugaguucucucucugguaguuuaccugagaucugauuguuuaaaaguguguggcagccccuccguccuugcucccucucucaccaugugacaugccuaauccgccuuugccuuucaccaugaguaaaagcuuccugaggccucaccagaaggugagcagaugcuggcaucugcuucccguacagucuauggaaccaugagccaauuaaacccuuuuucuuuguaaauuacccagucucagguguuucuuuagagcaacacagacugacuaacacaccaagucuuuaguaacccaucccgaaggagaguuuguuuuccucuuauuugcucaugguuuccucacuuguucugcucuugagccaggauuaagauugugaguaggggcugucaacacagaugccugggugggcaucccucugcuuaucuccaguccucaguuuccucuguaaaaugggaacaguaagaacagcacuagccagugauugcuguagugaucagacauagaucucauggcauuugccuggguuccgaucccagcuuggccagcaguagaaaugggagcuuggaugagaucacccuucucugugccuuguguccuuaggugugugcucugcauaaagcugggagaugagagcuggccacagugcagugggggacagaaguagccagcaugccuaaagcagggagggcugggcagagggaaugaaggguccauggccccagccgggguucuguguuaaccaaguagcagauuauauuuaaaaaucaaauuugcuguugcugcaaauaccaaauguacaauuaaaaaaucaccaaggcgcugcagcagguucauucuguuaaacaauaccagcauccucuccucuguuggugguauuuucccuucucagccacaaacuacaaacacccuacucacuauuccauaccuucugaggauucuagagaagagaguugcucaucccuuucaguccugauagcuucuguuuaagaagaaaaaucaccgggcaugguggcucaugccuguaaucccagcacuuugggaggccaaggugggcagaucacaaggucaggaguuugaguuaagcccagccaacauggugaaaccucaucccuacuaaaaauacaaaaauuagcugggcgugguggcggaugccuguaaucccagcugcuugggaggcugaggcgggagaaucacuugaaacuggaagguggggguugcagugggccgagaucgugccacugcacucuagccugggcgaaagagugaaacuccauuucagaaaaaaaaaaaaaaaagaagaagaaucaauuacugucaagacacccuuguguaggggacucaguuuaccuauuaaagauugacacaauacucuauauuauucuugcuggcaucuuucuuuguauaauaccuggcauguuacagagcagguuuuuaaaacuuuuuugguauuucauuuaagugauuaaaaauaaguaacuuguggaaguuuacuaaucuguguuaucuaauuuuaguuuucauuauccacaaauauauaauacauaguuauucauuuauucagucaauauacaguuauaugcuuacuuuugugcagauacaacuauaaauccauuuuuauuguaauugacaaguaauucaaaaauauuuuaaaguuauuccagcuuucuuuuuucacuauuauuugaauuauugcuuuuauuauguucaacacuauaaaauuccaacuugagaagucuguuucucugugaucucaagauuauugcauugggacugaaauugcuagugaugguuggccauuaaaauaagugaugauggaggcuguguuaugaucaguuauuaguauaacccaaaauagacuuuucuaugaaaaauuugcuuguguauucaaugaauauugaauaacugcuaugcacaaggccuugcacuugaaagcaugaauugguauuuauuacucuaauaucucagcacaguguauacauaaaaagauaguauuucacacugugugaagacugaggacgaucuguguauguuagacauuuaauggaaagcauuauuacuugaaguuccauuuccuggaucugguaacuagaauaauacaggaagugauaaaacuaugcugaccagacucccaaagacacguuucaucaagaacugaaguguccauuugaucaucaucagucacucugguguguucuugauccuguuccgcagagaggacacccagggggaggcagguccuggcagccccuguacugggaaggcccugagagcugggcugcagaccacuuggccaauggaugccagacucaaguguccucucugcauuuaggccugauauuuuuugcuuauuaaaaugagcauucuuauuucccaucucugugagcugugguguugaggucauugcaauacucaucuuugcagacuucuuccugcuguccuucuccuggagugaagucugccuucuguuucuuaucacauggcuuguggugguggugaauugguuacugauaaaguggaugaugcuuggagacauugaaaaauuacuuuucacacuaauuagagggcucugaucuuugccgggugugucucauggccacuccucagccaguuggccuccuggagugcuuuguucggaaggaaggacucaggucggcugaggcucagcaaaguagagagaguccuucaguuuaccaugcgcucaggaggggaggaucaucugggcucacccagaguaugagaugaugaggacagacucuuuagacccaccuugauggugucucuucuuguacacaucaaccacaucaaccugucagggaauccugccuguuuuccuuugaaguguauccagaauccagccauuucccuuugcucccaccugcacucccgggcucaagcacucccaugccccucugagauguuuccuggugcacuggcuuccuaacuagacccugcuucugcucaugcuccucuacccuggagaaucuucuuuacaccuucgcuagagcaacagguaucuaaacagagacagggucaugucaugcuuuaaagccucugcuggccucacgucacaguugacugugccagcugcaucucuccugcuucuccccacacccagcagagccuuucaccugccucucccuagcauccuguucaccuccucacugcaccagacccugcuuggcagucacugcauccaugaagucucgcuggccaccuccacccucugguaacugcccccuucccugguuucagguuucuuucagacccugccagacuaagcucaggaagccaggaauucuguguucccugacacaccuacagugucuaacacugugcucauuaaaccaguaaauauuuauaugaacuuacuuuacguguacaugauuuauuuaccaaacaugugugggucaucucugcugugcucuaaauguuggcguccuccaaaacucagaugucagaauccuaacuccaaacaugauaauguuuggggagugaugaggucaugaggguugaaccucaugaugggauuaguguccuuauaaaagagagcccagagagcucccccgccccuuccaccaugugagcgcaaagcaagaaggcgcccucugaagcaggaagccggcccuccagacacaagucuguccacaccaugaucuuggacuucagccuccagaacugugagaaaucagcgucuguuguuuauaagccucccaaucuaugguauuuuguuauggcagccugaagggacuaacacaguuucucagugaaaaaagcaugauuucaaaaugugcgcaaauagcgaaagaauugcuuuccucaaggaugugacagaauuuaaggaauaagucauggcaacuuugaugaggacuuggaauauuuacuccucacuaagaaaaagaguuguaaaugggccaugaaaagugcgagugccagagcuagagaacgaucuuauuucccucagugcgaggucgggcagggacagucugucugggcacagguaggaguaagggcacaagcaggcccauuugcaguuugcaugccaccucucagaccagagcugcugcugcugcugcuggaauggccagggaggcaccugcccacccgcccuuaggagggccagagcacaugggggugcauggcacagcacugucuuauggagccuccuugaggggcuugaggggcacaggacccuggcagcagaggggaggccgcaggagcagccgugugggcuggaggcugacauugccacuuaucacacagugagcggccgagcuucugcuuucuguaaaugggugcaauggccacacaaaauaugaagauaaggugggaggauucuucagcaccugcuccccgccccucccucucauuucucuccccuccccgcucuguguuuggugcuuuucugcaucugagauuuuuuuucucuuagcuaucuggcugucuuuuuaaauucccuucacucaguuuggucuuccaaugucucuuaaccaugucucuuuaaaauacacacacacacauacacgcacacauaucccacuuacuuugcugugcauaaaaugucuccccaugacuuguuagaucuaacccucacagccauccuggcauccuugcuaauuaugaugucuguuguuaucugaguuguggaaacugagucucagaccaggcugagcugcaugucagagaugccugcaaaagaagagcaaagaaguaaaucuggguuuagagcagggacacuuucccucuacaacuuuguaugggaugaauaaaaaccuuagggaggaagaaggugucgccaucaaggugggguuucuauguauccagggacccaucuuagaguuuaacauacuucagaucauauacacaaacuagcugccaagacuuucuuucagauguggcagaaguuuucccacuuccuccacugugaacugaauaacccagcuucauauucuggaauaccgugggagcacucuguuuccuuuuaauguuauaguguccauccuccagugaaggucaagaacaaugagugguauuaccauuuuguguuuugccagcgguugguaacucaauggcacauuguucugucccccaaaagagcugagggaguccggaucaccccuuugcucucugggacugcucuuaaguaaaacacccccagccuucacacacccagccuucaggccagagggagguuuccuuuauagccacgccccccagacuuuucagcuucuuuuguguguuuguuccuaugucuuuuggggccuauugugaaugcuuuagucuuucagaaagucaaaagucugccuugaacacaaggccaccguacacucuguucccacaacaacauccuuuccccgaccucauacauuuuuguccaaagcaaaaugcagccagugacuucuguacaggaaccugcacccuccccaguugcgucugucccuguagcagagggaaaaauacucuugguuuguucccuguucuucuggguuccagaauucuuuccaaagucauaagucaugcuccgcuguuuaguugugggcagcagccuaacaagcuggggacuugggugucugucacaucaguggccccguccccccugcuggcaugaugagcucuuucaagaaaccggacucuggguguagcucacguuugugacuuuccaguucugugucuuuguagcagccacccauguugucacucaucucguaguacuccuuggagaagguagugauagacggauaugaggugggaccacaagcgacgagguugagacagauccagggcccuccacgucccacggccuugagcacacagcuuguauuugccauccacuuggcugacuccccagcuugggaccgugacuuguuccccgugguguccccagucauaagcauaugccuggugugugguggacccucaguagacauuuaugagcgggugaacauggccucaaugucagacagcuaaggaggcucaugcgagacgaaugggccauugucuuucuggagggaggucucuggugacacugaagagggggagcaccuugaauuaaccagcgacuuggaugauguucugcuacagcugcaggguuuggugaauggagagcaaauagggcagcauuaggguccagagugguucccuaagccaggcagauccucugggagaugacauuugggaggggugagugacucagacucucagggucucugacgacguccagaucagucacuuccuugcuacacaugccauggacugugaaugagaggagucccacguccagguccaacccaggcuccuccauguaccucaguccaaggcugaccccagaagcccuucaauuucaagucuaagaaugagggugcccugauaaauggcacacccaagaagggcacucaggcaguuugguggggcuaggagccagugaaggcugugaaagggguacaguggcccagccuguccuaacagaagcaugaagaucaggaugagggugggguggugccgcucuauucggugcuggccacaucuguuccuucagugaguaggucucugaacacuuuuuuuuuugagacggagucucgcucuguugcccaggcuggagugcaguggcacuauccuggcucacugcaagcuccaccucccagguucaagcgauucuccugccucagccucccauacugcugggauugcaggcgcaugcuaccacggcuggcuaauuuuuauauuucuaguugagaugggguuucgccauguuggcaaagcuggucuugaacuccugaccucaaguaaucuguucaccucggccucccagagugcugggauuacagugugagccaccacacucagccugaacaccauauuuuaagagaaaaaaacuaaaaggcauucagaggagaacauucuuggaaucgaagcgucuagaaguuaccaucccuuacuuaaacgauauagaaauuacaaaauuuuagcugaaaaauggaaagauucacugggaaacaaucgcuacauccagauguuuaauuucugucccaagacaguggggugacgucucagugccccagaagacaggacuugaaugaguacgcggauguucugaaaacauuuguuuuaguugacuauagaaaaaaaauuucucucaggccauauuggggcaagagagcuaugaauauguggggaaagugccacguggcaguuauauuuaguguuuuccuauaguaucuuauuuaauccuucccaaauccccacaagauagggacugucaucucuguuuuauaggugauagggcacagagaggcugagugauugcccggcuccaugacaguuuguaaaacagaagaccaagucuaaaacauagucuggaggaguagaucauaguuugaauuuuuacaagcauaauuacugccuuaacauuuaagugaaaggguguguaaguuuucuagggcugccaaaaccuaaauaccgccgacugggugguuucaacagaaauuuauuucucacaguccuggaggcuggaaguucaagaccaaggugucagcaagguugguuccuccugaggcuccuccuuggcuugcagacagcugucuugcugccguggccuugcagggccuuugugguaccugugcaucccaggugucccuuccucuucuuauaaguacagucauauuggauuagagccuaccuuaaugaccucauuuuaauuuaguuacuucuuuagaggccccaucuccaaauauagucacacacuggggauuagggcuucaacacacaaauuuuggugggagaggccaggcaccguggcucacgccuguaaucccagcacuuugggagccugaggcugauagaucacuuaaggucaggaguucaagaccagccuggccaaaugggaaaaccuugucucuacuaaaaauacgaagaaauuagcuggaugugguggcauaugccuguaaucccagcuacucaggaagcugagacacgagaaucaccugaacagagguugcaaugagcugaggucacgccgcugcacucuagccuaggcaauagagugagacucugucaaagaaaaaacaaaaauaaagaaagaaagaaagaaaaaaaauuggaaacaaauucagaucauaacaaaggaaaaugggguuccugucuacaggcagaauaguuuccaugaggaacugaaggguguguaagacucagcccuuugaaggcacucagcacugaauuggagcacuuuauguccccaaaauacagagaacgcuugucuuuuggguagauuacgacauagguguccaggacaguggcagcagccgucgccaugggaaguucccacuagcaacauuaguuuguaugguuccagucuaauucccaucccagagaagccaucaguguuggaaaggccaucucauuccaguugggagccagagauacacugggugagggugucacuuccaaauucuuucuugguaaguggcaugcaacucauggaagaaguccaagcagacagaaguuauucaucucugcuggucauauuuuaauugcuaaaucaauuggagauugcuaaucuccaauugcuaaugaauuagauugcuaaugaaaggccauugugccagacaaauugcauguggaaguacacuggccagcaggaagacagcaaaggcaccgucauccagucgucggccaacuggucccaugaugcaggucccaaguuaagcacaauagcaauuagagagacccagcaacaguucaguucuucuugcaucccaggcacucugcuaggacuuuuaugcacaucaucucauauaacuucaucuuuacaauauccuuauaaggcagguucuguuaucuucauuuuaccaaugaggacacugagguuuacaaagggaaagugaggucccagggcugcuacuacugccaguaagcaacagaauaugggccugucugaugucuuuucugcauggagccaucaugcauugaugcugauucaauccaagagaguuguguaacacuuggcagaggggggugcagggugacuguggcucugcagccucugccuggggugaugugggugaggagguggcauggugcugucacauggcguagcacugcaaugagucacuucaacaugaucuuguuagacauagagauucugaaaugaagaaaauguuugacucauuuacucgucauugacagggaagucaugcauuugcugguugagaaucaaaacucaaagauuuaaaaacaauuguaugcaucuucuugaaggaaaaauguaccccugcuccaucauucacagccuccuugaauuuuucacuggaguguuuucuuagcacugucuguucauggugcucuuucucagcagccuguucugcuugugcagaaaguccuacugcaguugaaacauccuggcagaaaaugaaagaauugguucaccuccacacauggccucuugucaaaaaaauuaagcaaaacuggcaaguuagcgacaagggauacaaggcucuuguucuguagaacucuguucccuugauggaacuacuuaguaaaugggguuaacuucaucaggcuagccagcuccaaauauacauaaacucaagaagucuggaacccaugucaaauucauguuaaaaggcaugaacugccaagccauuacuguaggcauagccaaauacauuguaaauauaucugucaguuuugcucagauacggauaucugccuguuuuuugagaugcuuccuuuuguuuuggcuuuacccaacuuccaaaaaucugucugucugcucauacaguauguuaugagacuuuaaaagucuugauagggacaacaaauaaaacaaguaggauucuuucaggccuaacuaaacugucuuugagucuacauuuuacaaaaauaauuaugucauucaauuuuuuuuuuuuuuuugagauggagucucgcucugucgcccaggcuggagugcagucaguggugcgaucucagccuacugcagccuccuccuccuggguucaagcgauucuccugcaucagccuccugagucgcugggauuauagccaugcgccaccaugcccugcuaauuuuuguguuuguaguagagacaggguuuugccauguugcacaggcuggucucgaacuccugaccucaggugauccaccaaccucggcuucccaaagggcugggauuacaggugugagccacugugccuggccugacauuuaaauguuaaaugugccagauguaaagcauaucugccauuuuaguaaauuaacaaaacuagcaaagagcuaaauaacugaauugauacuaaugcauuuuguaauaaacagccaaguauagguuguauuuauauucuacaauguggagacgaaaaaacaacacuuaugaugguacaaaacaaccuuucuaaaaauacuggggaaauagaagugcugcagagaucaucucuggcguccagcugccuccucccauccuggagauggugaagaugaggacagcauuguguucagaggcacaaaggaagccgaguuccuguccgacacaaacaucccugggaaccuguggcaccucccacugcagagccugugaaaacagccaggcugcaaggauccuccuugguggaaauagccgggcagcuaacgccagugugcagagaaaggaagcuggagcuauuuuaguugcuuaacgucuaccuuuuguuuguggaucguuuccucucugacacuuguggcuaaagaagcaaguguuguuugaaggagauuagagucuuaaguauuuuuaacacucacuagagugugacauuguaugggagcucucugugauaaaaucaaaaugaaaggugagcucgccacucuccugcacguugacaguuuagcaacauggaggaagugggaagcuggcuuuguguuagagaguuaugcuguucaaauauccaucauuuaaguaugcuguucuuauccuuguacuucgucauacuuugucacuuugguuuugccugucagucacgucaacagucaguauguuuuucacuaugaagggaaacugcuggaagagugaguucauuauuucucucaccuuuacauuuugcaacuuuauauguauauucaugauucuguccagccaccuugauaauccacaaucagaaaaguggguuuucaaauauaaaucaggauuuuaaauuugcagcaguguaaaaagauccaauuccugucuuugaggcacuguucaggauuuggaaacugaagcugggugcagagccuccuaggcaccaucucgucuugaacuuacauucugaacucagccuugacugcucuggguucauugugguuaacuaaccuucagcuucaaagacauuugauuuacuccucaaccaaacuuacaaaauuuuaguaucugcaaagcuuuuacuuuugugcaccaaaggacacagucaacagauuaaaaaggcaacccgcagaaugggagaagauauuugcaaauuauguaugugauaagggauguguuguauggagaacuccuucaacucaacaacaaaaaacaaacaacucaauuaaaaaaugagcaaagggcuuaaauagacauuucuccaaagaaaauauacaagucagcaagcacaugaaaagaugcucagcaucacuaaucguaagagaaaugcaaaucaaaaccacaaugagauaccaucucauacccauuaggauggcugcuaugagaaaaaacacaaaagaaaagaugcguuggcggggauguagagaaauuggaacccuugugcauuguuggugggaguguaaaauggugcagccacuguggaaaacaguaugacagguccucagaaaauccaaaauagaauuccccauaggaucuagcaauuucacuuccgggcauauauccaaaauaauugaaagcagggccucagacagauaccuguacacccauguucaucgcagcaugauucauaauagcugaaacauggagguaacacagguguccaucgauggaugaauagauaaacugugguuuguucauuuguuuacaaugaaauauuauucuguaauaauacaaaaauaaauacuuaaacauuuaaaaggaaggaaauuuugauacaugcaucaucauggauguaccuugaagacaucaugcuaagugaaacaagccugucacaaaaagacaaauacacaaaugccaugugauuccacuuagaugaggcacuuacaguagucagauucauggagacaaaaaguaggaugaugguugccagggccuggggggugggaauuggggaguuauugugggauggguagaguuucaguuuuacaagaugaaaagaguuuuggagauugguggcacaacaaugugaauguacuuaacacuacugaacuguacaauuaaaagugguuaagaugguaaauuuuauaguauguguauuuaccauaauuaaugauaaaauuuaaaaaauuauuuaaccacuuccuuuaaaagguauaaccuuaaguaagaucuuuuuacuuaaauaugguaaauauaguuucuccaaaugccuuacguguguuauauuuuugaguaaaauauuuucagugaaccuaagaagguucacugaugccugaaacauuuuuaguggguaaauuuauuugacagugaaauaacuuauauuuuaggccauuuacccucccucuccauguauuuucuuucuccuuuguauguuauaccauuugacaacacuguuuugacccccuuguuugauccuugcaagcuagaguuauaaaggauucuguuguuuucuauuuuuucuauacuaccauauuuauuauauuuacuuauuucaauauauuaagauugccaaacaggacuguggccaaaaaucugaaagcauguagcauaucuuugcugagggagccaacaauuaagaacagacaucuuguauuuaaugagaucuacugguuuagaggcuguguggucugucucauccuuucacaacuucuguacaacuuugggcaagucacucaaaaggacuugccaaucaacuuuucugaguucuauuuccuuagaagucaaauaauauccuuaccuaucuacuuaacuaagguuuugaagaguuaauguauuaauagaauuuguaauaguacuuacaaaaauaguaaagauuuucaaauauuuuaaguccuauauugaugaauauuuuuaagugaaugguuuugucaugggaauaauuuggugaacaucuaaauaauauuugacccguugauguggaggaccacacaggcuuacuauaaagacuugaauuccacagacauuugaccuguauuugugauacaaaaaucuuguuuuuccucuuaaaaacuuuacuuacuacccaguuuccauauuagagaagcucguggugcagugucuaauuuuagaggaaaagggccuugaaucaugaacacagcuucgcucccuccuccuuuuacuuuacaaacacaggcccaagguaaauggacuucccucacaagccagcugugaguuuguuugucaaaaauaauuugguucccuugguucuuagaggaugaugguuuuauagcuguuacuuacaaaaccaauguuucccuuaguauugagcuaccucuuuauuuaaacuauuagaaaaugugucgccauauauaucacuaggauauauaugguaaugagaaccuagauuagguagccuaaauacuaugguaccuuagaagagguaauaauaucaccagggaaacuuaguuuauaaccaaacugacagaaucucuguauuugucagauaaugucccuguaacuuugguagguauguuuuaaccuuuuuaugugucugaauuaaacugugucauuuguaaaacuuuccuaugugauguaaucucuggugacuuuaauuguauauuagaaaauaagauguuuucaagugacucugggacugaggaaacuaauuuuauauuuggguauuuugagcugcagacaugggucugacaucccacauggcugcaggaaagcuggacagcaucgauuugcagauacugugcucuggcuguggauuccucucuguggcuggguccagccugcuccagcaguguagagcguaguuugcuuguugaauguaggagggauauuuggaggacauaggcuuugccuggauuugaauccaucccagacuccaccaacacuaaccuauacaaccuuggggaaguuauugaaccuccaagggccccagauuauagaagcguaaaacauacuuuuggucuucgugaccaacacacccuaaugugacaccccucccccucucccccccagugauucacauccuuguaugagcccuucuccuugagugaauuggaauuuggaacuugcuucuaacuuacaagauauggcaaagaugaugggaugucacucccugugauuauaaaagauugugaaaugcagguggccccuaggaugcgaggauugucucugcuuaacagucaguaaaaggccaagucucucagucuugaacccgccagagaagcaauuuucaacaaccccacugagccuucccaaucaaaccuccagauagaaacacagccugcugacaccuugauugcagccuugugagacccugagcagaggacccggcuaagccaugcuuggacucccaaccgcuggaaacugagauaacaaauguguguguuuguguuuaaacuaccaagcuaaugguaaugugauaugcagcaacagaaaauuaauacaguagucaauagauuauauguaaacucaggaaaguaacuuguggugcccauuuguucuagccuaauucagaacuauguggccagaauucaggacagccaccgcccucuggaaagugaggaaagaauacuagaaaggagaaagccagagagggacagccauaaauucuguggauaaauucuggcuaaaucucuggcucagccuugaaccaugcaugaaaaggacagauaccaagcagccuggcuaagaacuaaagagcugaacugagauuugauugcugcucaagaaacaggacuuaaagugaauccagucagcuuauuauugcccgugaagacaaaguaauuuacagucuccugaggaauaugagggaaucuagaaccuccuaagcauaacacucaacaauguccaggaugcaggccaaaauuauuuaacauaugaagaaccaggaaaaugcgaccuauucgaaaaugugaaaaagauagucaauagaaaccaaucuguagaugacugagauguuggaauuagcagauaagaauuuuacgacugcuuguaacugugguaacaacauaaugggaaauaugcucauaaugaaugaaaaaaagaaaaaaucucauaugguuaauaagaacuauaaauaagaaccaaguagaaauucuagaauggaagaacacaauagccaauauaaaaauuucacugaugggcccaacaacagaaugaagguaacaaaagaaaaaggcagugaaguugaaaauaaaucaauuugaaauauccaguuucaagaagaagagaaaaauuuuggaaaaaaaaguagauccccaaagauuuauuuuuucuauuuauuuauuuuuucuuuuuauucugggacucuauugacuccagaauaagaagagaaaaaaauauuugaaaaaacaagggccaaaaguuuuuuacauuuugugagacaaaauuuacaaauuaaagagguuuggugaauccaaaucaaaauaaauaagaagaaaacugugcauagcuacauagguacuuuauaaugaaauuacuuaaaaauagacuuaaggagaaaaucuuauacacaaguagagaaaaaugccauauuuugugcagggggaggggggagggauagcauuaggagauauaccuaauguaaaugacgaguuaauggguguagcacaccaacauggcacauguguacauauguaacaaaccugcacguugugcacauguacccuagaacuuaaaguauuauuaaaaauauauauauaaaagaaagugaaucacuuuaucaucagaaacaguagaaucuggguaacaaugggacaucuuuaaagugcugaagagacaaaacaacugguaauucagaauuaccuacccagcaaaaauauccuucaaggauaaggcaaaauaaagacauuuucaaauaaaauauaaagaauugccauuagaccuccauaaaagaaacacuuaacagaaauucuucaggcugaagauaaaugauaucagauggaaacuuggacucuuagaaagacauaaagagugucagaaaugguacauagcuagauaaacauaaaaaaacuauuuuuucucuuaauuucuuuccaauauaugugauauauuucuuuccaaaauauauaagauuacuuccaauauaugugauugcuuaaaaauuauaauauugucuuugggguuuauaaucucuauaaguguaauacauaagacaacuauagcauaaagcauggaagggcuggguaaauggaccuaugugauuguaaguuauccacauuugaugugaaggguuauaauacuuaaucuaauuugacuguaaaaguugagcacacauauuauaauuguuggaacaaccauuaaaccaaauaaugcaaagagguacaacuaauccagugguuaaauuuuuaaaacccaaaaguaaaguaagaacagagaaacaauaaacaggagcaacaacaggaaacaaacugguuuaucuaaauucagccauaucaauaauuacauuaaauguuaacagacuaaacacuccaguuaaaagguagagauugucagaauggauaagaauguugucuauaagaaccuauuuugaauaaaaagacagauacugauuaaaagugaauggguagaaaaggauaccauuuaaacaguaagcaugagaaaacuggagugacuagauggguagcagguaaaauagccuuacauauuacuagaguuuaagauggacauuucauaaugauuaaagaaucaauacaucaggaagauuucauacucauauauauguguauguaccuaauaacagaacuucaaaauacaugaagauuugacaaaauuaggagaaauagacacauccaccaucauauuggagaacagcaugacugagaacaaucucucagauagaacaacuagacaaaaaaaaugagugaagagauagaggaucugaccaacacuaccaacuauccauauaaaugauauuuauagaacacuauauccaaccacuacagaguacacauuguuuucuaguacaaugugguauguuuaccaacacaucucaauauacuuaaaaggauuuauaucauguggaguauuacauuagaaaucaacaguaacaauaugucuaggacaacccucaaauauuuggcaaacaacauacuuuuaaguaaucuaagucaaaaaagaaaucacaaaggaaauuagaaacuauuuugaacugaaggaaaaaauauacaauauauuaaaauuugugggaucuagcuacagcaguccuuagaggaaaauuuauaacuuuaaaugucauauagaaaaaacuaaagguuaagaaucaaagacuuaagauuccaucuuaagaugcuaaaaaaaaguagaacaaaauaaauccaagaaagagagauauaauaaaaauaaaagcagagaucagugaaaucgaaagcaguaguagagaaaaugcauaaaaucagagcucuuucugucuuucacaugaucaaccauaugaucaacauaucuagauugauccagggaaaaaagaacauaaauuaauaucaauuuuaaaagauggcuuauuaauaugauucuauagacauuaagaugaggaaaugugaacuuuuuaccaaaaauuuugaaaacuuagaugaaauggagaaauuccuugaaaaaugcaacuuaccauuugacacaagcugaaacaaaaaucugaaucacacauuuacugugguggugaugguaauugcagugaauauuuaucauuaguguaugcauucauccauucagcugaauaauuuaagugccugcuuugugcuacaggagauagcuaaaauuggagcuaguguugggauguagaaaauaaacaaguaaacaaauccauacaauacuucagauaucaguaaguuaucacaaggaauauguuggggacaugauuaagagugacguaacaggguaguuaguuucaauuccaacuugaggaacucugcucugugcuaaggaauaaaugcuuaggaggaacuggccuugugacaaucugggggaagaaaaucccaagcaagggaccccuauugcaaaggccugaggucaggacaaacuucugaucaaggacagagaauggcagauacaucauuucuguaagaaaacuuccagguuagucuuuucucucaucucucuccagauuuacugucuuauagaaacaguauuaggaugagauucuggcuaacugugauuucuuuccuuuuuuaaaguuuuauucuaaguaugagauuuuuguuuuaguaaauguuucuuauguuaaauacccaauuugaaacacuuauuaucucuggauuuuuuuuuuuucuggaguacguaagaaccagcccucagaauuugaccguguauaacagugaggaaggggcagcacgguagagagacaggggacuccucacacugauuugccuuugauggguggagcugagaaaaaagucaucccuggggguucugcuguuguguuaggagucacccccuccugacuguguuggaggggccgccccagcuuccagccuuguggcaagcguagacuuguguuagaccuccccagcaggcucccugcacauauaaagguggagaucgcuuauguagacccaaagucuagguuuuggaucuuucacagcaguucagaguguuggccacauuuuaaaauaucuaauugucaguacugagaggaucacacggaauaaccuagaaaacacgcacauuucccaaggccaccauuuggccuguaacuauagagggcaaggagugauuugugucuauagauugaggucaguuggaaaucuuucagcgcaaucacaggccuugauuauuuuuagacaaugaauauaaaacagacaaccuuagguuaugugaagagaaccacacuuaauuccaucaaauucaaguuuguuucauauuucucauaaacuaaaccauuaagugcugagaacagcaaauaacacauuucugauauggaagagaaauuuauuccaaauaauauugaaaaggacugauuucuuuaaaaagcacucauucagacauauuuuuuuuccaaaaucuauuguuuugguagaaauaauuauaauaaaagaagcacaauauuuuuguguuuuucuauuuagccuucuacauuugccaaggaauaaauguuaaggaaccacuuuaguaauuuuaagccguggaauugagugacaguaaaagcuuccagugacuaaaaacuuucuuaacaauguuuuuuaagagaggauagaauauuauuggagagagauuagacaaaaugaagagucagauuucuuaauggacacuuuauaaacaauagccaugguagcucauaaaagcuuuuacuuuucauuauacaguucuaacaguugauagaacaguaagccugguaagucuuccuuauuuaugugguuuguauuuuauuuccuucauauauucugaguaguacuuugcaccuuugcacuugacacaucugcuuuugccauucucuuaagaauauugccagaauccugcuagaaacuugugaugaagcauagaugcuccaaaugagcugucauccuggguggaagucuauucccuggaugugugggaccaguaccucuccaagagauguuacugugcagagggagugcauuucacacccuagaccugugccaaaggauuuuuaucauuuccggaagguuaagaugucugcagcuuccacgucuuaugggagcacaucaccauuaauaaauuuauuuucgguuguaggaguuuuuauauuuuguuugugguugccacauaugggaagaagaugauacuugaguaugcuugucuaagaagugucugaagcuguuggcaucaagagcacaauuauuauguucaaaacagaucuagauggggcaacugaagcuaaugagaaaccugauugugccuuccugccugcagcguugaccuaagcccuaggcaccagcauucuuaugcaaggaccccaagggccccuccucuguggacugcaaagcaaggccagacuaguuuuacuucugaugagacccaaaggugcaaaggacagccgaccccaugcaaggccuaaaugaggggaggauuucagcuauuagucaaauacuggugcucaggaaagagaucuguagaaacucccugaaagaucugugugcagaagugaauauuguaaccuaugcaucugcagggacaccccaacaugaaugggagcuuagaaaggaaacagugcucauugaucaugaagcacugcuugcuucuggagguaacauuguguuaauaaguaguuuuuaaguuacauauuaaucauaaacuauauauuuuuaaaugguccauaucuuagaaguucucugugguccuuugcuuccaauguuucuuuagggcaaaaaauaaaaauaauccacaggacacugaggagagcaauacaauuuccaucagugaugaauuggaauagaaaugcugauguauagcaaagauacuuacucuauguacagaaucuacuuuguaaucccacuucauggcauucuaguuucuccucucuuaugcuuuugcaaccauuaaauuguuuccaagccuuguacaguugacuguuaugugugugggagucuuuaguaaaaauagaaauagacauccaccugaaaauugccuggacuuguucuuagugguccccgugccaugcaagugaacuggauuccuuugaugauauugaugaggauauuaccuaaucuucaccucuuccuaggaacacacuuuaccauaugucccugugaaguaaguguuaagagaguaaaauaaauaaaucgcauuauguacacaggcccuuucugcccagucuugccauucagaaaugcacucauuuaaucuccuaguugugaacacuugcuggggcccaucacaugcccuggcuggcacugcacagugcugagcagcacagauggauacagcuccuccugguauugaggaggccccgucuaagaagauacacagauguuaccaugaagucaaggagcaugcaggggcccaggcacgggggagaggcagcuguuucuuuucugugacauguaguauugagaugggccuugaaggauggaugggucgugaggacaggacaguucagcgagagaggacacuccgugcugaggcugagguggggccggcggggagaaucagggccacuggaagagcaggaugccacacugcacacaccauuugaguaggauccugcuuacaauuaugcagcuagugacagugaauacaaaccaagcuucuuuccaaugccaauaaugccauacuggccucccaucuguuccucuuguaguauguaaaaggccaaguuagaagggcuuguuaucaaagagagaaaaagcaaaugcuggcaaggauauggagaaaggggaugcuuaugcacucuuggugggaauguaaguuaguauagccauuaugaaaaauaguauggggguuccucaaaaaccuaaaugaugcagcaaucccaccacuagguauuuauccaaaagaaaugaaauuaguauguugaagagaugucugcacccccauguuuauugcagcauuauucacaguagucaagauaugguaucaccuuaaagaacuaaaaguagaacuaccauuugauccagcaaucccacuacugggcaucuacccagaggaaaagaagucauuauucgaaaaagauacuugcacacgcauguuuauagcagcacaauucacaauugcaaaaucguggaaccaacccaaaugcccaucgaucaaugaguggauaaagaaacugugcuauauacauaugauggaauacuaugcagucauaaaaaggaauaaauuaacagcauuugcagugaccuggaugagauuggagacuaugauuguaagugaaguaacucaggaauggaaaaccaaacaucguauguucucacugauaugugggagcuaagcuaugaggacacaaaggcauaagaaugauacaguggacuuuggggacuugugggcaagaguggaagguugguuaagggauaaaagacaacaaauauggugcaguauauaccgcuugggugauggguguaccaaaaccucacagaucacaacugaagaacuuauguaaccaaauaccaccuguaccccgauaacuuauugaaaaauaaaauaaagauauggaaucaaccuaaguguccgucagcggaugaaugguuagagaagaugugguauauauacacaauagaguacuauucugcuauaaaggaaaaaaugaaauccugucauuuacagcgacauggauggaacuggaggccauuauauuaagugaaauaaaccaggcacagaaggagaaauaaugcagguucucacucuuacgugggagcuaaaaaaguggaucucaugaagguagagaguagauuggugguuaccagaggcugcgcaggguggaggggagagggaggaagagggaaugcuuaauggauauaaaaguucaauuaggucgaaggaauaaguucuaguguuugguagcauagucggaugacuauuguuaacaauaacuauuguauaguuugaaauagaaaagauuuuaaauguuuacaauacaaagaaaugcuaaauguuugagguuaaagauaucccaauuacccugguuugauuauuacacauuguaagcuuguaucaaaauaccacauguaccccauaaauauguacaauuauuauguaucaauuuuuuuaaagaaaaaagaagaggccaagcaguuuccauccccuugcucucgccugugucauucuuccucguaccuuugcacagguggccuguuucuuucacugccucagcgcuccauccucagccacggaaacauguggcugccuuucguuucuguggaagguggcacuacuaacaugaugcagugguuucuuucugucuuccccucacgagacauacauucugugagugcagggaaggaguuugcugucuuuuuugaggcuccccuuccuuuguggagaacagugccuggcauguagucaguuuuuuuaguaaaauuuuugagaaauaaaugagugaucgagccugguagcacagugguaacugacucugagagacagaacgacagagagggaagaagcauuuaagauaacucaggcaggaaaugcaaagggccugaauaaaagcagggguagccagggguggggggcaaggagggagaugggauuuuaggacugucacagcaagaacugaggugcuucaggagcagugcagugaagguggcgagcgagauggaaguggcaaagaauccaaccuuuaaagauuauccagaaggguccgcagaugcagaugaugaugcagaaccaguuggagcugaaaugucuacaggaaccgcacuggcaguugucuggagcucacaggguggugcauucacacaggugguuugaaaaugaccaccaguaggugguaguuggggaaauaagaauggaugaaaaccagagaugaagagaagaggcagcccugcggagcaccaugcccaggauggggagcagcccgagagugugcagaaacucgcauagugcaaggagggaagaggcugccuggugggaacucacaggaccuuuggaugugaccaucagaacacugggccauucacacaggugccacacuaggcaggaggccaguggcaaggaagguggggugaccgagacuaaggaaaaggaaguugaaguggaaccaguucuuucaguaaacuucauggggcagggggugugugugugugugugugugugugugugugugugugugucuaugugucaguguguguaucuuugugugacggcuccaugaugggagaaguaggcaggugucuuugauaaggagguacuggagagcuauacaagagcucagggugaccuccccaaggcuggcuccagcgccccagggagggcugaguuugggggaagcagcuuuccuuuggagaauggggcccagugucugagagcuggcuccugccugggaccuccacuuuuucugaguuaugggguaagaucaucugcuaacagggaagggaacgaagguggaguaacccaggaggccacaggaugggaauacauguuuggaauuugcagaugggaaaagcaaacagaaggaaugagaauaaggauuucuaaacaaucacuuugcaaaacuguuugccagcgacuucaauagcuggucacacaccccaugacccaagcaccuccaacugugugcaccuccaacaguugcaccaagccaugcacgugaguauucacagcagcacuguugacagcauccccaggcucaccccaaccgaaucccuuuccacaguccagcacauaaagcgugguguauucacaccgagugccacugcacagcaacgagccacacagcagcggaugagccucagagcaaaagaagccagauaucaugauacaaagccccaaaacaggcagagccagccuccacucaugccaccaggagaguggcugcugucaggagaggguggggaaucagaauguuggcccgaggauccuuggugagcuuggcccacaguggcagggaagaggaacagaguuaggagugcuggaggcuggaagcguggccucugggugagcccuggaucugacuuagaggcaccaggcaggauggaaacauguaggcaguggaauauucucuuuuccucugaagacauacuccagguuucugcugagggagagggugggcugcaggaaggaugacacugcaggaggaggaagaaucagugggaagugguggcugcuagcaggacacccauucucuuggacugggggauauuuugcugcaaguggcagaugcuauuaaaucucuuggcuugauuuacauaucuuccuuccuguuuauuaaggagauucccugcugcuuuggcaucuuguauuccccaggggacugugagguggauccuguccugugccucuaagggccucuuuggguucugcucucucuggguccugagugcagcccggguacggagaggugagaggucugcccaugguauguugguacuggugauuggcaacuuguauacaugcaccaguguacaauuuuaaaagaagcaguaucuucccacauuauuuuaaaaaaguaaaaagauuauaaacgucugcacauauuucuagcuaaaacaauuuuagcagaaaaauuaauccuuaacaaauauugauauuuacugaagugggaauaugaaaccauguaguuguauaauauuuacugaacugggauauacauauuggaaaauaugaagagaucuccauguuaaaaccucuauuuaaaaauacuagggcugggugugguggcucacaccuguaaucccagcacuuugggaggugggcaaaucacgaggucaggaguuccagaccagccugaccaauauggugaaaccccgucucuacuaaaaauacaaauauuagcugggcaugguggcgugcgccuguagucccagcuacucaggaggcugaggcaggagaaucacuugaaccugggagguggagguugcagugagccaagaucacaccacugcaguccagccugggugacagagugagauucugucucaaaaaaaaaaaaaaaaaaaacaaacaaacuaggaucacaaaaaaaguguuaaguauuugaggugagggauauguaagcuugcuugauuuaauuauucuacauuguauuuacagaucauaacaucaacuuuguaucauaaauuuauacgauuauaagcugucaauuuguaaugaaaauaaacuaggagcacauuaguauucuguuucagggcauuuuguucucagucagguagaaaaaaaaaggacuuaaacagcaacuuuuguuucuccucauaacuuuccaugaagcaugcccaguauuuuucuuucuguaauuaacaagaaugaugaugauagaaacuguuuucccugccagcaugccugugcccaccugugaagaggccuuucauuuuaccaaguggaacaucaagaacugcagggaaucauuugguugaccuaaggcaucagcauuugaugggagucuuuucaaccuugcuuaggagccucaagaauaaagcagaaucgauggcagaaaauauagugauuuuauauuuaucuaacagcaaaugacuaguaaaaacuuccuauaccuuggguacaggccuaugaugugugguuugugcagucccugggagaacucuuuucuuguuucggauuugggauugaaauggcgacaugucacuuaaauuagaauuuuccuccuccaucugccaggaugacaccagccgggauacugcuuccagcaaacaugccccuuacacacaggggucggcacugcuuuauuacagugaccaaauaaaagcauagcuuguucucgacaggaagauucacuuuugaaauuaagacuauacaggaacauguaagguucagaauccccagguuucauauuucacagaugacugggguggauguauuuuuuuuuuuuuuuuuuuuugagacaucucgcucugucacccaggcuggagugcgauggcacgaucucggcucacugcaaccuccaccacccugguucaagcaauuccccugccucagccuccugaguagcugggauuacaggugcgugccaccacccccgacaauuuuuuuuuuuuuuuuuguauuuuuaguagagacaggguuucaccauguuggccagacuggucucgaacuccugaccucaggcagugggguggauguauucuuucuggugugauuuggcaaaccuugcaaggugccaggugcucccaaauuauuccuguaagaucaggaugucaccauuuccuucacuccuccugaaauucugcggaauuaaagucguucuuuuguauuaguacuuaagccuuguuuucccaggccucucucagccuaggagggaacccaggaggacagaggguggaucugagauggggucuuguucuguugcccaggcuggagugcagugcaguagaacgaucacagcucacugcagccucgaacuacugggcucaaucaauccuccugccucagccuccuguguagcugggaccacaggugcaugucaccacacccagcuaauuuguuuguauuuuuaguagagaugggguuuugcuauguugcccaggcuggucucaaauuccugggcucaagugauuugcuugccucagccucccaaagugcugggguuacaggugugagccaccccacccagccaacucauuuaauucuuacaccaacccugcaguaggcaugcuaucauuaucccauuuaaaaugagggaaccaaggcacagagagguuugguauuugagcaaguucgcgcagcaggugguggguagcagggcaggcaggcugcugcagagccugugcguccuugucuuucuguagggugguacugacugugagaaacacgcauucacccguccaaacccaaagaaugggcucggagacacgaaaaacagcagaagcgagacuuuuaauggcggucuuggaagaucgggcgucuuguaggcaggcacacccggggcagguacagcagguaauuuaucuccuagcauggaagucccuccccaguuucucaguggucgaguaauaugggguuacaauuuuccuugacgucaccuaaguuucauuaccuuccuuuaagguuauaccccguccccuucccugcuuaaguuucgauuucccaauaacaaaauuuucuucccuuuuaugggcugacccccacucuacauuguguucgcuuauugugacuuucuagacgcaugaacuugcgguugguuacauucucaggcuggcugcucauacuuagauuuaucaugccuugaaaauggaccauuuaaaauguuuucuuacaugucaaugcauuuagccucaagaaacuuaaccaggugacagaggaugacugaauucucucaggacccuggugugcccuacaggagugagaccaagaucuagguaguucauaucuguuucugggggugaugucagggucuccaggcuccccuuagacugccgacuguugguuaggggagugauuagggugauggugagaagaaaacuucagaauaaccugcccaccagugagggcacugguuucuguacuuuucauguuauuacuuacuuaauccuaacaguaaacaagggaggcagguaguauuuuuguccacguuuuacagauggagaaauugaggcacagagagguuaagcaacuuauccaccaucacacagcuaaugguggacaccagacucuaagcccugcaaucuggcuccagggugugaguggggccaccacgcugugcucucaucucuugcucugcuuuucuaggcuguucuggcucauaaucuuuuuggucaucaucuuaaaaauacaaguauauuuagaggaaauuacauauaaucaucauguaaaagauuaauagguuaaaauguagguuuaaaaauuuaauucagaguagcuucauuauacuaaaauguuagccuccuggugucucuggaaaaugagaauaugauaaagaaauaacuacauuagguauugaggauuuauccuguuauguacaaaucucuuuuaagaaauuacuuaagcacuuuagagggaacucuuucuagaaugaaucacaaaacuuuucugaauucucagacuugacccugacucucucaggaaacuuugggcuuauugauuaguggaaagggaauuagauaacuuuggugacaaaguuaggcaggcgcugcaaaguggccgccaaggccuggguugaggcuggggccgaggccaggugcgggcaggccugucgggaagggcaccccucugauuugaguuagauauuccagcucugcaugguuugagucuguguucugaauagguaagauuuccagcaagccagauucuccauggaugagaugccacuuuauacuuuaguuagugaaggaaaugucaaaaguuguaauauuauuguaauguguuuuauuguuguacagguaucugcagguuuauaaaauaaacaucuucauuguaagcuaaucauuuggaggaaauguagagcacauagcaaaauuaaauccagguuuauuuaaaguaaaaugguaaaaaaaacuaaaucauaaagccacuuuaaaauaguacgaauuuuaaaaacuucgaaucaagucccuuucuuaguaugccacauggugagaaaccaaaaaagggcggagagaacccugacagauugaaucagauaaaauuuuaccuucugaaaaaguaaaauuuagaaaauucaaggccaugacaaacuagggaaaauauuuacaauauauaugcuauuuagaggauauugcuaagagcacauggacaccacaguaggaaaaaaaauugaugugaacaaccaauucucucucuuucucacacacaaacacauaaauaauaagcauuaaacauugcuaauccuaauaugugaaaaaauguaaauuuuuaaaguauucagaacacuuacacuuugauaaaaaaacaagcauggucauugauacucuguguuguugaaugggggauaggggcugcugaugacuuaaacuaauagccuuucugaaagccuguuuacagcaugaaucacaguuuuuaagaauguuauuuuuuugugguaggaacacugaacaugagaucuucccucugaacaaagugugaaaugcacaagaguguugucacucugagcacagccugugcagcggaucucuagagcuuauucauccugcaucaguggaacuuuguaccccuucaacagcaacucccauuucccucuuccccucaucgccuggcaaccaccuuuccacucuuugguucuaugauuugacuauauuagaagaaauccaccugguuuuccuucgcuuguguguauuauuugcccaugggccuuggcacugaggagacccacaugugaaugaaugaacaaaucaacaaacaagcgaacaaaugaauauguaaauggaugcaaggugcugaauccugcucauuuucuuauuauacagaccaaggcucuguggaugucugucuucuuuagcuaaacaagugagaccuuaaggagugucuucacuuccccuaagaauaacgugaaccuaauguauguguacagaugaaaggcauaaagggacauggaagauaaacacaccagcauuuaaucaccuuuuacuaaguuccuaugaagugccacucccagagugagguauagaaccaaggucgggagugggagcgugaggcugugucugguggugagaguucuuaucuguccucuuuaaguuagaacuucccucccccuuaaacacuucugaccucgaggaugauguacauaauuggcacaaugagauuaugagaccaaagaaaccaaaguggagcaaaugcuuccaaaaaugacccagaaauccgucacuguuucugcuauuggggaaaguuuccuuccuaccauaugccagacgggaggcauuuaaaaaucaguccugaccaagcaaaagaggugucuuagcucacacugcuauagaaaauauaaacuggauggguuaaacaaccauuauuucucacaguuuuggaggcuagaaaguccacgaucauggcgccagaagacucggugacugaugagugaucucuuccugguuuucugacaacucuuuuuuugcuguguccucauauggcagaaaaagagcuagagagcuuuuuguggucccuuguaagggcucuaaugccauucaugaaggcuucaccaacuuaccacuucccaaaggcuccaccuucuaauaucaccuuggagguuaggauuuccacaccugaauuuugggggaacacacacauucaguccauaacgagaaggcacuagauuuccugguugcgggaaggaaaagggcuagcugcaugcuuuggaaaucaggcaggacuagauauuaaguguuccucauagaauaugcuaaagauagacuuuuaaaguauuuucuaaagcaacacuuugaagcacaaacugguuucuaauaugcccaguaggugggugcuuuacuaggugagaaauccaugggcuuuagucacuaugguaucauaaaaauaaacauuuccauucaaaacugcagcaguuauuucuuccugaccuaucagccugaggcugggaaggcaagguaaggacagugguuaaagaggaugggcuuagagucaaaccaaagcuaaauccucacucugcucacuuauuacuuguaugaucuuggacaaguuaucuuucguaaucuucaguuucuuccuuuauaaaaauagauauaguaaaauuaccucccuuuggggggauuugagucauaugagauacaauuaacacccugaguaaauguuuaauaaauauuuauggcugacaauguuaauauuugcuugaagucucuaaauacaucuaccagaauccuuuuguuuaagcaccuuaaacuaacacaaacucccauuagaccuugucuuuauugaagggucucugacuuugccagacauuuuucaagcauguuaucuuaauuuaccaggaguagcaccaugacugggaaauacaugguauucaauaauuguuuguugaauagauguuauuaacuuugggagaagaacuuccagaggcaaagcuaggcaauuuuggcaaagccucaaggaguuuaaugcuucuccaaauuguguaacaaugagugagccagaaccaucuuucaacaggugaaauugcuuuuucaaguuggguaaacaauuugaaaaagagcugcugcugcguuuuuuuuuguuguuguuuuuuuuuuguuucuuauugaagacggagucuugcugugucacccaggcuggagugcaguggcaggaucucagcucacugcaaacucugcugcccggguucaagugauucuugugccucagccucuugaguagcugggacuacaggugugggccaccaugcccugauaauuuuuuuguauuuuuaguagagaugggguuucaccauguuggucaggcuggucucaaacuccugaccucaugugaucugccugccucagccucccaaagugcugggauuacuggcgugagccacugcacucagccaaaagagcugcuucuaugcccuccuuuucuaauuaauuaccuucagcuuaauguggacccuuaagagaauucuggaauaugucguuauuauuacagccaucagugagagcuuagagggcuucagcuaaccaauguggauucauagaacaaagcaaguccccaaguaggauacaaaugguaguuuuugguaguguuuccaaccugguagauugugugaaugcuauagaauuaucucuccuccauuagacuuugaacagcuugaggucaggaacguuuuacaucuuugaauccacuacaguuccuaucacagagaaaggacucagcagccccuugcuaguuaauugaaggaguaagugaaaucguggcauuuaacaaagucucucaauauuuuaaggagagaaugagaaauagagacuagaaaauaauacgugggcaaaccuauaacauuugaacaaucaccauuaguuaauagauugaugucaacucugaaggaagaagucuaguaacuaaagccaagguguuauggcuuucaguguuaucaacaaauaggguggaaauaauaggcaggauuaccacaguggaggugguggcaaggccaggcaucucaucucuuccuaagaacucuugaauacucagguauaaggucgagucagggcuucuaaaagacuagaacaccacaucacaccagccucuaggccuagaaaagucuuacaaguuagaacagugggcuaaagugauaaguagguauuaacagaaaaaauggaaagguuucauauccauuuauuugaaagaauucuggugauauuaucacaaaccgaaugugagcuaaccagaugacaaggacucuuuauuauuaauaauaauggugguuaaaaaauugugguuaaaaaaaccacauagcaugaaauguauaaucuuaaucauuuuuaagugucauguuuaauauaggcaccucuagaucacuagaacuuuuucauauugcauaacugaaauuuuauacccauugaaaaauaauucaucuuuucccccucccucaagcuccuggcaaccaccauucuacuuucuaaaguuugacuacuuuauauagcucauguaaauggaauuaugcgauuauuugucuuuuugugacuggcuuauuucacuuagcauaaccuuuucaaaguuucucuaaguuacagcaugugucagaauuuccuugauaauguuccacucuguguauagaccacauuuucuuuaugcauucauccaucaauagauauuuauguugcuuccaccucuugguuauugugaacugugcugcagugaacaagaacacaucucuuugaaauucuguuugcuguucuuuuggauguauauccagaagugggauugcuagauuaugugguaauucuauuuuuaauuuuuugagguacuuuauacuuauuccauaguacuuguaucauuccacauuccuacuaacaaugcauaagaauucuaauuucuccgcauccucaccaacacuuguuuucucucuuuuuuuuuuuuuuugauaguggccauccuaguggaagugaggugauaucuuauuguaauuuugauuugcauuucccagaugauuagugauguugagcaucuuuucauaugcuuuguggccauuuguauaucuuccuuggagaaacgucucuucaaauucuuugccucuuuguaaaucagauuguuugcuuauugucauuguugacuugaugcucuuuauauagucuauauauuaacccccuuucagacauaugguuuauagauauuuucucucauucuauagguucccucuucacucuguugauuguuuccuuuguugcacaauagcuuuuaaguaugauauacucacauuagucuauuuuugcuuuuguugucuguacuuuuggugccauaucuaagaaaccauugccaaauagaaugucauaaagauuucccucuauguuuucuucuaggaacuuuauaauuucaggucuuacauuuggauguuuaauccauuuuaauuuuuuuauaugguuaacgguaagggcccaauuucauucuuuuguauuugaauauuuugcauuuuccaaacaccauuuguugaagaaacuaucuuccacauuguguuaacaccuuuaucaaagaucauuagauuauauacaugaaaguuuauuuuugagcuccuuauucuguuucauugauuuacacauuguucucuaugucaguaccauacuguuuucauuauaguagcuuuguaauauguuuugaaaccagaaagugugaggcuuccagcuauguuuuauuguuuucuuccccucaagauugcuuugguuauuuggaguacuuugagauuccaucaugaccuuuaggauuuguuuuuccuauuucuccaaaaaaaaaaaagaaacugcuauugggauuuugguagugauugcuuugaauguauagauuguuuuggguagcauggacauuuuaacauuauuaauacuuucaugaaaauauuuauugugucuucucuaauuccagcaauguuuuguaguuuucagugugcaagucuuuuuuaucuccuugauuaagcuuauugcuuuuuuuuuuuuuuuuuuugagauggagucucgcucuguuguccaggcuggagugcaguggcgcaaucuuggcucacugcaaucuccgccugccggguucaugccauucuccugccucagccuccugaguagcugggacuacaggugcccgccaccaugcccggauaauuuuuuuguauuuuuaguagagacaggguuucacuguguuagccaggauggucucgaucugcugaccuugugauccacccgccucggccucccaaagugcugggauuacaggugugagccacugcacccagccugauuaagcuuauuucuaaguauuuuauuauuuuuaaugcaacugcaaauuaaauuauuuucuuaauuuccuuuuuagauuguuuauuguuaguguauaaaaacaaaacugauuuuuuggaauugauuuuguauccugcaacuuugcugaauguauguauuaguucuaacagcauuuuugucaaaucuuuaggauuuucuacauauaaaaucauguauaugcaaaaggaauaauuucacuucuuccguuuucaauuuagaugccuuauauuucuuuuucuugccuaauuguuauggcuaggacucccaacacuauuuucaauagaaaugggaagagaagguauucuuuccuucuuccucgucuuaaagagaaagcuuucaguuuuucacaauugaguaugaugucagcugugggauuuuuauguguggacuuuguuaaguuuagguaauuuccuuugauuccuaguuguugaguguuuuuuuaaaucauaaaaggguguugaguuuuguaugguuuuugucuuucacuguggcauauuacauugauugauguuuuuauauugaagcauucuuaccuuccaggaauaaaucccgugugauuguaguguauaauccuuuuauugugauguugaauucuguuugcuagugcuugguugagaauuuuuauaccaauguuucaucagggauacuggucuguaauuuucuuauacuaucuuugucuuauuuuuggugucaggguccugcuggcaucauaaaaugagucuggaagucuuccuccucaucaauauuuggaaagauuuugaaaagaauuuguauuuguucuuuaaguauuugguagaauucuccauugaagccaucugguugugggcuuuucuuuguuggaagguuuuugguuacugauucgauuuccugacugcuuauagguuauguccagaauuuuuguuucuuuauaacucagucuuaguaggauauauguuuguagaaaucuauccauuucuucuagguuauccaauugguugguguguaauuauucacaauagccuccuaugaucuuuuuuguuuuuguagcaucacuuguaaugucucuuucuaauuuuuaaaauaugagucuucucucauuuuuuacuuacuguaacuaaggguagucaauuuuguugaucuuuuaaaaaaacugaaauucuguuaauauuuuaaccaaaguucuuuuuuccuuuuucuauuuucuauuucauuuauuucugccuuaaucuuucuauuaaauguugguuuaauuuguucuuucaguuuccugagguacaaagucauauugcugaugagcucuuucguuguuuuucauauggguguuuauuauuacaagcuuuccucuuagaauugcuuugccugaaucccaugaguuuuggcauauuaugguuuuauuuucauuugucucaauauauuuucugacuacccuugugauuucuucuuugaaccauugguuguucaagauuguauuauucaguuuccacauauuugugacuuuuucacuuuucguuuuacuauugauuucuagcuucauuccauuauuuauagucagaaaagauauuugauaugauuuucauauuuuuaaucuuguuaagacuucuuuuguggcuuuaaaugugaucuaucauagagaauguucuauauaacauagagacagagaaagagacagagauagguaucuguuagaucccauuggucuauauuguuguucaaguccucuauuacuuauggaucucucugguuaaucuauucauuauugaaaguggagcauugaaauauccuacuuuaauuguguuucugucuauuucuacuuucaauuaugucaauguuugcuuuauguauuugaauacacugcugguagaugcgcauguauuuauaguuuuuauaccuuccuagugaguagaucguuuaucauuauauaagguccuucuuuguuuuaugacaguuuuugacuugaagucuaucuuauuugauguaauuauggccauauucacucuuuuaguuacuauuugcauggaauaucuuuuucccuccuuuuacuuccagccuauuuauguccuuauauccagagugaaucuuuuguagacaguguauaguuggaucuuguuuuuuaauccauucagccaugaauggauuaaauauuuugauuauauauuuugauuggggaguuuaauccauuuacauuuaauuauuuacuaauagagaaggacuuguuacuauuuuguuaauugguuuccguauaucuuguaguuuuguugcucuuuuauucuguuggcacucuccuuuguauuuuguugacguuuguaguuacauaguaauaugguuuggcugugucccccacucaaaucucaucuucaguuuuagcucccauaguucucacgugucgugagagggacccaaugggaggucauugaaucauggugguggaucugucccuugcuguucucaugauagugaauaagucccaugagaucugaugguuuuauaaaggggaguuccccugcacaugcugucuuugccugccgccauguaagacaugauuuugcuccucauucaccuuccacugugauugugaggccuccccacccauguggaacuguaaguuaauuaaaccuccuuccuuuauaaauugcccauucuuugguaugccuuuauuaauuagcagcaugagaacagacuaauacacagacuuugauuccuuuucauuucuccugugcaucuuuuguagguauuuucuuugugcuuaccaugaggauuacauaaaaaucuuauaacaaucucuuuuaaauugauaacaauuuaacuucaguaacauacaaaagcuguuuuccuuugcauuucacccuauacacaucauauuuugaugucacaaaguacauauuuucauacuuuguauuuauucacaguuuuauacuuauauuuuuaugcuuuuauuuuuuaaauucucuaccagaauuaaaaauuauucacacacuauugugaacauauuauauuccaggauuauguauuugucuauauaguuacuccaucagagaguaacuuuauauauucauaugcuuucauguugcuaacuaguguccuuuccuuucaacuugacagacuuccuuuaccaauucuuguaaugcaggucuagagaugaucaacuucaucagcuuuuauuuaucuagcuaggucuuuauuucuccuuuauuuuaaaaauuuauuuacuuuuaauugauaaauaauaauuguuuauauuuaugggguacaaugugauuuuuaaucuauguaugcauugucaaaauauucaaucaagcuaauuaauguauauauauuaccucacuaacuuuuuuuuguggugagauuauuaaaauuauauucuuuaagcaauuaugggauauacaacacauuguuauuaacuauggucaccaugcagggcacugaaacuuauuccuccaguuuaacugaaacuuggcacccuuuaaccaaugucuccucuuuuccucucucuccucuacuccucagcuucugguugccaccuuucuauuauguuucuaugagaucaacuguuuuagauuccacauauaagugagaacauacaguauuugucucuuugugcugucuuauuuuacuuagcauaauguccuccaguuccacccaugaugucacaaaucacagaauuuucuucuuuuuaaaggcuguguauuguuacauauauauguaauauaaauauauguguuuuauauacauauauauauauguauauaaaaaacaauuuauccaaguaucuguugauugccacuuaggguaauucuauaucuugacuauacuuuuuuuuuuuuucuuuuggugucagggccuggugccaucgcccaggcuggaaugcagugauaucaucauggccuccugcagccuucaaucccugggcucaggcaauccuccugacucagccuccugaguagcugaaauuacaggcacaugccaccauaccuggcuaaacuuuaaaacauuuuuuguagugacagggucuugcaguguugcccaggcuggucucaaacuccuggcuucaagagaucucccugcucaaccucccaaagugcuaggauuacaggugugagccauugugcccugcuguggggauaguuggcucauacagcccugcuguggcauucauaauaauguugaaaugaacauagaagugcagaugucuuuugauguacuaauuucaauuuuuuuggauaguacucagaaguggggaugguuggaucccacgguaguucuauuuuuaguuuuuuggggaaccuucaacauauuuuccaaaauggcuguacuaauuuacauuuucaccaacaauacacaaggguucauucaucuuuuuuugucauagccauucuaacaagugugaggugauaccucacuguagauuuuacuuugcauuucucauaugguuagcgauauugaacauuuuuucauauguauguuggucauucguaucucucuuuuuuuugcaaaaugucuguucacauucuuugcccacuuuuuaauucaguuauuuaguuuuuugcuauugaguuucaguuucuuacauauuuugguuauuagccuuuuaucagcuauaugguuugcaaauauuuucuaacaaauccauggauugucucuucacucuguucauuguuuucuuugcugugcaggagcuauuuaguuuaaugcauuccuauuuaugaauuuuuguauguguuaauuuaaacaaggaggugaaagaucuguacacugaaaacuauauagcaugcugaaaaauuggaaagggcacacaaaaauggaaagauguuucauguucauggauuaaaauaauuaauauuguuaaaauguccguacuacccaaagugauccuacacauuuaaugcaauuuuuaucaaaauuccaaugucuuuuuucaaagaaauagaaaaaaacaauucuuaaauuacuguggaaccagaaaagaauccaaaucuugagcaaaaagaacaaagguggaggcaucacacucccugauuucgaaauguaaagcuauuguagucaauagcuuugacuacagcaugguacuggcuaaaaaacagacauaucaaccaauggaacaguacagaaagcccagaaauaaacccaaguguuuauggucaauugauuuuugacaaagguaucaagaacacacaauggggaaagaacagucucuucaguaaaugauguugguaaaguuugauauccacauauggaagaaugaaauuggggccuuauuucaggccauauacaaaaaucuacuuaaaaugguuuuuaaaaaguuaaauguaaggccugcaacuauaaagcuacuagaagaaaacauagagggaagcucuaugacauuggccucggcauugauuuauugaaugagucgacuucacuuuugaaauauaguuuugccagaugaagcaguaguccccacccuuuguggcaccagggaccaguuuuguggaagacaauuuuuccacggaccaguggggcagggaugguuucgggauaaaacuguuccaccucagaucaucagacauuagauucccauaaggagugcacaaucuagaucccaugcaugcacaguucacaauaggguuugcgcuccuaagagaaucuaacguggccacucaugugaugugaggcagagcucaggcaguaaugcuuguucacuuaccacucaccucuugcugugcagcuugguuccuaucaagccacgaauugguacuggucuguggcccaggguuugggaaccccugagauaaacuauucuugguuggaaguuuuuaaguauccuugauuggcagguggcguuuuuuuucuccguuuuuagcacuuugaauaugucauuccacccucuucuggcuugcaaaguuuuuacugagaaaccuacugauaauauuauaagacucccuugaaagugaugaaucaauuucucuugcuguuuucaaguuucuuucuuugucuuugacuauugauagcuugauuuuaaugaauugugguaugguccucuuuggguuuauucuaguuggaguccuuugagcuuuuaaaauuuuguaugucuauuuccuuccuccaauuuggagaauugucagacauuacuucuccagaucaacucucugccccuuucucucuucuccuucucugauccccauaaugcauauuuucauccccuuggcauugucccauaaaguccuuaaggcuguguucaauuuuugaauuuuuuuuuauuccuuuacucaauaauuucaacugaccugucuuuuaguucacugauuauuucuucuucuucuuaauacagccugcuguugaacuccuccagugaacuuuuuaguucgguuauuuuauuuuucagcuucagaacuucuguuuuuuauaguuucugucucuuuauugauaugauucuauucaugcauaguuuugcugauuuuguuuagcugucuuucugaguauucucuuguagugcacugaacuuuaauuuuuuugucuuuucuggccauagauuuccauuuauuguuauuucucucuagauguuuauuuuguuccuuuaauugggccauguuucccuguuucuucauguaccuuguuauuuuuuaauguaauuugugcauuugacaaaauagccaccucuuccagccuuuacggacuggcuucuuacaguguaauaacaugucagucagcucagcuagagauucuuggggccucucaacccuuuucuggauauccaucuucccugggcuuguugguguauuuuccaauuagaagguuugcugauuucuucuuuaugagcuuguaaucucgugcucucucuugcaucugucuaugguacugcagauuuucuggcacugcggccagcuucugagcucucuuauuuucuaaagccuucagucauccauaguauuucaguuuugucuguauuccuggucaacugagacagaaaucagucccugaacaagccuccccacaaauccagaacauugcauguacuuuuuacucauuuccucccgagggauaagcagugagcugggugcuuucucuugauugcacugagcugugcuggccuuugccuguggcacuggcagaucucugcuguugcaaccagccucugagcuccuuuuuucucaguagcucccaggcauucaaagugugccaguuucccaucagugcucccagucagucgagacauaaacuagucccucaggcagccccccugaaaagcuggaauguuagauguacauuccauucuucucuuuucuucccaagggaaaagccaugaauugggcuuuucuccugcagacacugagcgauacuggguuaggggaagggcugucacaguugaggugaaauggcuuuucuuacccauuucagcauggccauucuuggcauuaagcuugccuaugguccugugccuucuuaacugguuucuggaguucucauaaaagcuucuggauuacaaauugcuguuaaguugaugucuuuguggggaaacugaggugcggggcuuccuuuucugcuaucuagucaacaucacuucuucaugacaaggagucuuaaaauugagauagcaauuuuaggaucuugucucuucacugaauuuuauguguuguauaccugaggaguuuuaguaaauggauuuauugaaaacucgaaaaauaaagagagaaaaagaaaugugaggaaaagauaaaauuacagaguguuuuaagaaguuuaauuuguuauugccaaaaccaaauaauuuuaauauuuagcuaaaggcaauaggggcuaauuuaguuaauuauggcucaucaauucuguggaguacuaggcagccauuaaaaaauaguugaaauucugcuaagaggguugauuuuaaguguuuuuaccacaaaggaaaaaaaaaaagauaaaugguaaugaugugaacugauagauauguuaauuagcuugcuugugauuauuucacuauagauauguauaucagaucaucaguuguauaccauacacacacacaauguuuacuuguuuguuccucaguaaagcugaaaaauuacaggaaaauauauggcuaacaaaacaaaucuaugucucucccucugaaacuccacuaaaaaaaaguauuacuucacugugacaaagacgagagaagcaauggccacugaugacaguuuucaguagacacuuuggggacuacaguguuuuguuuuuuguuuuuuuuuaagacggagucuugcccuguugcccaggcuggagugcacuggcaugaucucggcucacugcaaccuccaucucccagguucaaauuauccucccgccucagcuucccgaguagcugggcuuauaggugcccgccaccacgccuggcuaauuuuuauauauucaguagagacaagguuuugccauguugaccaggcuggucucaaaacuccucaccucaaguaauccacccgccucagccucccaaagugcugggauuacaggcaugagucacugugcccagccugcgguguauuuagauugugauaaauaccuaguaaagcagaagaagcugaaacuugacugcugggugaaagaggcccagcagaagacgccagauccuaggacacucaggaauuuggggcacauguuuguuugcacaugaccguggaacgagcugaugaugaaggaauggcugaaugccugcaugugaaacaguaagaucuccauaccccugccugcccaccacaaccagaugucugcacugccacccccugcaguggcagaacuaagaggcucugacuucaggacaucaggcacaaccaagucugcaccgacacagggauaagcgaaaacccacaugccacaggagagcuucaaggcccucucaccagaguacucgggaaggccuaguuucccucaggcaggagcugggcuuccccugugcagaagauggccgagcuagcagacaauccugcagguaugaauaucuggggaucucucagcuacugcauuucugcccagauccccacugggaaucccauuacugugugaacagacucuagacacagaaacauacauauuauaaacaaucagucaugaauuugaggaagacucaaaauaugauaagcagaggccaagacagagagcagaaaggaugcuggaggaaagugcgaugcauauggcugaagaaaauggaaauuaaaauguggucuugaaaaagauauaaagcauaaagcauagcuucugagaggaaagagaagcuaugguauccaggaaacaagaccaugaugcuauuuuuaaaauacauaacaagaaggggcucuuggaaauuaaaaacaaaaaacaaaaaaaaaacaguaacuaauuuaaaaauucaugagucuuacaauggagaaaauuuccaagagggggggaaaucagaaaaaauuuaggcaagaguacucaagaaaaaaauagacaauugaauuagaauccucaguguugaauuaauugaaaucccagagagaaagaaacagaggaaagaaaaaguugaaaagaauaacacuaaaaaauucugcagaauuaaggauauucagauugcaggggucagugaaugccccagacaaugaaugaaaagagccccacccagcacuugccaucaugaaacuucccagcaggaaggacucagaagccccugagccugcagaggaaaagcagauacuaugcagaagauugagccccacucuggauccgggugucucagcugaacaguuccaaacuaggagacaguggaguaauggcuuagcauuuugagggacaauucuuuucauccuagguuccuguaggcaucuauacugacuguccaguauaguagaauaaaaacauucuuacauuuugaaggucucaaaaaucuuccucauacgcaucuugugucagaaaguugcuggaaacugggaaccacuaagaugcagagaauuaaaaaaaaaaaaaaaaaaaaggcggggccgggcacaguggcucauaccuguaaucccagcaauucgggaggccgaggcgggugcaucacuggagcccaggaguucaagaccagucuggccaacauggcaaaaccccaucuccacugaaaauacaaaaauuagcccggcgugguggcagugccuguagucccagcuacucaggaggcugaggcaggagaaucacuggaacccgagaucgcgccacugcacuucagccugggcgacagagugagacucugucucaaaaaaaacaagcaacaacaacaaccaaaaaaaccccacacaaaacagguggaauauccauaaggaucagaacugaauagagggaaugggaauuuccaggaaaugcaauuaaagaaaaaagcuagaaaacaaaucaguuaucagguucagggaaaacaaaaagguaauuuagaaauuguaauuaugauauacauuauacaucucaggaggagaaaauuccugcugaagaaaacuuauauuuuucauaauuuugauaucuacuauaacuaaauauauauaacuaaauaguaaauauuaauuuaaaucuuuugcuauaauuuuuuggaaaauggagaggaaaaguaugagucugugcguguguguguguguguaugucucuguguguguguguguguguuuguguguaugugugugucuuaaagaaccaaauccucaucuucuggaguagaugccaauaccuaacauggaaaaaucaagaaacaguacaauaagcuucuuauuuagaaaaacggaauaaaugccaaaaaaaaaaugugaaaugcuuacugcuggagagggggugguggacaauaaauugcugguuuugacucaucuuuaugggguuauuuacuuucuguuauguccauguuuuauguaaaauauauuacagaauuuuagagguauaggaggugguuauaauauacuauaacagaaggaaagaaaaaaauauuuuuagaagaaaaaauagucuagaaaaacaugccaauuguuaguaguuugaguauuaauaaagugauuauguucuuccuuuuacauauauuuuuuaacuuuuuugcaauaaauguguacugcugauaaaaauuaaaaggagacuuuuuacacacacacacucucucucucucucucucccucucauugucucucucccccuuucucucucccauauacgugguacacauggugcaagcaugaguuaauaaaccagagagcaccaaggucagaguugaaguggcagaggcaggguguugcaggcaccauuccuaugaugagcccuuggaaggccaggaaguacuuggacuggagguacagacuuggcucugagcuacuagagagcaggacagcucuugucauaugauagucaccauguucauucuuuuuuuuuuuuuuuuuuuuuuuuuucugagacacagucuugcuacaucacccaggcuggagugcaguggcgugaucucggcucacugcaaccuccaccuccuggguucaagcgauucuccugccucagccuccugaguagcugagacuacaaguguccaccaccaugccuggcccauucuuugcacauacucugcacugcucuauacacaauguucuuuaaucaaugaauuuuaaucaaugagagugaacgaauaaaaacuuucgcccuaaugaggaggagaggagaguaggauuauguaguccuucagaaacaaagaaauggaaucagugaauucaauuuuacagacaaaacagauuucacauucagcaauuagaccugcccaguauucaugagcugccuuuagaagcugugugucuuucacuguugaaagcugugagcaggagcuggauuucugcugugguugggggcuaaugucccauacaccgaucuaauaacccauauacuaagaaacuucauugcgauucuggaucaagauguguccaccuguggaccauuagauagucuuggcugcagcugcucuggaacgugaacaugcagucagggaaacaaaccuaagucagagcagggugaggucugagcugcccccaucagcucuuccucugugugaucacaauucacggcagcccauccuguuccagaaggaauuguucuccuuacauuuaaugaaggacuaugggucucauucucuugugugacagggaaguuuaccaacucuccagacuugccuggagucccuagaaaauaugagcucccugcucauaggggucuuuggggugucuaugagcaacacugugccaccuccaggccacuccuuggacauccgcuggucucucgccucauggccuccccugccugugugggaggaccuggaaagggaacuggccaucuaacaacccuccuggagcaccaccuuccggugcaggucccugccccagcacaaucacccuaauacugccuucuuuguacuucauagguacaaaguacuuugauuguacuuuccuucuuuguacuucauagguaucucuugggucacagauugauuuacagaagaagaagcggcgagcgccagcucccccuccaccacagccaccaccaccgaguccccugauccccaaccgcacugaggauaaggaggagaacaggaagagcacgaugggugagugaggcucggccugccgucugcaugcggggaugcuugcucuguccuggaaugucagcucugaugugaacuccugcaguggccucauccauaaugacauuaacccaaaaaauauuaaugcuaaagaaagaagggcuggaaagaaauaauugcaaguucacuucauaucuuacuagcaguauuuggugggcauuaugugagcauuuaggaggcgggggacgguggaaggggagaaacggcugcaggagccgggagagggugaaaauggaaagccugugagugugagugugcgacgugugucucugauggcaaaaggagaaguuccuagggugacaucguggaaacugcuuugaaggacauuuggcauuucaaagagaucuuaggccacaggugauguauagacaaguugacaucagcucaguaauuuuuggaccauccuguuugaaauugaucuccacuuauauuaccugguacacauuuagcaaagacccugauuuucuuugagggaaagagagcccagaggaaagaagauggaauuauacuaucugugagcagaaagagaccuauuagaucaucauagcccaccccucgugcuacaggcgagguggagagaagcugaaugauggcgcuguccagguccaggggagucaaggguucauuuucuuuuuaaaucauucagcauuuguuauuucacuuauguuggaacagaaauggcucuuccauggagugguuggaaaauggcagccuaggagucacaccuuccugagcugagagccccaagaauggcgugugucagugcucacgacgaagccaccagcacucacaggccacucaccaugcccuuuaacccacccaggcagccccgcguuuugccuuugcccuaaggucugcagcugcaggagggaaaguccuucugagauaaguggcugccuuggcaguuucuggaccuuuagugagagcuccguggcaguuugucagcgucuuuccccuuagucaguuccucgcuuuuaauguguuagcauuucagccugggagucaguuaccuuaagaagcaauaaccuguauuccaugucagcucauccucuuucccaaaggacugaaagaaaacauuaucaguggaucauuaaaauaaaccugguuuucuccuguuucgugaagagccccccauucucccuuccaagcucucuccccauuuuucauaaauggacaaaagccccugguuuaaauuuuaaguggcauccacuguaaauggcuguaugugguuggaucgugccaaucccuaggccagucacuucaacccagggcaggacccccugauuccgcccuggaggccugaguccuugugucccaugugcuugggacaacauccccacccucucuacaacucaggacauucuucaaaacaaacuuggagaacuauuauucuaaacaaccaaagggguugaaaaguauaaauggacucaggagauaagcuaaaugaaugcuuaaucuagccagaauaggucaguggcucuagaaaagcaacaagaguaggcuaaaaacagaucugugaaccugaaaaagacuaacauuaauaaaaggaguuccuuuaaacuugacaaagcucugucgaggguguugaagaauaguuuucaagcccagcauuuauguaguugugucuguuaaaaagaaauugcaaccaggcacaucuuuccaaacugcuccaaugauagaacacuacguauguaaaauguuaaagugugagugugguuggaugugguuggugccagaugagaauggauuaggugcuggauaugacuggaucugguguuagguguggcuggaucugguguugaguguggcuggaucuggugcccagugagguuggauuuggugccuagugagugacggcuugguuuaaccugcugaaguaacucccuguugauuccauauaggugguggacggcaggugccacaaaagccucccagaggcacugcucgggguccaccccaguuagugcuucccccacccccgcccuacccuccucccgacacagacgugguggagccucucagcuuucccggggaaggcgcugguuccgaggccucagacccgauacccaaacguauguuccucuugcuucauuccgacuguguuaacuguucaucucucugagcacugcgaugucagggcuggguuuccagauuuuccauucuugucuuuggaugugugugccuuuccuucucagcucuuguuucccaaugcugaaugcagugugucugauuucacagagaacacacucuggagaauuuaaccagguaaucaugccuaucuguggucagacuucagcuaaacacacaccuugugguuguagagaugucagcuaggagccaguguucucauauuagaaugaaccucagagugucuguagagagagacagcuguccggcacagccgucgugugaucuggauggugggcuaacucaggcaggcugugggcacaccuguagagaucgcacucaagagcugggaggacguccuucguaaguuagcuguggaacucugucgccagcggccaagcaugagcacugcuucucuauggaaaaggaaacugagguguacgagaaggggaagcagcucacuuugaguguacuaauaagccagaauugaaguccugcuuugcuucuguuuccuggcacacccuguuugagauggggcucucuuuguuuccugggguucuuuuggacuuuaguaaguagagauagcauucccaccuccggacaggcauaguuuuauacacuuacucucuacacuccauggcauuaugggcacgucgggccugcgcuuggaccgcuucaguaugucucagcugggcggcgacacuucugauaaagcaagugccauccugggcuguguacacggagcagcgcaauaucacugugcaugcggccaggagcccugcuggugcccacaugagugugcacagcccucuaguuaggaaguucauacuuuucugccacuggacugcuuuaucuuuuucugucuucuuuggaaguguugacuagcugccugccagcuucuggguaaagaagauaauuguuggauuacuuauugacuuucucuaggcaaaauaauccugauucauuuuaucuuucuucacaaguacuucuuuuccacccuuaaaauacauuugaucaucuugacauuagacaugcuuccgaaugcaaaugaauuuuuuagggcauucaaaaaggaaggguuaggcuuaucaaucagaaagacugcagccguggcguggauggcuccagagccauuucaucucugaagacaguggguuuuaagccccacacaccaaggccaugagagucggugcucucuccuguggccgcugugcucaccuacagaauuuccuuccugcaggaaaaagugagggaaagauagcuggaugaaagcuauaaagccaaguacagccuguuggcagucacagaacgggcccagcaccaguggcucuguggcagccugcacaggaugggagagcugggugcaaacuugcagacccucgcuuucuccugggcucccuguguguugggggcacucacuguucaggugcagcaucugcuggggcaacgggcagacaagaugugggagggguacuuaccaaggcagcaucaggcuuccuccugcaucucugcagagcaguggaaccuccccaccugcugcccuuagaccuuuggacaggucugagccggaaggagagcgaaguggcggagagaaaaccagacucaccuucgucuugccuuguggcuccauuuccuccuugugcccucuugccaacuccauaccaguucauucccccagguacaggcaccugggacuuccuuugcccucagcgucauaauucaccuucucccucucuuccccucucaugcccacagcaauggaguugggggaagaggagguugggauggggaggccccaggagguguuagauggagugcacugauuucaacuccaccuccccuucagaccaggcaagcgccuugcccuucuugggacucagagucuccccucccucuccugccccgcuccugccccgcgcuccuggcugccagcgcaccacauguucaagcaucucggagcuuuuauguugcuaauuagcagaaccagccugcccauuguuuauggcuuuacaaacuaggauuccccgccuaagcaggcagaaugcaacuugccuucaggacuuaaaaaaguuaaggaaaaugaaucuuuucauuuguuguaucguuuuucauaauguugaaaucugggugcuccuuccacccauccccagugaggcacaggcuguuggcgccugagugcugggugugaaugugcgucccuguggcccauguucaccccugggcuccugagcaaacuuccggcuauuuuuggcuguguggaagcucaguggagacauuuuaaugccagcuacaagcacuugccuaucuccucuugaguucaguuuuaaaacuauguuccucacauaacaaacgcuguguuuauaggggagcuuacccugaguacauaugaggcccagccgguccaccaggcaucucacagaagcucucucacugcuucguaggguaugcacagacaccauggggaaaccgaggcaggaggccuuaccaccauaagcgguacagagggguuucucuuuaugggaucucggacucucaaucuuugcuucauccaucacccugcacuucucuucugccacugcaggaacucccaggggacacuguggcuuucacauccauugugauugcuacagcagaugguauacuccacuuagguuguuaaaaaggagaaauacacuuuuuugaaaaccaguguccacuaaccuaaauaagauuaaaagauucaaaaagcuaauggauaauggauuugugcgcagauuuaagagggugaggagaagacauaaauaaguccuauacaacuucacccuuuauuuuaucucuucaacucugagccauucuguuccagccauuccccugucuccucccugaccucuguaaggucuugacccacucauaggccugauggcuuugcuggggucccaguaggccuacugccagccucccuuccacagccagccuccugccagccugccuggaacucagcccaagcacaaagcccucacuccaauuuugaugcugaaacuguuauuaguacuugauauuuggucaugaaaaccacauuuaccuggaacaaaggccaaauggagaaaacugugugcucagauguucagugccauguauauguggggcuucugaacucuuuugaacaaauacaugguuuguaucaagaguucagaagagguggagcaaccaccuuccccggguguauguggcucuaagaggccaccucucggcagccggcucugcagcucacccagcccaugugcagauugcucugagcugcgugccugcucaagccacagcugcacagggcaaguucucugugcacacccuguggccaccucaggugccugucucuggcaagccucucacucccuccagugggaauuccucccacugcccucuaggcauuuauccuuuacuguacucacuauaccauauuacacacaccuguuaugugccuccucuacuaguuuaagcuauuaauacuuggaggcuuaacuguuuuauucauauuuauauccguccuucagauaggugccugacacauagcauaaauuuaauaaagaaauauaccagaauuuaucucaccaugugaauuacaaguaucaaauuauaguggaaugugcuauucuauucagcuucauuaaacauguuuuccaggcuaaagagcaucuaguacccagcauuuuaggucugucuguaggacaucccucaagagucaacagugcaucaaagaccuguugcaguuauacuugagaaagaugugaaaaucuccguggauuucagcauccagccuuggcaccuucucgagugguuucuuggucuggccuugcugcuggaugccuucaguuguguguuggccucucugaaguggcucucagugauccccaccuccuguguucacccccuagccucuuguagccucuugccacgaaugcugacuguacuuagugacuccuaucuaaggaauagaauauggcaaagguagugggaugucacuucuuacauccaagauuaggguugaaaaggacuguggucuccaucuugggcacccucgcucacuugcucacucugaggaaagccagccaccacgcugugagcugcucuacggagacccacauggcaaggagcugagggagacuucagccaacugccagcgaggcgcugaggcccuuuguccacugaucaugagccuagaaaccugccaacagccacuugagugaaguugggggcagauccuuccccaguagagccuacagaugagaccauaguccugauccacaccugcacuguagccuggugagaggccaugagucagaggcacccagcaaagccaugcuuagauucuagacucacagaaacuauggaauagucaaugcuuacuguuuuaagccucuacauuuuaggauaauuuguucugcagcaauagauaacuaaaacaaguuucaaguaagugaaacccaucucaaaccuacuucaacaguuagggaaugucuuaucucauggaacaggaaucccagaguggaguagcauucaguauuaguugaaucugaagcccaaguugucaucaaggaucuuaguucuuccuaauucuucucuguaucaucuuuggggucagcuucccccuaaggcugggagcaaugggucuguggcuguuccauguaucauauccagacacuagaauuuucauaagaggaagagagacuaucucuuuuaauaguuuuguaggagaaaggaaaccuuucccagaaagcccccacuaaagaguuccucucauauuucauugacuacaauugaguaauacacugacccaauucuuuggcaagaauggaaugaccuuagaugagccaggcccaucuggcagacggggauggggucagcuuucucugagguacguggaagucacuggucaauacuggaguucuguuaacuuggaaguaugggcaacauaugcuaugugaacagccagcagugcgcacuacacauggguugcagccuucaguuugauuuuagucuggagcauguaggaugugugaugaguagguacagagaggauggugaaucacuguugaagagcaagugggugauuuggcucaaaaacaguaaggccaagcaucugaaagucaaaagucaccaaggaaccauccuccuugagggacgauuucagugcagaacuggccacuucaaaucuagccuccaccuacacuucucauuuucugcuuuucuggagcagaggaacuauuagaaaugcuccuagcaguagaauaugccuauucagcguucaggaacuaaagcaucugcuuucuugauagucuuuguaguaagagguguguucaucacaugaaucugaagaauacuggaucucacuuaaaauuacuuccugcuguagaaagcauaaucuugucucuuccagaguuaguuuacaguggacaaagugcagccuuuuuaaaggcaacauagggcaagugugaagguguguguggccaaagaacaaacucgugcucccugcugucaccuuguauagaacugagauuucuguugccugauccaggcuguccaugucuuccuggcugucauggucaggacaacuugcagagucugaguugauaaauaucacacauauaggagaagggcuacuaagcuauguaaccucucaaagcugcaugucacaaagggcaucacuaguaggguuuugguguguguuugauguuucccagcaugguuuuaagaacaauggaagacuggcucccaggucuguggucuuuaaucauguuuuuucuuauuaauaagauuuugcauuaaacuucagauaucuaaucauguacacagaugcuuuaugugcaugucuaaaccaauacaguugugugcauacggauuuuucaucauaacuuucgaaucagcuugcuuucugccgccauuugauuucaguugaaccuucauugugaaucaccauaauggagccuauucccuuagugcauugaauuguuuauuuacaagauuugcagugcugauuauaauuagguuauuaacaaguuaugaauuaucuauuuuaauuagcagaccuuggagauuuaaagaucaaugcauauggagcucaaauuacagauccucaauuuacuuuacauuuuuaaaaugaaaauauucagugacugucauuuucuuacacauuuuucuacaccaggcuuaagcaaauaaaucuuuccuugggcauacauuuacaggguaauugacaaaagaucaaaaggcauaaagggaagauaggucauugucuccuguucuaagcaaccccccccaacaagggauacuauuucuagcuaauugauuuuaaauuugugaccaaguauccaauucuaaagaacuuuaaggaaauucuaaaacaaggaaauaaaaugagaggaaugaacuaucuauuuugaauuagaagagaguaucuugaguuugaucaaugcagaaauaauaauaauaaugauuuacauuuuaagcaagugaucgagcagaggaacugcgaauugcgaaucuagaaauacuuguggcacagcuugaaauauuugguggcuacaauccuaucucuacacuuggggaccagaugcucacuaagggcugcuggcucggugaacagccaugugcugcuugagcagagggcguggaacuggagaagguaggacgggaauuuggcugauggcccuuagguugggaccaguccucauuagaguccccuaaugccuuauucucaaauuugagcccaaacuaaguacuuuuccuauuucaaaacgaagcaguuaguucuaaagcuugugacacaaacacaguucugugaguccuguuuguugugggaaacacccaugaaacacuacagguguggagcucagagcaagcccugggaagcauucuugcccuuggcugguguuuauuugccacuuuccuucccuggcaggagagccagccacacagcuguuccugcugccacggggcaggcauggcauccaggaaaacaggaagugggucgugagcaaaugggccuuuucauaaaauggaaggaaaucgucaacugugggagcagaaucugucccuacucaaaaguacauuagaaaaaaacggaacugaacuuuuaaccuguuacuauuguaccuugaaaaccauuaagucaacccaacauagacugaagauuggauguagcuuagaagugaaguagugagaaucaaaauagaucuauauauagcuuuucaaaaaaaccuuaugagccuauuucuuuuugcuaauuacuucuuagucuuuuauuuacaagguacaaugucccuaacuugagagaauuaaagaacuuagugacaacucaguggaacagaacagcacuuugccagcucauaaaagcagaucguuaaaauuucaggaauuuugcaaaccaauggcugaacagauccacuauuaaaaaguaaauuauauagacauacaauuaaauaaauaauauuaaaaacagagguaacaaauacuaaaaacucaucacuuccuaauuauuuuaguacauuucauuacuauuucaguguucuugagguuguuuacauguaucggaucuguaggauuuaaugcuuuagaauaguaaaaauauaucauagugugcuacuacacaucucuucacagcaccgcauucagugacugaugucaauagcaggaaaucaaccaucaagaaacuauuuauagcauaggaauuagcaaauguuacaaaucagauauugauuggucuuguuaauugucuagauauaagacagugauugggaaauguaauaauacagauuaaauagaaaaguaugucauaucuguagccaauacauugugaauagcagaaaaaauugaguuguacauccauuuuccaaaaaccaugaucaauucagccaagucauucaugggauugacaaaugaguaaaauuccaacauauaucuuucugguuuuauucucaucuuacugucugaugccaucauguugaaguuauacuucuuuguuaacgguaauaauugacuggcuacagguuaaagaaucugggaaaaauuaaugaaagcauucuaugagaaucaacugguaauacagaauuuacaaaaaauaguauuaugcauuuuauuauuacuuauaaauuuugugcuacuuauccuuuauauaaguaaaacugauuauaacuauuuauaccuuuuuccuccaaagagcugguuacuaaccauuuaccaaaauaccacugcaaaguaguaacaaauaugaauagaaauggugaaaagaaguaauauuauuuaguuaagaaaccugagaacagauuucuuugauuuucaugagugcucaagcccuaagcugaugcaaauaaucacaacuguauuuuguuuccuugagcuuuaacuaguagcauguacucagguuacguauaaaaaccauguugaagaacuucucuuuggguuuauauaaauuugaguccuucccagaaauaaggcauaaacaucuugauuuuucaacaaugguuugaaguuguuauuaaauaucauuaccuucacgccuguaaucccagcacuuugggaggcugaggcggguggaucacgaggucaggagaucgagaccauccuggccaauauagugaaaccccaucucuacuaaaaauacaaaaauuagccaggcauggcggugcaugccuauaaucccagcuacucuggaggcaaaggcaggagaaucccuugaaucagggaguuggagguugcagugagccgagaucgcgccacagcacucuagccuggcaacagagcgagacucugucucaaaaaaaaaaaaaaaaaaaaaaaucauuaccuuguuuuacuaguuaagaaguaaauagagauuaugaaucaggcauucucuuaugacaauagucuucuaaacuguuugucucaggagguuuugggugcugaugugcacucaggcauggcccuucuuuauuuuaaucccuuucccccaaggccuucagagauuuaaagcuacucucauguaauagcccuuugcaccacaggucagucucccacuagagaaaacagcagcacucaagaggaguuugcuccacagguacuuggaguugauauccaucuccaacucaguaaaucaaccaguauucucuaaguuuauauguggggccugcccagugucaccauuaucaagaugggauacacugaaauugagggcaucacaaagccauauggucuguuuuccucuggaguucuacaaguaacuuagacuguuuuucaagagguaagaaauaaaugacuugccuaccagcugcuucgugucucggcuuguaaggaccuuagguuucauaccaaauccaaauaauuuuauguggcaaccugaaagaccaaccaugagggaagugaugcuuaugauaugguucuuacaggaggcagaaucauaucuguuggaucaauaggcccuuuccacagcuggcauacaaaaagacuaaauggaaaggaagaaaacaauaacaauaugcuuuggcugauagaacgcuugcuaugcaguguuaaaucuccaggggcuggaaaaugaaugauaauggcagauauuuauuucaccgcaagugugcguucacauuuugccauuuauuuuccccccgcaguuuauugcugugcgucauucccuacucaggccaagcgcuucugauggacgggccucuuccugaccucggaccuuucccagugucucuucugcccuggcucugauuuuccuguuguucuuccuccuuucaggauaaaagggcucauuguauacccagaauuuacuuccuuugggguuuacauauaaaugcauuaauaacagagauuuguuugauugagguuuauauuuuuuugaaggagguaaauuauaugcaaauuuuagguugauaauauucaccugucugaaauucacugauacuuggaaauguuccugugaagaacucugcuuuauuuuaauucauuauuaauucauguuuuucuuauuggauauucaguuccagaauuuauugccaauuuuucuuaaaacuagauuguauccauaaauugaccaguauagucaauuuggauagaacugaaacuuucugucuaccugguaaaacuaagugccuaaaaacaugaacuauaaauguaguuacuaggaacucacaacuuauauauacuauccauucaaugauacauaggacccaaugucuuuguguuuuugagguuuuccuguuacuguguacuuugccauuuuacauaguucacuaaaaagaaagaagugggagaagaaggguguucuauucauuauucuauauuaugauucucuucauuauucuguucucuucauuauucuauucauuucuucacccauuuauucacuaaacagugacauaguacuuacuugaugcuagguauuacaccaguuuugugggcuauaagagugaauaacaagcacgugaccucuggccuuggauuuuacuaccuguggcuccccaggcacaugaaaagaaguaaagaugguuccauuugauaaguacuagucacaaggguuguacaugugauaaagaugccagagguugugaccaccaugucugugcagaggugcugcuggcuccucuuugagugugagaucccucugcagucacacaaccucacccaguuacgaagagcuagucaccucaacugcauugucccaagacaggcagaguagguaaaaauagucauauguuaaaauucaagguuuagauaaaaagacaacuaguucuugcuugcuuugauuaacuuuuauuaugcagaugcauuugaacuggagaagcuugucauguuucucucuaaaagauguuuuuaaauguuauugcucaaaauggaaaaaaaaaaaaagaaucaguaaguauuccugacauguaggauuguugccuggcugaucacaaugaaaauguuagcuaugacuaaugaaggaauuaucacaacuuacauugguauuaauaauaaacaaauauaagccaaagcuauauauaaccaauuuagugcuauguauuggugaaaaaaacagaaaguuacagaaauuacucacaaugaaacauagaacaaguuagaaagggccuuuuuuuuuuuugaaauaaaggacuuuugucugauaaguagcagucauuugaccucaaaucauuaaauggggaaagucuaaacaagaaaagguaauguuuaccugaauguuggggaaagcauuaggauuuauggcccagacuuaaagauuguagaagauuguauauaauuacagcaauaagcauuuguguaagaaguagcuauuaugcugaagaaagaugggcacacaaaaucucuaggcaaauccuuggaacaggggaaagugauacugcucauagaauuauugguucgagaggcagcaaauaugaugcaauaaguauaucaaacucaauuaaaaauagaggacagagguauguggugggggaaaacaaaugcaauagggcuaagucagcuuacagggggugaauauaauuugaacauggcacccccaauuuacuugaucauaaaguuagccaaagacaugaguggucgaucuuugacaauacucuagugaucuccaugagagauggccugauagauguuggauagaaugaagggccauuugaugaacaaguuuuguagauuuacaugugacuuggcacugugcugacauuagagccuucuaagaaucagauaaauuaauuaggugaaacauuuuuucccaaagcacuugcauuucagaaaguuucucauuucugacucagcuuagaacccaucccuuguuacaggucauuucuccuccuuauaagccaugucuguuucuuuuuuccaucaugucauacacccuauccacaaaagaugguagcucacguuuucuaacuagagacgugcaggcaaguugagagcaugaagaaucccuugggaauaccaauucuguagcaaaugcuaagguaaaagaaaaacuaugcauuauuuuucaacuauaguuggcuuaaauucuuaguuucacccuggagaccauguugccaguggacaauugagcaugcugugauuuauaaaaugcaagcuaguuuauaugauaauguuugccaucucacuuuaccaguacuguugaccuuuucauaugauucuaaaaucacuuacuuguaaauaaauacuccuaguucuguagaugaaacaauuuggaaaagucguuacuguuuacucacugacauuuuauuuuagcacccauuauaaucagucacacaucgcaucuguguuugugaugcuuaucaacuguuaauuuucacaguuuucaugcuaauuuggauccauaaaaugauacaguuuguucacaacuuccauagcucauguaauguaauucaaaacguuuccacgugcagacuaacauuucccauaacaaaacaaacuuuucuaccauagggauaagagugcaucuuccaaaaauuacaagagaaagugagggccuuucaaacaaguauucaagaugucuugagucaucauaaccaauuacagauuauccagacccagaaauuaauccacauacagagcacuugcuuccucuggcuucucggaauuuuguguguguguguguguguguguguguguguguuuuaacuguuucauccuucauacccaaggaauguggagcaggagaaaaacccaaaauagcuuuugcaccuuauuagucaccaugguaaaaugacaacaagcaaacuucaaacacuucagugaagacagagguucaaguauuaaauaaaaugaggcucaggaguuaucuguauauuuuugguuucuuugcuuuauuugucaccaauagcaacgcauaauugguaacccuuuugccgaauaacucccuuugcuggaaguuuugugauuuaaauuuacuguuacuucuguguugauuuuacccuuaaaggcuuuauguuauaacccuucuuuuuccuucuuauuaagaaaauaacaaacuuuuauuacgugaacgaagcugcauaaaauaaggcucugaguauauuuuucaguaaagggaaaaagaaacccccccaaaagagauuagaucuauugagauuauuuagacuggacacacuguuuccugguugauaaaucugcuacagggcuucagggcaggaagugaggagaaaaaauaaccaaaacauaaaacccaaacgcaaauggaauagucaguaucuaucauacuuucuucuuuggcccauaagggacaagauuuaaagaguggaugcauccuuuccuuguauguuuugugugaauaagaagugguagggaggaauauaaagacauccugaaucacacaaaucaucaaccacaggauggaaauggauggcagauugccaugucuagcccacacacacauccucucugccagguaaaguugccaauauuaaaagucagauuuggcuugaaauucugguucuuccuggaauguguaaagagccuucccaaagggcucacauccuucaaguaagccuugagcauagcuuggcagcaggugcucccugagcacaggccggcacuugccaugcacugcggagcccaccaaucccacagcuaacacccaggcuaagaauccaguauuuucaggcucauguuuuuccaaaaagaaauuuaaagggaaagugauuauguccuauagucaggagccugagaggaccagagaggcagaugcagcacaaacuuacagaguugcuguuccaacaagagaaguguaguuggugguggaaguaagcauauuuguaucucuggccuguuucugccucaucccugcgcccuucgcuuggcccuucucucucaaucauuucucucuccuaccuggucucucauaugggcaaaccccgaaucugcacccacagugguguauuggcagagcugugcagggaaugccccagaaggcaaauuaccuuucaugucugcuggcuccauucugccccuuuacauugucauugucauauuagugaggauugggugcgaucaggccgagggcaacguuuugaugagcuggaacugucacucacugcacaaguggccuacauuuggagucuucaggcuccauagcagaaaccuuagaugugaagagugaguuacuuaaguucaauaaauauaaaauaauaguaaaugguuauaaauugagacguuuagcuucuaguaggaaaacuacaagucuccauuuaauauugcaaagugaaguguaggaagaacauugauggggauuucuggguuuuaugcuauuuuuuauauuucacagcuuuauaggaguguaauugacacacaaaaaacugcauauguacaaagaaaguauauaauauaaucaguuucgacucuuguauacaccaugaaaccaucacucaccaucgaguaauaaacauccaucacccucaaguuuccuugcaucccuuagucaucauuuuuaaucugcguauguguauguauauguguauauguacauaagacaugcacacaacuauauauauuacuuuaugacaguacuguacaucgaaugggaaaguuagcaaaauauagguuuuaauaacaaauccuaaauuaauugagaaguaaaacuucauucuagcuaauugggaaauuguuuaaaaggagaacauuaaguguuaaaauugaugacccuaaugauaaagcgaguauuugaucugaggagaaagaaagcuggucgcagcauuuuaauagucaucugaaugcauccuuugugaagugaaaauguggggaugugagugcacauacaaccuuuggaacuauuucuccccuauccaaguuuucaagaggaaacaaagguaauuucuccacuuaauuuucuucugcuaaagaagcaugaguguguucuuuaaaccauguuuaccaaaaguagcugagaggaggucagcccaccgccucugccgcucaagccuggcuugagaaccgcugaccaggauugcuggcucuagucaggagcccagcugccaggcuggggcuaggcagcggcaggcaccagggcagcaucugucuugggcuccacugcaguggccagcugcccacugacccucacuccgucucugccagguuagcaagcagucgaaggggcugcuuauuuaagagacaagagauucuuggaugacuuuacccgcacauuucagccaccagggggaacccugauuaucccauugauagacagaguugaagagaauggaaagaaacauacaagaaguuaacauuggggcuuugcugcauuuaugccaauauuauguugcagcuagucacacaacaauuuagugacuguaauuauaggauugaguucucucauuuacaaagaggggaaagugagucaagaagagucuaguaacuugccuaagaucaugcagcuaagaagggucugugcucagauggcugacuccccauccucuguuacagugugacuagugguucuaaaaagggauguguguguauguguauacaugcacacauacaugugcauacaugcaugugcacccauggugcaugcauaucuagacucauguacaugugcauagauguauauacagugcauguaugcauacccacacaauacaugugcacauuguguaucuuaaacaucuaugcauacauacacaaguguguacaaaauauuuguguauauauacacaugcauacauauaugccuacacaugguguacauauucauguuuguauauauucaugcauacaugcacaucuauauacauuuguaacuugugugcaaauauacauaacacgugcgugcacucauacauccauguguauacacugugugugugugccugcacgugugugaagauaugaggccaaggacaguauguggcuauauuagcuuguugcugccaguaugcuuccccacccccacgccaccccacacacaauauaucucugagccuggugcuucggucacuggcaggcuuugcaaggauucugaacuuguccacuuuggccucccagaaguuauugucaggccucuuguuuggugccuaauuuaugacuuggaagagauuuaaagauuaaagagaauauggccaguuaguuguuuaaaugaauagucuuccauaguuagauagggcagaaauccaaaucaaccauguuaguaaacucaaaccucaucuuucgucucugcccuugcacuuaugucugccuccaucuggcuauuuauuagccaggaggcaccuugccaugaaggagguggccucugcuugagugcagacugcacagugggacuacaggaagguacagcccauggaggggugggggucuuagucuucauagauucgcugccagcggggucggggcaggaagugaugauggcuaaaguggcacccccuucccaugcacuuuuccuggaguaacccuuaaaucuauaccacagcccuaugaggucacugcuguuguuaucauccucauuuuacaaauaagaaaacagcacguagaugauaagaaacuugucugcaaccaaaagcaaguuaauauuuaagccaggacuugaaccuugccagucuggucccaagcaccugcuuaacuuccauaucccuccucccuacucuguguccuguuagucuguagggagggcuacaaggcucuaacccugcucauaucuccccaggaagccauucccuguguccacagaggaaggagaaaguggaggagguggugcgugcuguuugagcuuuaugggaggaucucucaugugcaagcccaccuaagcccacagccaacaacaaguauggggcugcacaaaaauaccaggaaggaggggcuugacuccagaggaaggaagaucagaggacaccacagagacugagacagucaccaugugugggccugucaagccacagacacugucguggacuucaauuacuuuaauauuuucaucacagugcgcagcaacacagugcacugauauguuagucugcuagggcugccaugauaucauaccacagaauggguggaaauuuauucucucacuguccuggaggcuggaaguccgagaucaaagugucggcaggguugguuucuccugaggccucuuuccuuggcuugcagauggcugccuuaucccugggucuucccuuguugugugucuguguccuaacauucucuuauaaggacaccaguccuguuggaugaggccuccacccgaauggcuucauuuuaacuuaaacaucguuuaaaagaccuuauccuaauaauguuacauucugaaguacuggagguuccgacuucaacauauaaauuuuuagggaacacaguucagcccauagcaccuggugugcauuagccugugugcugaugacgacagaggcuggagagcuucuguuguacccagguggaugcacaggggagacccggacucugacuccagggcuuggcccuguuggaggccugggcccugccaccuuucuggcaagcugugcugauuuugcccaaagcuggcuguagcccacccuagcccaacacuguaugugaaccaccauuccugcgugcauucggccucugcccugacuuugaauuuccuccuugccccuacaguuuauggagcagcugaagcugugauaagacuucugagcuugcuucugaauaccacagccccgggcacagcaaagccaagaacccuguggaugagugagggccgcaguucucuacacaauccugaaaucaaguguuccuguuucucuuccuccuccccauuuccccagucacugcucagccuucucuugggucuuucaagcauuugugaaugcaugugcacacuuagacacacacacgcacacacacacaacccaucuugugucuuaccuaccucugaaauauuggcauuugggagacaaucccuaaucagcuaacacuuguuuuuuucuauccucugugugcuuguuagaauacugugaagguguuuucuauggaccgacuucuaaauguuccuccugaaaucaguguuauucacacaguucuaauguaaugaauucugucugucugaaagcuugccauauugucccugguuucucccagcuaauagagaggaaaaugagccugaauaugaacccgucaccacagaccgcacugcauccuuuccaggcagcagggcccuggagacugugcucaggccuggcagccucuguguuucacuuaggcuuguuuugcucaacccaggcaagacuuuuaaaauuguuugaauaagcugcagcaucaguaugcuuuuuuaaauugugauuuaaaaaaaaauauaaaaugucccauuccuuccauuuucaaaugcauacuucaguagauuuaaguauauucacaaugcugugaaaccgaucuccaggaccucaucguccugcaaaucugauacucuacucacugaacagcaacuccccuuugccugcuugucuuuuugcgccuggcuuauuucacuuagcacaauuuccucgaaguuuauccauauuguagcauauaacagaauucccuucccuuuuaaagcuaaauaucuuucaaguauauguauagaccacauuuucuuuauccauccauugucaguggacauuuaaguuguucccgcuucaugguuauugugaaugaugcugcacagguaugcaaauaucugagacucugcuuucauuucuuggggauauauaccuagaagugggauugcuggugaauccagcauaucuuugccugaaaaaaaaaaaaaagccacucaagcugaguuaaugcacagggauauauaugggauccuauacugcaccuauagggguugugucagcucacuuaccccacaucagccacaugcgaguuccugaaccaaucacaguagccaagggagugccacacacccauuggcuuaggccagaaugcacugaucaauugucagggagaacaggauuacuguguuugauuggauaaucaggguucaucucccagacaaccagguugcuccacaaaggggauggggcagaaagggugcugagggucuugcacuguccagagaaguacauagcauggggcuagagccaggcugcauggacucaggguuugggucuguuacugggugauuucaggcaacuugcuuaacuucucugugccugaguuucuucauauugaaagaaaaagugcuuuugagaauuacacauacaaauacauguagaacauuuagaaauguuucgggggcugcuggguuggagucaacagauccuaauuauuaugaaaauagccauaauuuaaaaugcagaagaucgugcauuaaaaucuugauuucuucuuuuuaaaaaaaguuagagauaaggcaacaccaguuuuacugcaugaaaggaagugugggaugcauacuagcugcuucuugcaggcacauguaggcaccagguuuccucagggucuucguggggccacaccuggcccucagccugccuccuacugcugucugcagaccucuguagauggaucagugcagguucccugauucagucauacuggagaaaugaagucacucaaacccucauuuuuaaaaagucagaaauauaaagauuauguugucaaauacugcacaacccuuaaagaaaauguuaggccgggcacaguggcucacgccuguaaucccagcacuuugggaggccgaggcaggcggaucaccugaggucaggaguucgaagccagccuggccaauauggcaaaaccccaucucuacugaaaauacaaaaauuagccgggcgcgguggugggugccuguaaucccagcuacucaggaggcugaggcaggagaauugcuugaacccgggagguggagguugcagugcgccaagaucacgccauuguacuccagccuaggugacagagugagacuucaucuaaaaaaaaaaaaaaagagagagaaaauguuuaauuuucuacuucauacagucacacaagugauguagagcaauuucugucuuccuuuuucuuaggaaguuuaauaacugugcguauugccuuugacagagugcugaaggugugcccccuacagcuuauaaaaaugaagugccugcccugcagugcagagcgucucacuguuuugggggcugcuggguuggaguccugagcaaaugcaugucaaggacucaggacuucaccgugguugcuccugugugugccccagcgcucuccacgggugucucacagccucuuccaggacagcugagccgggaccagcagccuugcucaugccacccccugcagacgcagucccuggugcuggcaggcacgacuccugggauggcaggcugagagcuuccucagauggcacauugagccaugccccuggcugacaagggaaagaucauuuucuccuccagccccugcagaucagcaagcgcccacguuuccaugcaaugaugaaacacacaaguaaauaagccaugauguugucugggaaugcuucagccaguguggcuggucuuaaacuggucuaguuuaguugagacacuuggaguggccacuuguuggccacuucagagaaaccagcaguguuaauuggaagccucucuccaagucucagcaggccagccgagcgccgggacaccauggcucugacuuaagccuuugcccugaagucaugcugugacucaggggcugacccagagcuugggauuauggaggcuuuggagaagcagcugcaccuucaagcaaguuuccuuggauguaucuccugccaccucucacagacgcaaauuaaagagagagagagagagagagagagacaugaacuguuguuacugcagcaaacauccacacuguaucugcugucaggguugcauccugggaaagcuaauuuuguagacuuaaaguaaugaauaauuagaccauugcuaaauguauguuuuauuuucugaacaaauucaaagcauuagaaagauaaugaagauuuucuuaaaauuaggccuauuuuaacccucccuacuguuuagcccuaauggaauauuuauuccaaaaucucuauuagucaggcuucuccagagauacagaacaauaggauauauuuaugaguguguguguguguguguguguguguguguguaucuaugguggggagagauuuuuuuuuauagggauggccuuguguaauuauagaaaccaagaaguuugaccauuugccaucuguaagcuggagaccccggaaagcuggugaugagauucuauccaagucucaaggccccacaaccuggagcucugaugcucaagcacaggagaagaugggugucccagcucaaacacagagaacacauucacccuucccugccuuuuuguucuguucagacccucagcagauaggaugccugcccacagcgguaagggcacaucuuccuuacugucugucaauucagaugcugaucacucugguaaacagccucacagacacacccagaaauaacguuucaccacguacccgaacaccccuugcuuagccauugcaaauucaccccuugccaacucgcccccuauaugcaugucuuuuucuccagagaaagacaaaacaaggucacaauuccaacuggcaugacacugcuguccuguauacaaccgaaaaugcacucaucccuuccagaagagaagguaaaguccuugaguugauguuuacucucuccugauauccuguaacuuaaaauacuaugauguaaaauuaucaacaauuagacacugcuauggaagucgcguaugucccauguuaagggaauaaggggaaagaaaacaaagauauuuauauguauauauacauauauacacacacacacacacaaacauauucuuaacaaaaugagaaggaaauacucauugacaauuacuguuuucauuucuaaaacuagucacaucacagcugguauuuauaaugucuucuacccauucuguauuccccuugccuucagcaagcaccucagcugguugugguucuuuaccugguggugugaugcaaaccaucauuccugaagggucugggccauuagugguacuaccuggauugggucaggguaguuuucauugaccuucaucgcagggcuuacuaagggaaguccuaagggaucuccuacaucccauacuguuccuuaccuccauucuagagcaguagucuauuuuccccuggauagucugggucagucacccagccaacaccauaaaccccuucuucgccuguugacucaaaagccugaggagcccagacugaccauguggcaucuuaacuuccaguucgguggaaucauuguugugcccccugguggaauaauuuguuucucuggaccuaagacccaucggccaauagaacauaaaagucaugaggaaaacguuuugcuagugggucacuagggauaaugauggugccacucccuuuuuaaccucuugauuccuggacccuaugggagaaacagcaccauauauuggacaucauucagagcauacacagccuucuggagaacaucacccgagcccucuaagguacugcuaccucucugacccuguaacugaguuuucaaaaggccacucuacuguucuaucaaaccagcugcuucaagguaguggggaacuugguaagaccagugaguuccaugcacaggcucauugcugcacuccuuuggcugggaagcgaguuccuugaucagaagcaaugcucucuggaauaccaugacaauggauaaggccuacuguaagucaagcuacugauaguaguuuuggcagaacuuacauucuguaagcuacugauggagaagcaagugggaaacuuuucuucccaagaaguaguuuccugcagagauugcuuugauaacugugaagaaaaugcaaccuguuaagaccuuucauugugagaucugggcugguguucaugugcucagagaccuguggaguguuggaaaacaccuggaggaggcacugcugucagacagccagggugaagcgugugcacugaagacgagaucagaucgacucauggaggcauccggcagagcuuacggcaggacccaugaugaagggagggccuguggaggguuuauucaagacaaaucaggagcagaugucuccauuucaauccuacacaggcauggaggaccacaugcucccugugaggggugagaugaggauugaacaguuagcaaaaaacaggccacguuggguaaugcuaagaaguagaaaaacuucagaucccacugggacuagagaauagcacauagaaggcaaucaucuuggcuguauuucuggguggaguuagugcaaacagcaggaugagggaacaguggcgggguagcugggagacagugcccucaccaacuccucccugccuggcucggacucauuuaugcgaacagggccagcccucacccucccacccaccccuaccugaccaggcuuguuugaucuacaaacaaucccaaggcuuccugggacucccuccuagaaacccauguguuucaggcccccccuucucccuguucucucccauuccugggaaaguuccccaaagccuuaagauugcaguuucugcagcccccacauaaucacauuuguucuuuaauuuccagucuuucuaaagaucaugaccacuaaugaaugauuauacaguaaguccucacuuaccaucaucaauagguuagguuuuuggaaaccgcagcuuuaugcagaacaauagauaaugaaagcaguuuuaccauaggccaacugauaaaaaugaguuaaguuccuagcauauauuucuggucaccaaaacaucgaaauaaagaccaaaacacuucuaaauaaagaccaaacacuacuaauauuaaacauugaaauaaauacgagcuauacauacauuuaagaaagauuaauaaaagcaaguaaugugaugauuuacccaguuuuuccaguucagggucacagguggccgcagccuaccguggcagcacagggggcaagguagaagccagcccuggacuggcccccaucccauugcaggugcacuuauacucacccacauggggacaauucggacaccccagugacccuaacaugugcagucuggggacaugggaggacaugagcgcagccagagaaaacccaugcagaccugccgagaagguguaaucugcacagacaguagccccggccugggauaauaagaugacgcugaacgaaagucguuggaggaccugccauuaucagccuguaggcugaaaacagaugggaaucucagcaaucagacucgcucuaacagcccacgcucagaggcuccggcuguccaugcucugucaggcuuucccugccucaucacgccucuccaugaagcuccugagugaaugaauacuguuauucuuauccccguuuuacagaugagaagccauagccuguaagcacugauuugcuggaggccacaguugaauccgcacagugucauguaauuguuuugggggguuguguuguuguuguuguuguuguuguuguuguuguuuugagacauggucuugcucugucacccagguuggagugcauuagugcaaucauaguucacugcagccucgauuucccaggcucaagcaguccuccugccucagccucccaaguagcuaggacuacaagaacgcucuaccaugccuggauaauuuuuaaaacuuuuuguagagacagacagggucucgcuuuguugcugaggcuggucucacauuccugggcucaagugauccucccaccucggccucccaaagugcugggauuacagaugcgagucacgguacccauaauuguuuaaauugacacaaaagauggagaaaaaugugucuuuaaucuguugaguacaaagugcauacauaaacauagaagggcaauguaucugauuuucuucaaacauuuaagaaauuuuguuacguuuauccaaaaagcuucuaaaaaaaaaagauuaccaaaaaaagcaaccuaauguaaaccaugguuaucuuggggauaagugauuauuuucuuuccaaauguuuguguuuuccuuacuuucuauaugaaagaaaaagaaaacaaacuucauuuuaaaaacuaaaauaauccuaauuuaaaaacucugguagaauguggucauaggaggguauccguaauaagaggaauggaagaggugagguguggccaucuauccuuucagggcauggaggggaaaauggggucccugccucgcaaggggacagcauccaacuuccagucccugggacagacccugaaacccuaaggcuggagccccagcaucucauguagguuauuuugaguguugguggguuuugcugaggugaguguuuucuggccaauaaagccaaguuauuuugggccaccauaauugugaguuagacaggugguuugugugugaaacauuuaauuugcuggcuguguagucuguugacuuuggauaaggcuagaaacaauucuauacuaguuucccaaaaugaugggcccugaugcugaucuuaucacuguuacaagcagacgcacagugccaaggcaggcuggacuacgggaggggagcucuagagaaaaaucuuguuacuauucauugcuuuuaugcugacuacucuacuguauuugaguaccuuuuaaguauaguaguccccugcuuauucacagggggauauguuucaggaccuuccauggaugccugaaaccucagcacugaauauauguguguguguguguguguaugugugugcgugcacgcauauauauauacuguuuuuuuccuaugcauacauaccugugauaaaguuuaauuucugcauuaggcacagugagcaacaaugacuagcaaugaaauaggacaauuauaacaauaugccaacaucaguacucuugugcuuugggccauuauuaaguacaguaagggccccugaacacaaucucugcaaccuugagacaguccgucugagaaccaagaccacugcuaagugacucacaggcaggggaggagacaguguggauccacuggaaaaagggaagauucccauucauggugggacaggacaggauggcagauuucaccaggcuacucagaaggacacgugauucaaaacugaccaaguguuuauuucugcaauuguucauuuaauaucuugguugaucacaaguaacaaacugcagaaagcaaaaccuccaacaaggagggacuacuaugaugguuuuugccguguguguguguguguguguguguguguguguguguguugggagagcacuguauacaagcauaguuauuagucauuucgcuuuucuccacucacuuuuaaugguauguuagcauugugugauuucuaaaaauacucagaagagaacucaucuuggaacaagccccgauuagaguaucuuuucaauauuaaaagauauguuuuauuccuuaguccagaaccagguaacaguuuaaauuagucaucuucacagucuuugcuauuuaaucugacccaaacuucaggcaauugauacaaauaacuaauaaggcaaaaauaacccagcuggccaggaaacugaugcccugagguugcagauggaggcacugaugcagagacaccagacaggucauccuuggagacucagguuucaaugcugccauugaugagggcucauuucccccggugacgauacaggcaccucucacuagccuuuugacagccuuuugacaccugggauguagaggcucuuugcugccucuccucuguuuucuccagcaucucggggucccauuugcucacacucaggcugugccaccccuacccugcucagcucuccucccccugcucuuccucaugcccccacuucaucaugcacccccccauauuguuucuuugcucuuuguuuuugacguaguuuacaaacauuuggaauguguuuuauuuuuguaaguaauuuccucauucugucuuucugaaacuauucuauuauaguuuccgcaaguaauuauuucagcucuacuucugucugaagaaaaaugacauuuguaacuuuguugagggcauuuugggacaaguucccaugaaacaggagacaugugaagagcacugagaugggaaauggaaucugcuaauuuuagaaaaaggcaaauacuccugccuuuugagagcagggacugaaugugacuuuuuaaaacuggucguccguuaacuccagcgccuguuguuggagacagcugucuuugaacuauugcagggaauagguuucaguaagaugacaacagaaagcuacauggggauacaaagcuuaaauguaggugguucucaccugcagcccagugaggggagaaagccggcuggccaggaacucugggggagguacgaaggaagcccucccaugugucgcccaggccggccggccggcagcagcaacaccugggaacaugcaccccugggcccaccccagccccacugaaucagaaacucauggggguauggggucuggacaaucucuauuuuaacaagcccuccagggcguucugacacgggccaagugcaagaccaucaucuucucagagaacuuaggauguuuauggacagccaggcagcuaggcccagcgccugugauaauuuuagcuaccauuacugagcauugacccugugcccugcuagcuccuucauaagugcugucucguuuaaucuucacuaaguccuuagagagaggaauucggccuuguggaugaggacguuaagagaugaguuugaguuucccgcagcccuugaggggcugagcgccaagcuggaaggacaugcuauuagugcaacaggaaagaguggcaguagcgugggcuuugcgaguccaggaaggaugcgcgcuggggccccuggagacaccaaccucauggaggagggagggccugagccgcccuugcgggaagauaaggacuuucaagaggaaagagaaggacuuguucugagaacuccggcuggggaugcgugcaguagccaacccuggggucauaucugcaaguccucuucucucugaaccugcucccuuggcuccuaaaaggcacccccugucuccuggcuccccaucuguccccucaacucuccaggcugcuccagggaagaaagguuuggauccuggauagcggaccaccuucucugcugaaacgaggaaggcuguggaaaggaaacgauguuuuacauugaaagcaaguuccguuuucuuauauuuccagccauaucaugggugaugugccccgaaaaccccuccugcuaccaagcaucuugaaaggcuggguuuucugucguggacaucauuguaaaugcguagccaagcuuuguguugcacagaaaaugagaaggaaaucauaaaacagaagcgugagggagagcugagaugcugggggcuucugaggaggcuggggcuggucuuagucaucuggggccucccuuagggguuccgagggccccuggccaagcggcagagaggaacggggcccacagcaguccccagugcagggagaugccauggagaaaaaacaucagaaagucacuccucuccaggccaggcagucagaaaggaaaaaaaguuacaguagcuucaguucaccugaaacauggccaucucccaacaagcccagcacacauacgaggaaggcccaugaagaguccuucaccuucaaggagcgugaagaggccugcacagcaaaacgggaacuguggggccaacccaguggaaaucucacaaacucaguagauuuuauagauggcaaaauuuaaaaagccguccauaaggaaauaaaagaacuggccaagaaagaaguuuguaauuuaugugaaaagaaaaaaaaagcgaaaaguuuccuuuuuauguguucuuuguuuguuuguuuguuugauugauugagacagagucucacucuguccccuaggcuggagugcaguugcagcacgaucccagcucacugcaaccucugucuccuggguucaagcaauucuucugccucagccucccgaguagcugggauuacaggcacacaccaccacuuccagcuaauuuuuauauuuuuuguaaagacaggguuucaccauguuggccaggcuggucucgaaauccugaccucaagucauccacccaccucggccucccaaagugcugggauuacaggcguaagccacugcgcccagcccuuuuuauguuguaauuuuucuuuaaaacagcuaauaaaauguugcauugcagaggaacagugacaauuuugucuguuaccaccaaccuccacuuuuagguacaagggaaggaggagcagagacacaaagacgagaagcuaagauuggccgggcccggccgaggggcccugugccagguggggaggcaccucucaggggcaggcgaggcacagggacgggcgcuugggaugacugacauuacaggguggcauuacagcacacccggacaucuucucugaguuauagaaagugaccuguaauauugucuguucuucagcaugcaagagacgaggcucagauaucuggauucuuagcuuuugucaaagaaugcucuuuucuguuauugcacacuaaacguugauuauauuauugagaauuuacauugcacagugugccagcuugaggaggccuuccugacugggugagaugcccugaacuccaagugcccauuugaacggggucagccugggucccugagggcagcacagggcagggcacacagcuugcccagaagaugccaucugccugucaggcaagaggauggucugacuccuuuccucucuuaucauccguagagaucuauuuuauuucuuauuuaaaucacagugaauuucaaaggggauuguaggcagcuuuuugugucaguauuauucaaauuagaaaagucuagaaaaaggaauaauuuuuauuuuaaaugauuggaaauaaaaauauguuaauuaaugcuauuuuugaaaucuacauuuuccuuaagugguuagaaguaaacacuaggagagcucagaaauauaugugcugggaagggagagggagaaggaaaugcaguuaaaggcagccacaaaggcacagcucgguccugccuucuugggaaacaaggccaaagggaucagagaggaugcugugucaaacagcacucauuuauuuaauaauuuggucauuuuuauaucaaauuuacauccagagugauagaugaacaguguguuauggaaagcuaaguaaaaguaggccacauacuuuauucucuagaguucugaugauaaaaggauagaaguuggaagaaagcagcagaaggagggauggcauuuuucuuagguugcccaucucagaugguggcugccucaccuuugcuucauaauagacccaaagcauagucaauuugagauugagucccuuggcaccuuggcaggucccugaaccucucuuucugaggcauugauuaaauaaaauuuauguguuuuaauagauagacaaccuggagacagaguuucuauuuugacaaugaaaacuaagacaccagcuuuguucuugccagcagggauggccauccacugccccacacuucccucaaaggugaggccccagaaauguguaaaaaaggacugaagguuuuugccucaagaaaugguuucaaauauguugagauucccagauaaauggauccaagauuuguuccauagaacauggaagaaaaucuuuuggcuuagaaaagucuaaaugcagauauacucaguaggauucauguaacacguugguuaaagaaccuuaauuugacuccugcccaccauguggguuuuuuaugagguuugaaugaacuugcccuuuuuauaagcugagcagaguguuucugcaacacacacccucagggauaggugacauaauuuguugguuggggcuucuuguauaauuugcaaaauaggaauaauaauaauauccacacuacagggggcauguggacuaaauaaggagguagguaaauauuauccauuugaacacugcagaaugucaaaacccaauuaccguuaugugguuugcaaauaucaguguugagcuguacugucugauaguaaauuagccaauaguguaauacuuuagacuacucuuaaagcccaugacaguggcauagagaaggaauccuguuuaacuauuggcuuaaaaacaacaacaacaaaaagcacauuacaauaaaaugaaacuucaguuucaggguagcugaacugauucuaagcaucaucagccaaagccagcauuguggcuacagagaaaaacuggccacccuauccagauggaauccuugccccggaaugcaagcguccgucucugucccuguggaacuucacuuaguccaguccugguucaugcaccgcacccaugacuguuguugauaggcuuucugauccauaguaaggaaacaggaauauucacgugcggcaaagaaauucacuccguaccaucgcugauacccccauuuaaacacaggaaagacagccaagaguugguagacaauuuuguuuuuaaugcaugaaagaaggacaacaaaguggucagagaaauuuacuccaaaggaaguagaguuaaguuaggaaauagaacagaacuuuaaaauaaauacuuuuagucauugccucagaaaauuucaguagaucaucacauaaaacaagagcaggcuauuauugaaaaacaaauaagcaucaaaacauucuuggaaauuaaauacacaucuuuagaaaugugcacauuuagacacauucagguaaaaauuuuaaaaauccacagauaaaauuuuacuagcuucuagagagggauuauauauagcuauaaacaaaucaugugaacauaugccuucucaucuaugacacaagaugcuagaaaacagagaagcggagaagacagucuuaaagaagaaggauuuucaucugaaucuuccuuugguuuagccauauacugguagucaaggauaacaaguaaauggagccagccuucagacgcaagagagcuucgagaguauacccuccuaaguuagauuauacucaaguguauaauccaaauaacggaaaauaaaucuaggaaagggaaagacauauauguagcuguccaauuuaauauguaauuuaauauaaaauaaugguuccuauaauagaaauaccauaauguuacauagauauaugugcaaaauaaaggaaauuuagacauuuauuagacaagacuccucaguucucagaaacagaaguaugucuugaccaguuaugcauaauuggguuuuguggcgauuuuuuagcucacauaacuggcacuuccaagagacuaaucuuuauuaugggcaugguuggggccaggagcugaaacauugucuuagaacuauguuccucugcaguccguggauaaguucuucccugugcugguuaaaauggcagccauuuauccaaaacuuguacccaauccauuuauuccagcccgauuggaccaucuuccugaacaccucugguggaaagguucugagaaggacuuugauugguccagcauggaacacauacucaucuuuggauauaacauuguccuagggaaauaguuaggggcagauagucucacccagauaugauaaauugguuaccugcaagaggacagaauucuuuuaacacaaacagagugagaguggugggcagagaaaaacagcagcuguuuauuauauguuuuuaaaagaacagcaguuggaacacagcucuguguuacaguggaauaacuuggaauuuucucugcccagggacucuaauaggcacguuaagauucuaggacuagaguuugguucagguagugaagaaauaggagcugacugauaccaagaauacaucacuugacucuuaagagaauccaggucuaauuuuagauccauaaauguuuuucaguccuucauuaucuugccuucuugaaaagauaaaaauguguguguguguauauaguagugcucuggagucaacugauuaccuucaucaugcagugucuuugaggagcccaggucuaugggauuuuugacaagagcauuaauauaaaacguuauuaaauagugcccaucaaacuaaagaggcugugauuuugacaaggaaugaacaggcaaacuucacuuggaggaaacugugccuaggaaaucaauuagagaaaaagaggggaacaaaguuugaggugccuacucagagcagaaucuauauaaugcugguggcagagggucucucaaaggcgaauccuaaacccagccucuccaaaccgugccuccugaacauuugcacacccgugugugcacacagacacuagggauuccaaccacucaacaguauuugauguuucucaugcagccuggcauuucucugcuuuuucccaucuuuugacccaacuguccucuaccugccaaaaucaugcuuguguucagacgcaguccaauggucacuuuccuguguccucuaauuagaaugagugaccccacuucuguauuccugugguauuguccaugaaucccaccuucgcaacucuuaaauugacugaaauguauuguguacauugguggguuuaaacuggguacacguucuucugggagaaucaggacuuuccaagggaauccacuuccaaauguuauaccuccacauguauucuuuccuggaauucaugugccugagaacucaccugugaccagcaucauuccaagucuuuuuccccaaugccaguuuuacagaugcccuccuucuccuucauaaaagacagacauaccccucacccaucaggaaacucacuggggugcacuuuccugagaugggcaaaccuuauuccugaucucaaacaaaagaacaaauggaaauauugguauaagaucaagcagauaaauuaaugaguugguggcgaaucuuuuugaacaucaggugguuucccaauuuuucuuuccaaccaaauugacaaaggaucuaacugaguugucagauuauagaucauuaagcauaauuuuugugacagauuaaugaagugauuuuugacauauauuagaggaaaaguuuuagaaaccuaauggaaugauguaaccauaacaaaagucccuuaauuuaccuucguaugugacaagcuuugccuagugcuuauaucuauaagaggaaaaguagaccugaauuuaugccaaacccugccucaugcuagcaauaaguaauccagucauuuuuaaggaauuaauugaaaaagccucacucacuuaugaaaugcaguuccaaaugauauuuuaccauuuugcuuaagaaaugucaaaguuucuaagaacauuuauguaauuuugguuggcuguuuucuauuagcacaaggauaaacaauauaaaaaggaauuuaauacaacuugcuuauggugagggaaaaugaaaauuacauuuuaacuuagauacauauucuauacaaagaggcuugaugaauaaaaaaaaaaacucaagcauaaaguacauucaguuaggauaagauucuguuagguagugaaauggaaauaaguucaaggaagaagagacaugcucuaaaauucugccuguuaaaggaagaacucauuuacuaauuuuuacguggaggggccugggcaugaaaauacuaugauauccagauuccuuuguuuauauuuuuaaauggcaaaauauuuuugccauuguaaauggcaauuuacaauuaauuuaguuguaaauggcauauuaaacaguaauacaauuuaaaaaauuacaauauuuuuaaauuguaaaauauuaguauuuauaacacaauuaaaauguacaucuguugcaaccaacugaacucaugauggaaauuuucagacgucaaugaaaaauggaaggagaugcaugauuguucaaaauuauuuggagggauaugccaaaaaauuauuucuauuuauuuauuuauuuauuuuugagauggagucuugcucugucgcccaggcuggagugcaguggugugaucucggcucacugcagccuccgccucucagguucaagcaauucucugccucaacuucccgaguagcugggauuacaggugugcaccaccacaccucgcuauuuuuuguauuuuuaguagagacaagguuuugccauguuggccacgcuggucucgaacuccuggccucaagugauccgcccacgucagccucccaacgugcugggauuacaggugugagccacugcaccuggcccccacaaaauuauugaaaugcuuuaugucaguuuguaucacuaguucagaagcacuuuaccuuguaauuuuucccuuucuuccaagugccuagaacauagagaacaaagucaacacagguuaagaugaagugcagcuuugcuuguugguugugaguggccgugggacccacaggcagcagugugagguggcgagguagcuuuucuuucauugaaacauuuucucugggccauauaaauuugguggaacuggcuuuugagaaauccucuuucuuaaugaaccacaaaaaaagcaauaucauaggacacaagaucuuuaauuugcguuuaauaaaacaauaaaaugaauccauuccaaaauuacuuggaagauacuuacauuuagugauggaauuaucuuugcugacucuguaaaagaaaaacuaguaccgaacugagaauaauuguguucaacuugaggaacuaguagcccuaaguuagcauuuucuucuuuauacuugagcugaagaauuuaccaaagcucauucagagauauguaauggccucugaaccaugggauuauauaauuuagguggaggacaauagaaggguuaauauuccuuacucaggcucuguggcuauucauuuagaagagaauuaaaucaugaauuuauauuaggcuucugcgaaagacaaaguaagugugcuuuuucacauuugcaaaaauccugcaguaauaacuuuuuaguucaaagagauuguucaugccuuaagagaauagcaaaguugccagugcauuaauuaacucaaaaauaaugacuuacccucucagggaagacagaauauagcagaaaggacaaagccaauguuguauuccuuuuaaagauuccuaauuagucacuggucaguuguaaaaaugaguguuuacauccuauauuuugauuuggcauuucaaagacuguuaacaguuccacucuagaagggauuuuagagcccgucagagccaacugcuuauuuuacagaaaggggaaaggggauuguucagagugcaauuugggcuuucaauucagcccuccuccugcugccccuggguuucaggcuggggucccuggaucgcuggcucuagggaagccccucagaggcuggacagagggugggaaaugggacacacacaggaucuggaggacaggaccugggcccccaaccucgaugcagcccaagcagcuccacguuuuccuuuuauguucugaguuuccguuuagcauugaugaagaaaaaaaaagucuccugcaccauuaucucauucagaaauugucaaaacauguuacaguucaugggguuaaucaucggaaccagcugaaggaagaaaagagauguggggugggggcaggaugagugagaugggcaugucugauuccaaacaaaagaugcccaggacagagcagaccucggaaaggagggaucagaaauugccugaaaacucacaccaacacagguuggggcuucacaggaauaucugcccuucucuucagaucugugcucucucugacagcucaccaggaagcuucucuggaaaguuccccacucagccuccaucacccuccucaaagccuuugcaggugcucccccuuggccacacccugccccacccuauacuccgagcaggugccggcaucacuguggggaggucugccuggucuuuccuggacgggucccaccccuuuggcagaaggccuuucacccauguucccucuccucccagcauuuagacaguugucuuuucaauuccugugccacucuucucccuagacgcagauaaaccuccugagagcaggcccccccacccccaccugcuucugcaccaauggcaugaauggugucgcagggcuguggccaggccacacgggccaugggaagauuauccacauggagagcaggagggcuggccugggcaaaaggggagcucugguaauagcacucgcauuagucauuuuguaaaugguuuaacacgugugugcaccaaauaugugaccucucacuccauguugauuuaaggcuuugcagguggcuuaauuuagaccacaggcucucaacuuuuuuuuauugccucaaaacuucugaggaauauauauguaucacccgacaagcauuccugaucuuauaacuggcuagagaagggguggagguggguuagagucccucugcccugcgauguguucugugccuccagagggcauguaccaggugcucugagggccuccuccaaggggccuggcagcagacagcuaguggggacacauuuguuaaggucacuuugcgccucagcgauaaucccuggagagggaagaggguaagccaggcuaaaccagcauuuguguggccccuacugugugccaccaccucgcucaguccagccugccacacucugccuaugggagcacaccgagaguuggugugaccauacagcacugucauucuuugcguacgugucugucccuucagaagcugugagugccagagagcccacaugcuuggauuggaaauauguguccccaggcccugucacagggccguucacauucaggcacccacuuagcaacagggacccugugggcagcagcauuaccuuacuccaccagggugugaauccaggucucugugaccugagaguuuuacucuugucauacuuuuuauauacaacauagacagaaaaaacgugcugguuuuauuguucagugauggcagcaaaagggaaggcaagagaggagugaugggaaacagggagcuacagcgacguuucuucucaauauuugucuugaacaagagucuagccccaaaagcuggggagagaacuagaagagcgaggucgcagcagaccagcaucacugcauucagcauaucuccucguacguuuacacugcucuaaacuauuccuuuuuuucguucuauucuuuaccuuggagcucuuuagugaaauguauauucuuuaaacuguuguucuuucauuuguuuuauuguuuggaaucucaaauauaccaucaccugaugggauuuucuuuugguuucguggugauaaguuguuagucuccuguccaguuaaaauguuggugauguugagugcaauugugaugucacuucacucucagugcaugauuuuguggagugagcacucccagaggagucuuaauucacuuugggcauccagugacuauuuaggggaagaaugacuuuaaaacaaaauacacugggacugcaacaaaacacagugcuuguuuucuggacuguuauaaauagugcuuagaucauauguccugaagugucuugaaguuuaaaaucuauuuuuauuaaaaaacaauaacaacucuaauauacaucugggcuagacuuguguguuuuuguccuucaaauuucaucucuuugcauagaggcuucugugauuuuagagaaucuagaagcucaguaagagaaaaauaaugaccucccauuacuuacacuuaauguauugcuaucuacaaauagcuagguaguugcgcagaauagccauagugcuacccaucauuaguauuaaggcuugacagaacuuggcuuggagagcaaguugccacucuaugcaucucaccaaacuccugcagcgaaucacauuuagugcauaggagccagguaaccucaaccacagaaacuggccucacauguaaaaauuaagggagagccaaaagcuggggaguagggccgugaaucuuccaggccagauuucaaauaugaaauacacgucagauguguccaaacugauacuuaugucugcuuauuuauauuuccaaaaacucuaauugucuuaauguuuuucuaaagaucucacauuaaacaaguuccauuaagccaaaggccagccuagaaacaauugcauucaacaugucauuaguuugaauuuuuaaaugugcuugcccauagccauagagaggagaccaauguaaaaggcuaauuaaucaaauacugauuuuugagggaaaauuuugcccucaaucuuacacaaaugacucccugugaguuaaaauguuucaggaguauucagcaguauuugaaugagguucuuccuuuacuuugagcacccugaaucccaaauuuuagagcggggccgacagacugaugucacacuuguuaggcaguauggacgccagagugguuugggcugaccuguccuugccgugucuuguccaguaagccugccccuggggucuggcagccacugcagcccggauggagccccgcaggugcugucagaggcggaggagaccgugucaguuggcagcuguuuugcgucggaggacacgaccgaggacucaggagugaugaguucccccucagacaucgucucucuggacucgcagcaggacagcaugaaauacaaagacaagugggccacagaccaggaagacugcagugaccaggaccucgcuggaaccccagaccuggguccccagaagagccccuugugggagaagaauggcucugagaacucacaucugaggugagucacgggaaggauggguggguacggaagucacagccacaucugugucucuaaagagggucuuuugucaugggauccaacacgugcuaucacaaccugcucugcaccaggggccccgacccugauucacagcagcugcucucaggcaugucucugugcugucuauacaucugcaguaacuuacaaagacuguguaagaguggcuuguuugcuuugguaccauacccuuaaguauauuuuucuacucaauaucauguuuguaagauuuauccaugaugauaucuguguuguucauucauuuauuuaccuguuuuccugauaaugaacacuuagauuguucuaguuuuucagggcuagaaacaaugagcaagaaacauaugucucuauuuacauguagagacuuuucuagaagaggaaagugacaggaaagagacucaucuucagcuuuaugggauaccugaaaugcuuaugcaguuggcgggccccccagugucugcaagguccccuuguugcacaccgaugccagugauuaaggucaguagacaucuugagcuuugccagcauguaggcgucagauggcaucucauguagcuuucauuuacauuucucugauuaggaaggaugagcaucuugucauauauucauuagcaauuugggccuuauauuggauuaauugccguuucauagccuuugcucuuuuaaaaaacaugccacguuuggccuggcaugguggcucaugcccguaaucccaacauuuugagaggcugaaacaggaggauugcuugagcccaggaguucaagaccagcauggucaauauagugagaccuuuucucuacaaaaaaaauuuaaaaauuagcugagugugguagcaugugccuguagucccagcuacucuggaggcugagaugggaggauugcuugagcccaggaggugaagguugcagugaguugagauuguaccacuauacuccauccugggcaauagaacaagacucagucucaaaaagaauugaauuaaauuaaacauuguuauguuuacuuuuuuugauuauuaaauucuccuuugucaguuauuuacacauggaacauuucuaagccuguggcuugaacuuaauuaauguuuucuuuucuuguacaaugauugucuuuacauucuaauauuauuuaauuuuuccuuuuucucucagauguauauaaucuuugccuauuuaagagauccuucccguacccuaaaagacuaaagauagucugaauuucuuguaaaacugcucucucacauuugggcccucuuguaccugggguuuauuuuugggugugauaugaagaaggaucuauuuuuucccacugauuccuguccccacuauggucagacaucaaguguccaugugcacguuguucuguuccagugcucuuuuuguagcacugguguauuuguccaucucuguaccaacaccacacugucaggauuccuuucuuuauuauauagaaaggcauauugauucucuucagcccgccaauguuuuucgucuuuuagauaaguguaagaacucaucaaauaaauauuauggaaauguuaacagaaauaagguaaaaugggcugggugcagcggcucaagccuauaaucccagcacuuugggaggcucaggugggcggaucaccugaggucaggaguucaagaccugccuggccaacauggugaaaccucaucucuacuaaaaauacaaaaauuggcugggugugguggcacuugccuguagucccagcugcuugggaggcugaggcaagagaaucgcuugaacacuggaggcagagguugcagugaaccgagaucgcgccauugcauuccugccugggugacagagugagacucugucucaaaaaaaaaaaaaaaaaaaaaaaggaaagaaauaagguaaacugauuuaaagaaauaguucauaagccagucaccaaaaugaaugaaugcuuuuauaauauauuuuucagguuuuguuccaacccuauucauaugaacucacaaaucuguaucugguuaguguaauugucuuaucaauaauacuuuauauuucuuuguaccuaacaguuugucaugagcacuuccccauguuguuauacacaucccuaauaauguuaaaguauagcucuucaauucuuaggaugacuccaagaccaaguuuauauuucaucagaaaggaaauucaaaggcagcaacugguuccuuccugccuaccccacacaagaugcauuuugcugagguuggccuguguuguuuacaucugugagaacagagcaaaauuauggcauuuuuccuuuuagucauuuaacauaaagaaaaaccacuuucuacuguaaucuccacgucuguucugcaguuugcauggggauugcacagguuugcauuccacaucugaaacuaaucagacaugcguuacucugcaccccgcgggaugcugcgcauaggacucauuguuugcuuugcuggugcugaccguugauguaaaaucuugcugauuucuauccaaauaaugaggguuaauauugacuauggccacagccagaauaaucauugagucuuuggaaccugaugcuuuaugcaaacagggaauauggcguguuuuccugcccucaucucuggggugccacugaauuugagaguacugugguggggagggagggaguucgggaaccugauagaccuacaauggaaucuuaccaccacuaacuagcuguuuggccuuuaagaguccacuuaauuuugccaaacauuaccuuuugaucauacacagugcagauaugccaccuaucuaucagaguugucaugagccugggaaaagcccagcacagaugauaccaugcauguugcauauauaauaaguaguacccauugucagaacuacugcccuuaguuuuuaggaaaugggggcaccaugaauugcccuggacaaucacuuuccuucacugggauguggucagcucaucagucagaugaggaugaagaugcucuuugagucccucagcccugucugugaugcuggguuauuugccaaagaguugggauugacucugcccuugcauggaauuacuauaguuuuguguguguguguguguguuuuugaggggaggggggauuucauagaaugaaucuaguuuuuugggcaccauuuugagguuuuuuuuuuuuuuuuaacagaaauuaucucaacugacaaauuagacauauucagagauuucagcaugguauaucacauuuuuucccaaauacaugauuuucaauaaauuucaggauuacuuaaaagcagugccucccaugcaaugcagggguugcaaauauggaugcuuuagggguaaggcagggguuaggcgagguugagggaggcucagcuggugagagaucacaggcaguguggaaaacacaugcuuucucuaaagagagcagcccugcucccucuguccaacugucacccuguggguuacagacccaguguggccaguuuuugaagagaagccagaaaucuagauuuuuaugugaugucucucaaauuguaaauguuggcaaccaauucaggcacucagggugaaacggaacacauaugcaagcuggauguggccuguucccagacuuacacccuccugaggacugaaggcugcaucgauuguugcacuucucuuugggagaaacaagauuacuuugcuugccuauuugucagcuuuggaauacacuugucgcuacugaaguauucccugugcuauauugcuugaaaaauaucgauucacacauaagguugggaacguagagagaaucugccucuuuugaugaaaauaguguguuccagggacaggcuuggcauucacaucuggagugaacccugucgaaagccuaggcagcacaggggugguaaaggcagggcuggcagggagcugcccaggcagcagaacucagguguggcccgauggagcaggccugucagguggucacgaucccuacagugaggacccaugccugggggcugacagcccagacucaaggugaacuugugagagcgcagaacccaccacuguucacagggauguggcccuaaccuuggccaccugcacagaggaacccuauuagaacacuaaacagcagcauccauguucagacucuggcgguugagagaaacaauagcaaagaggagguuuucugacaggcagugugagcaaaagccuggcagagcgucccuaguuggcaccucaagcuccucuuucauugugccccugaaacauauacccaacaccaccuugaucaagaggaggcugcccagagagggcaugaucaccguuccuggugcccugugccuggucccugagucgagccuccuggcccuacccuggaugacccccuauaccugguuuccacaacucauccugagcugcccauuugugcucccagaacccguguuugucuuacauggcaaacgacaaagauguaggaccuagcugugacaugagcccucuccauccccucugaaugacaggccuuggggcucaggcaaagcagaagucacccucugucuggcuggcaaggccaggccucuaggcugagaguggaguuggauagguugugaagcugucccugauagccccagacaucuucagcuugcagaaagucucugcaguagucccagucaucaagaaaaugaggauuucucauaguuuaucaacuuggccaagguggugucuucuauugcuaccccucuguuacuuggguauucacuaaacacgguuugggaacagccuuaagacccuucaucaccuggaaagacccaaguguguaaggucuaccucgcuauguucuaguuuucuuagcuauuucuccuuucccugcacccuaugaaggucaaaaucaucuagacuccuuuggcuagggaugccuggguucacacauugacaagcuggaggcaaacaccauuuccucaagagcucugccaccuguccaaggagagagccauguugggcuggccacagcuaaaaacuguccuggcccaguggcaucuucacugcuuggguugugugcaguuguauuuagagguucgacuggccucgcugcugcugcagcaccugcuucauacauggcagcauuggugggcuccauucgguguccuuggagccaaggcauuaaauugaagagucucaagaauaccaugcuucuaagaagagcaagugugaaugcuugguaauaauuagaauauguuacacguugggcucacgccuguacucccagcacuuugagaggccgaggcagguggaucaccuaaggucaggaguucaagaccagccuggccaacgcagugaaaccccaucucuacuaaaauuacaaaaaauagccaggcgugcuguugggcgccuguaaucccagcuacuagggaggcugaggcaggagaaucacuugaacccaggaggcagagguugcagugagcugagaucacaccacugcacuccagccugggugacaagaguaaaacuccaucucaaaaaauaauaauuauuagaauauguuauaugugcugcugcaauuugaaaagcguauguuuucauccagucaugugaugguauccgauuauaauuuuucacugcagaauaaaucucaguugaaauuugaccuuguaaagggaacaucagagucccagagucuuccucucaacauaguacagccagugaagaaacuccuaaggaagagcucagcccaagaucugaacaggaauaauagaaaugugcauguggugguugcauuucauucuggggacaccugggcauggcccucagggaagguccugugugccucacacacagcucugcccuggacuucauggacucacagacucuuccgaaaggcaucugucccuuacauaugaccccagccaaugcuccuaauaguuaaagaaucacuuaaucugaagauugaagagucugcauuuagacugcuuagggaaggaacugcccauggcuggcaguggugugcccagugacuucaccucuugguucaauuuccuggucaguaaaauugagauaugcacuaccuccuccuuacaauagugccugauacauugcuagccuucaacaauugguagcugguguuauuguugcugguauuguuauguacaacugacugaggaaggggagaaauuugauuugcuagguaaucuuuguaacuuguaucuagcucugaucaucuuccucuuuauuuauaacauguuugaaaaauagauaaauagacacauauauaugugugcaugcguauaugugcauguauguguauauaagagagagagagacagagagagagagauggauggggaaguagaggagacuguaucuccuccuaccugcagggaaggaacaguggaacuagcacugauuauaaacucuugaauucugaaagcaaccuugcuauaaccaggcaauaucuaacuguguauaauuauugugaaaaucugaguucuaggguuccuuuugggaacaucaauuccacaggaaugcugugagaaguaaaagagagagaucgaauaagugggugucaggcuuuuucuuuuuuaacaguaaggccaaacugaaaucauaugcagagccaccaaagguagagaguguagcuucuccaguugaagggagccucccuggagugcccgaugucccauuucagccuggcagccuguacauuuccuucucagcccccacuuguuggugccugcuggggaugauggcugcagaagcacuuugugaggagcugugcuguuaccugcaggcuuguggcuaugaggauccuuaugggacugagggccuguagugagaggugcagagggacccagaucacaccagccaaccucugaaaccugcugacugcagaaacuuugugacacaggagcauuuagaaacauuuggcaccaccuagaaccuugaaacuucauuguugacugaaagaugaguaugcagcucaugacuguguaagagugcauagauuauaugcaaauacuaugcuuuuuuuuuuuuuuuuuuuuuuuuuuuuuugagacggagucucacucugucacccaggcuguagugcaguggugcgaucuuggcucacugcauccucccccuccuggguucaggcgauuuuccugccucagccuccugaguagcugggauuacaggcacacgccaccaugcuaauuuuuguauuuuuaguagagaugggguuucgcccuguuggccaggcuggucucaaacuccugaccucaagugaucugcccaccuuggccucccaaagugcuaggauuacaggcgugagccaccgcacccagcuacuaugccauuuuauacaaaggaguugagcauccgcagaauuugguaucuaugggggauccuggaaccaaucccccuuuccucagauacagagagaggauugcauaagaacuuugugacugcggaaucauugagaaacauuuucuacauuccagaccgcuucuagaacucugaaacuuugugacugcauuuacaaaggaguguuuaaaacacaugugagaccuuggagagcugcaccguccaguauguguguggcugccgagcgcuugccaagugucugguccaaauugacaugugcuguuaaguguaaaauauacaucaaaucugguacagaaagaaauaauuuuauauuaauuauuggcagaaaucacuaaauuguuuuauuaaaauucuaccuauuucuuuauacauuuucaauguuauuauaaaaauauuuuaaauuauacauguggcucauguuauauugggcaccauuguucuaggacucugaagcuuugcuaauacaggaacauuuacaaauggaagggggagguuaagcacauacgacuaucaucaacugcauauuuucccaggcuucuugccuuuaguuaaucaaguaaucacuuugaaaucacaggaguugguuugguugucauuagcaaauuggauugcuaccuaaaagcaacaucucucuccucucagacuuuuuuuuuuuuucauuaauucugccacuguacuagccucaucaaaaagaaaaagugaccucaugugcuaugaacccaucuuguacauuucggauuggucagauucagcccauucucccucauagcaaaugaaaacaacaaaucaaaaagcgcuuuuggcuccuggcacuaacugaauuugacugucccuaguucucguuuuugcuggaggcugggguaugaaugcagaggcucagcaagcccugcacacacccggcuggguggaucggucagccugccacccuccgaccaucccaagaggcugggcccaaggacgcagguccacuuccugggcagacucugguuugaaacuugccggugcugagcugugucccucauauugcaugccccaguagccuaaacauucacauucccugcagaguccccaacuccgugugagaaaauaacugcaauacuuauucaacacaugcagccugauaucaaaaugucuucccuguguuuguuugcauuuauuuccuugaucuuaagccagaacaaacugucaauaaggaacguuucuaaagauugagguauguguuggugggggggaaggaagcccgggagaaaaacaucugggcagguuuacuuuaagcuaacagaggcugauguuucuugcugacugcuaacucuucagggacacauaccuagggcuccccugcuaagcccacagggaacuggccuccaagcccagugacuaagggcauaaaucuggugguuuugcaaagagagaggaauguuuauaauccauuaguaacccuuuggagagaaguagaugggaguuaguaaggaaggaaaauacugcugucucucccuccugcuuucuuacacuggaaaguaaaaucacuacauugccauuggcucuggcuuuugcuagauaauccauucauacaugcucagaacacagccgcccuguuuugcaucaaaagaagagcaggcugcuccucuuuccucucucagagaugccaggagcuuggcagccucaggaggaacaccaaacaagguccugggcugcgugguggccagaccuucccucacuccacggugcacacaggcugggagcuccuagcucauguccacucuuucuuucagggcaagcagggccccaaggagccagccccacacugaagugugggggagcaaagcuggagcagaggugggaugcagagguaccagcauugccuggaaccaagcagcagcguccggggcaaccucuauagagugccaagugaggccaguggugggagggagcuggacaggaaaaaacacagggaugaaggacuagggcugagcacaggguccccagacuccagaaaggcagcuguaacugguggauaggggagaaaccagcucagaagcagccccaagcgccuggagcugggcuccugcuguuucuagagggcagggagcccggagccugggaggaggaagguguugaagggcugagacuguucagaccuuguacagccucucuguuacaguuucaggcugacagccacgcacuaagauugcuaggcacucaguaacaaaauaaagugcuuacugugugcaguguaagaagaaugcagacuccuuugcaggaaagaauucuuguucacuaaaggacaaaauuauccuuuuaaauuuugcuggcuaaaaauuugcucugucacucaagcugcuuugaacucaaccaagcacaguucuaaagaaaaaggguaaaauauucauccuaauucauccuuuuccuuaagucaugcugguugguuucuuguuagauuucugucuccgccuuguccaaagguauuugcuauuuuuaaaucaucacaguguuucuauauaugugugugcugauuucuucacauaacaugcuaacauaagcauggauguguguuucuacauagacuuaaugaucaucauauuuacugauuuuaaugcccuuugaaauauauauguaauaauuuagguaacugccuagugcuggacauuucuagaauucuuacaugaacuuuguuguauuuauauuuuuccuucuauaggguuuccuuaaagcagauuauuaaaaaagagauuaaugggccaaaguucuuacaaagauaacgugauuuuuguuuguguguuuuuugauauguauuuccacauugcuuuccaauuaaaaccuguagcaacaagugugggucugucagauucaucacaucuucaucagcuugggguggguuuuuguuuuguuuuguuuuguuuugcuauuuugcaaaaugguagaaucaguggaguuuuuaucuuauuauuuuuuuuaauucuuauugauaucauuauguuccaugucucauagugacgugaucaagcauacuuuaaaauaaaggcaaauacuuugaaguaaaaguaugucuguaauuuuguuuggcugggcuuuaagcauccuaaacuaagagcaagcauuuaaaaaguuuuccaucuuuccaaguauuuaaaucucuuuuccauuucagauugcucuuuuauauggcaauuuccauuuuucucugccauauauuuuauuaaaaauuuaaauguauuuaaaccaucucauuccaugaaagagaaaagcagaacuuuaguaaagugcauucaaauaauuaaaguccauggcaaaagcaauagggaagacagucaugcaccucuugugguccuuauuaauggguccacaugcacacacaucuccaaccagcccccuuuguguagcuugucagaggacauuagcugagacuaaucuggaagccacuuccuggcucccaaauggacauagucaccaaaucagaaagacucauuuaucagaauaaaaacuuugcuacgugaggauugugcaaagcuuauuucaugcaucauuaucugggccugauuagcagugauggaaauugguccucaauuuuuaacaaucagcggaaaacaaaccuucagcuuucacugaagauagacaauugccauagacaugucucuguguuuucugcacaauaggaaaauagaggcaagagcccuugcaaagacaguuuuuaaauuguuuuggcagcaguugucucacagaugccauugucccugugacgcaaaugaagccagaucccgcucucugagcagacggguugacaucuuccuggaugccccgugccacaggggccacauuauuauguguuguggccccagaugcagcugguccuucuugggcuuugggggcaggcaggccugguuccagaugccagugugaccugggcagcucuguagucucuccguacauaguuucaucacuguacaacagugacaacaacacuaccugccugaaaaacugugaggguuauaauaagauaauuuaugcaaaagagcucugugcgggggcuggcacaaaggcaugcagacaggccucacacugcuaggagcuuccuccuguuaagucugagaggaggcccuugggaagggucuugcggagucaaggguggagcaguuacuccugcuacuguugcugugagguuuuuuggccauccuuauuguccuuaugucccaguucaagauucuagggaguacagcucuucaaguggcauuaucaggcccccaagcccugccccugcaaguggcauuaucaggcucccugucacccaccaaggguaggaauuaagccaaaguaaacauagagucuguaaaagucauuuauaguagaggagugaaauuucucguuuucugagucuggcagggugggcuacugcuaggguggacacagauggaggcugagcuuaugaaguuggugggacuucugggaacacucccccaugcagcccugcacaacccuccccacggaccuccuaacagcaggcagauccugcaccagagguauguagccuuuaucacugggaccuugaacgacgcugcacucaaauccgcaagugccaaggaacagccgggcugugcaguguugaggugagguggaccagccuccagccacgugcacaugcuuggccuccagauggcuucacuccuucuugccaggugccaggugcaggggacugcuguagcgcaaggcacagaugcaagcaaauccuggaucacgugaaccgucuuuugugcgguggaauuaaaacuuugacuucagucugcagagugaaugaaagcugugugugguuugguuacuguaacacuuuggggccccacacacacaccauauaucacauguccaccacauacaagacauauacuccacacaugcacacacgcuacacgcaucccacacauaccugugcacacacaugggggacacacacacccaugaacaaucugcgucuccguaguucugaggacaacagcaguacagugaguaugugacugcuugaauuugaguaugagcuguucuauccucagauauuccuggaaaggaguacauuaaaucaauaguaagagaaaugagugcuccuuucucuuuggucuucccuagaacugaaaaagcugucacagccucaaaugaugaagaagaccuauuaauugcuggagaguuccguaaaacccuugcagaacuugaugaagaccuggaagguaagaaccaccugauccgcuacucugauauuaugcugcaugaaaguaggugccaacaguaacuuccucugagcauacuuugauguaucuaugugaggaaacagccuucagaaggaauuccaggucaguuuggugaaagucuggaugugaggcgcacacagguuuccgguagacugcuuuuuaucugggcugccaagcaguaccuggaaacauccagacaacugcuuacagugugcucugaauaauacuaauucagugcauuaaaaaaguaugccacacauguuaaagaauaaaaaggguggcgcaaaaaauaaacagauuuccucauuaagacuucucuuaauuuguugauauauggcauaucugucaaugagaaauacucagccuuuugaccacaaugaagccauuuauaauggagcaucucauggcacugcuauuauauugauauauuuuggggaaauaauacuggaaggccaaagcagauggcaaauaguugcaguaaacagcuagggaaucuuucaaacaaagcagcuauguuauuuucuccaaugcacauguugaaaauaaacuaaaaauuagauauuuaucaugccuuagagagaagauaacagacugcaaaacugacgaguaguuuuugucugacucacuuuucaguuuccuguccugagaauguauaguugacagagcuaaaaauuugaaucagccauagugugucccgcagguucugaccccaugaccauugcauaauuuggugcuuggaagagccaugguaauucugagauacucaagauuuagucaucugcuuccuuaagaaguuaaagcuacagcccgugguccucuggauuuuguugugcuucuaguggacaugagaaacauggaggucaaaacccaaaacucauuuucauguuucuguguugagacaguuuuuccagaggcuuggaucuacaaaucaguuuuuuaagugaaggauguuggcagcacauuguaacugaauaccuugccuugaaacaucauggaucugcaaacagcuguguugaguaaugaaaguugagcuucuggccccaggcauauuauguagauuacaaacccaaauaacauuuuaaaacguauauaaauaauguauucaaaaguaaccucagggaaaucaaagucauggcugcaguuacacuaaguaauuggugugggaaacaucugugauuuguguuugucccucuuugcagaaauggaagacagcuaugaaacagacaccagcucccucaccagcuccauccauggugcauccaaccacugcccacaggaugccaugaucccucacggcgacacagaugcaaucccaguaacauucauaggggaaguuucagaugauccuguggauucgggguuguuuuccaauagaaacaacaaugcugggucuuucgacucggaggguguugccagcaggagagacucccuggcgccacuucaagcugagcacagccagccccaugaaaaggcaagggaggaaguaccugcccugcaccccgcuucccaugacgucggaaaaggaauccguguggccuuaucuaacaucucuaaagaugggaaucuaauggaaacggcgcccagggugacuucuuuugcuucgaaucuucacacagacaaccuaaaugcaaaagugaaagacaaaguguauggcugugcugacggggagaggacucaagccacagagagagugaauucccaaccggugaaugaaaaggacagcaacgauaaaaacgcugccuuggcaccaacaucauggcaccaacgaggccaaaacccagggaaaagcuacagacuuaagcacggccucacaacguauaaaaucauuccuccaaagucagagaugcgauguuacgacagagaugugucccucuccaccggagccauuaagauugacgagcuggggaacuuggugaguccucacgccaccggcaucaggaucauuucccugucuucgucugugccugaagcagaaucucagcccauugggaaagucagagaguucuggaggugcaacucuguggaaaaacaccugggccgacccucagagagcucugccaggggaccccccuccaccccugugcccacgcagacgcagaauccagagagcagacuccaagcagaccccaagccaauaucgccccagcagaagucugcccaccaugagggccggaacccccuaggggaggggagaaaccagccccccaccaugggcaugggucacgugagggugccagcagcucacaccacagaagucacauuucucaagccucagagaagaacguccagccaguauguggccucugccauugccaagcgcauaggagccccaaaaguccaugcugauguggugaggccacacgguuaugccgagaaggguuaugcaggcaaggcgccagugcuggcugcaccaccugucacugugaaagaugacaggacauccagcccacacucagagacacaaggauggaaggauggugcccaguggcccugugucacuccucccaacaaccacggggaagauuuggcagugggagccccuccuaggggggaggucauuggcccacacaggaaguugucuacucaggacagaccugcugcuauccacagaagcuccuguuucucacugguucagucuucccagagggaucguguuucugugggacagagcugugguuucaguggaaagcaaagcacaaguagccaggaggccagcucagcaucugagcccagacgcgcaccugaugguacagacccacccccuccacacacaucugacacucaggccugcagcagggagcuggucaauggcucugugcgcgccccaggccacggcgagccuucccacccuccaggagggucuggcacagaaagccacauucuccuagaaagagaggaaaagcccaguguguucucuacagauggaaaugaaacagacaguauuuggccacccagcauuuuugggccgaagaaaaaauucaaaccuguuguccagagaccagucccaaaagacacaucccugcacucugcccugauggaagccauccacucugcgggagggaaggacagacuacgcaaggugaggauggcggcuuccggggcaggccuuccacaccugcccacuucagugcacuggucucagagucucagaauaaagcggaggagagagagagacgggauuaggauaacagugaggcuuaccacacagguuucauuuuaacuagaauucccaucauacugccuccagauauuuguacugaacuauuaaagggacaaaauggaugggugugaggcuaguccacacugacuucaggccccuggcugcccugugggaaagguaacagccagugauguccauccacagggccagaggaauggagaggccaggggcaggcccauccauaugguuauccuugaacaauggaacagaggagaaaauucaggcagggccacuucuuucccauaugcauuuguagcagcagcgaacugucauucuucaguaacacaggaguaauuguaggacacgccuugcccauugucuaggcacuuaacacaccacaaguauuaucucauuugcaugcuacaccaaugcuaauaaugagauauuucuuccauuuugcagaugaaacugaggcacagugaggccaaggggccucguccaaggucaggcacuaguuagugggggccauggauucucuucugggucugcaagauguaaacacacacaucggcucuggaacacugggaugaauagcaggaguggucugccauuaagaggcaguuugaaacuacguagccuuugauucuuaugugugccuucucauagacaggguguaaaacugacccuauaggccucggcugacaugaguggauuuucuuucuuuuuuuuuccugagacggagacucacucuguggcccaggcuggaguacaguggcacaaucuuggcucacugcaaccucugccucccggguucaaacaauucuggugccacagccucccgaguagaugggauuacaggcaugagccaccgugccuggcccaugaguggguuuucucaugagcugcauuacaguucacauuucuccauguucucagugaaaugugugacacuguuaauauucuagacggcagaacacaccggggagggcaggccagcgaaacuguccuacacggaggcagagggcgaacgaucugcacugcuggcagcuauccgcgggcacagcggcaccugcagccugaggaagguaagaggugaagggccuuccauggcgccaggagcucaaacccacccaccccuucuuccgaggcacuugggugguggcugcagaagcuucuguccuuccgauuggauggugaaccaucugucuuuagaguggccaucccagccugugugagacacugggguggacacccugcuccaagagccuggggcagccauggcaaggagcagcaagagcuuccagacacucucucagccuuugcugaagcacaguuccuuccugugccuagaacugagcacuuuuccaaauucacuuggacaccuagggugguuuccaggcuucacuaacuggacaaccagaacugaagccauugcacaccuggaaaaaaguuguugcaugaauauagcgcugguuuuugcacauccuugggagccaguauggacucgaguuuagggcagaauggucucaucuuaguuuccaugcacagaaauugaggagcaaugugauuuguacauuacucauuagguucugacugcaugucuugcccccaguaauggguuggauguauguguccagccucuaugucuauucuuauaugccaagaaaagucaugaggucagagaguucucaguaaggcaggacugccaacuucuagucucugggaucaguuacuuggcugccaacagagcaugggggcagaugucucggccguggaguggacaaacuuccugggcuuauugcaaaagaacugucucagguccagggguaagauaaucagcugugugcugcucucucagaaccuuuggggacagugucacugccuuagucuguuugggcugcuauaccagaaucugacagacuggguggcuuguaaaugacagaauuuuauugcucacaguucuggaugcucaaagucuaagaucaaggcaccagcagauucaguaucuugugagggcccacauucugguucauagacagugccuucucucugcauccucauauaguagcagaggugagagagcucccuggagccuuuuuuguauaagagcacuaaucccauucaugagggcuccaccucaugaccuagucacccccaauccucaucuccucaugccacuaccuugggcguugggauuucacagcugaauuuugggagacauucacucuauagcagucauuuaaucaucucauugccagguggcauccucugcuucugaggagcuccagagcuuccgagaugccgcacucucugcucagggcucggaaaguccucugcuagaagaccuuggucuucuguccccaccagccauucccccaccacccccuccacccucccaggcucucucugcaccaaggacggccuccagguucagcacgggcacccucagcaacaccgcagacgcaaggcaagccuugauggacgccauccgcuccggcacaggggcugcgagacugagaaaggugauggcgacugugugugcgcauuucaauggggccagaggguuggaggugcagcguagauccagggacacgcuugccugugggcaggagcugcgaggcggucacaugggaguggguugagagagagccggcgucacugugucucucacaugugcugaccagaguggcagaugaaggcuccaguccacaggugagaaagucagccuccugcaugguaggugccagcuccaguccucagcuccuuggugaugaugacagguggaaucuaaaccccacuguaacccaagcucaguuccacccuaacccacaguuucuacugguccauggagaggauggaagaucauccauuuggggccccacagagcacacaucacaaacucauggcccucagcuggcacggaagccgccagucuuauucauucauucauucauucauucauucauucauucauucacucguacaugcuugcauuccagccuaauguuggacaguuacggaaucugaagucccuugggcagagcaugcacuuucuggauuuccccggcuucuccauuuuggucuugugcuggucugcacauuacugcccaccuggccccugcaauggaauuccuagauuaaagggcugcuugggccagauggcuucugagacguguuucaauucugacaugauucaguaauggauugacccuccgucccugcccauuccuaguggguguggggaguuaugcuaauaauugggagguuggaaaaagauuuuauuuuauuuuauuauuuuauuuauuuauuuauuuauuuaucugagacggagucucacucugucgcccagguuggagugcagugacgcgaucucggcucacugcaagcuccgccucccggguucaugccauucuccugccucagccuccugaguagcugggacuacaggcgcccgccaccacgcccggcuaauuuuuugugguuuuagucgagauggaguuucacuguguuagccaggauggucucgaucuccugaccucaugauccgccugucucggccucccaaagugcugggauuacaggcgugagccacugcgcccggcaaagauuuuauuuucugagugauuauuuccagauccuaagcuuauguuuucacuuguacccaagcauucggugcuaaagauuauccucacuuucuauauaaagugggccaggcucagaggagugagucgcuuggcuuggucacacagggccuggacuuagacacggaucaguuugggcacaagaagugcucauccccaggucacaagcugugugcuccguagagagcagguaacccaggagacgcuggguaagcuacucucauguaggacugcuggcacaauggagaagggagacagcucuccagaucucccacucagaagccucggggcacugagaauggaggaggccccacacccggccggcagccuugcugugaaaggcacugccuggagggaugagucccuguggacacccagaggucacaacuuuguugcccugugcaagaacagccugagcgcccacugauucgguggcucucugagcuccccaggggccauuugugauggcucuugggucagcuccccagagcuugucccagugugaggguggggcauucauagcugugugauguggcccugagacaucagccagcaaagaugcuagccagucaucauugaaugcacagcccacccauggaugcuggggagaaaagucuccuuacccagauggcaagggauauggcaaguuuuaugccaucuccucaggauaggggcaauuagaaauuacuuaaggcucuuugguuuucuuuaugcuuuuuuauuccuguggaauuuauguguugaugaauguguguacuuauguaaaaugagggaaaagugaagaaauuggggugaauggcuaaauaggggucauaaaaaugagcacaaauucuguugaagauggcucuugaagugcagcuccgaggcauccugucugccccacacacaugacagccaccgauuucaagggcugaucaucggaaggcucucuggaggagucugaagcagugcgauugggaucagcucugucacucuacugaucccaggguacauuucugagauucuaaagcuguuucucaauguagguccauaggacaucuguaucuugaaucacauuuuucagccuaugaaucugcaauuuuccauugcuauccaagugacuuuacauuaagguuggagacgauugucuaucucauuugagccuuucaugcauuuugaauugcaccgacugggauccugugaaggccaugaccacacucuguacucacugcuuuauaaaagucaucucagugacugguuucuguaucuuuuucuuuuacccucuccaucuugugcagagucaugaagggccuggggcccagagaugcugaaagcuggcccgagguccacaaccagcaagcggaggagauaauaacauugggacuuuuggcuucugagaaugcguuccucugccuuacagaaaggaaaaaaaaaauaaguuuugacuagcccgaaagaacagaggaaguugugcugugagaaagaaaguggggagaaaugcacaggccacggagagagagaggccgggccuggaugaagccgugggcguuggugccgugcgaggcccaggcaugcuuggaggaaaggucaccguggcuguaaagugcuagccagggcgggagccgggcuuguguuucucgcacagucucagccaucugucagcugcuucaaagggcauucaaaaguccagguuuugauuguuucuuggauuagucugagucguguggccugccuuauccacccuggaaaguucuaggcaauuaauauuuauguggcauuucugagguuuugaugccccgagccguuuacaagaugcucccgggcugaaagcugggcccugaguuccuuggcugaguccuacguuggaaaccacguuccccucagucucauuaucacuaccaugcccggugaucccagagccuuccuacacuugacgcuuuaucacagaaccacaacaaaucugaagaaagccugcccuaggagggcaggaauugggugaucgaccugcccuccuggccucuguucagcauucaucagggagacucaggugcagggggccaagguggccucaccuggaccaaugauucauucuuuugaaggcauuaaccaacugcauuuccuagaaguuugcccugucuacucauuuguguugagaguagaccuguggucacaggagacauuugcgauuugggaaaugaauuacaauuuuucuaauaagccugguuagauggcacuuuucugcuaugcauggauccuggagguuauauugucuucauagcaaauacacuuucguguauauuauggcaugcgaacaucaaauuauauggacuuugccucuuaugauuuaguuuuauuucaccuuuuggacuuuuaaagcuaugcuggcugggcauaguggcucacagcuguaauccuaacacuuugggaggcugaggcaagaggauugcuugaggccaggaguuugagaccagucugggcaacauaacaagacccccaucucuacaauacagaaaugagccaggugugguggcacgggccuguagucccagcuccuugggaggugaagguaggaggauuguuugagcucaggaguucaaggcuguagugagcuaugaucauaccacugagcuugcaucagccugggugacaaagcaagauccuuucucuuuaaaaaauaauaaaagaaauuuuuuuaaaaaaguaaaauguuaaaagcuauguuaaccuugaggaaaauacaauaaauucaggggcucccagugcgugcaguguugguuguuucuccauagguucucaguagauguagaguuuccugggucuucuuuuggguguucagcaacggcuccagaacagcauugcugggagcacauccugcaauggagggguguccuuggcuuucccagcaaggcagugcaugaaucuguaggugcuccuccuccccuuagcagugcagccuccuccuuucaaugagggugcccagcuaugcugggaagguuuucugggacagucgcaggcaaauugggugauuggucacccaaccuguaauacacaaauuucacauuggcaguaagcugcccaugaucaaauacaaaaggguaaauuugauguaggaggaauaauuaccuuaacagugacguugccauuuuucaaggcaauugaaauuacauuugccuucacggugugaauccaaugaugucucugccucuguauuuguggcugccagagaaacuuccagcuguguuucuccuccagcuccaaauaagagcauuugcagcucggcugcaugugcacccacuuccucaguggaacacccacuccuccugaaggcaguguucagaucugcccccaccccacacucagugcuugcuuccacucagcccugcguucuuauuaaaggcaaagcuguaugcgucugacugucuuugucgaucuguuuuaaaugcauuauuucagaaggccuggaauguacaaguacccuccuaauccauguguauauuuaaaacauucaugucuagugcuucauucuacaagcauuuccggagaaccuacuaggguccgggcacugucggagcugcuugugauagacgaaagaagcuucaucugugcccucaggaccucucagccagaggaagggggcaggggugcggggucugcuauugaccuuaggaacuuuuccaaagaagcugggacaggcuaaucccgaugacuuguggaucuuuccucccaggagggcagcggggcaagcaucuaccccgacaccuuccuggaagucaaggucguagcuccccuuugacaggugcgaaaauggggcacagacaucauaagugacuucucccagcccuuccguguguccugcugcugcugggcccagacaccuuaucagcuccuagccgcuuugggaaacguccuauugaacugaguuccagucucuugucugggcccucaggugccuguuuucccacggcaggaauuaauugaugcgggccacacgcgucaugacacuuggccuugaccacagaccuuguaagaaaugauuagacaugugacaguaacaggaggccccaaaccaggaaagagaaaaaacacaccaacucucuuuucaucuaagcccuagguccucauaugugcauuagagaacuccaaguugcugugacgagggaauagcaauuucuaucaggaugugaaugugacccacaauacaauugcaucaccccugguuuaguugcucguaauguaaaccuguggugugcuuugguuaaugugaaauuguucugaggccuaggggucaguucugucuuugcagacucuuugcgugugacuguucugcuuauugcagcucuacugagucagcugccucuucugcagguagaacggggaggagccuccugggagaagcacaccuaccacagugaccauccucagggccagcaaaugcuguucuccacuccuccagagcuguuccccacauuugaccagcucauuccugacucaucccuuuguuccuuuauuaaccucacgucuucagaaagccucccucagucuagauuagguucccaauacagcgucacauaauuuuuccuucauaaugcaaaccacagcucuaauuucucuagcaguuggugugguuuuuguuggaugcuugccuucccuuccacaucacaaguuccaugagucuugcccaucgugucaugugauggaaggguagacacgcucccuggugccuccuugauaaggccaccaaucccuucaugagguucaacccccaugaccucaucaaauuccagagucccaccuccuaauaccaccaucuuggagguugggauuucagcaugugaauuugggagcacacaagcauucagacuguaacacucccccuauuaauaaguggggcccucaggaaacaucuggcuaaguggagcacuguguuuguacaaguagaucagaggugucugaucuuuugccuucccuaggccacacuggaagacaaauuguguuguaccacauauaaaaaacacuaacgauagcuggugagcuuaaaaaaaauugcaaaaaaaaucauauauauauauauauauauauauauauauauauauauauauauauauuuuuuuuuuuuuuugagauggaguuucucucuuguugcccaggcuggagugcaauggugcgaucucagcucaugcaaccucuaccucccggguucaagcuauucucuugccucagccuucugaguagcuggcauuacaggcaugugccaucaugcccagcuaauuuuuuauuuuuaguagagacgggauuucuccauguuggucaggcugguuucgaacucccgaccucaggugaucugcccgccuuggccucccaaagugcugggauuucaggugugagccacuaugcccacccucauaauguuuuaagaaaguugacgaauuuguauugggauacauuuaaaguggucccaggccaugaguuggacaggcuugaaguagauguuaaauccccaccaugggaguucaggaagagggcccgagagaaccuagagaagagagggauauggaggagcaucaggaaaagggcaggugcgcccagugucaagacagacccggguggugucgauccucccaguucuucugggccuuggggcuucacuuccucaucuguaagauugaugcgagggaugugugagagagcaugcacagggcagggucugcaucaccaccaccaucaccaucaccaucaccaucaccaccaccaccaccaucgucaccaccacaguuaccaccaccaucaccacugccacaaccaccgccaucaccaccaccacgauuaccauaaccaccguuaccacugccaccaccaccacaauuaaccaccaucaccacauggaaaguaccuagaauacuuccugugugcuuaccaugugccagacaccauuuaaagugugacacaaguccacucauuaaaacaucagcuuaaccaaacaagcaguuuauuauugucauuauuauggguaugucuccaauauaaagaugaagaaacugaaguuauagaggguaacucgucccacaucaaauguuagucacgauccucucaggcacaccugagcagagggcaaggccucagaugcguacccacacagcccaagaggcaguguccucugucuggaccaggaccccagggcccaccucccaguucccuugaccucgggccucugcauccugcuagucguccuucccuggcagcuuuuacgaggaagcuggagcgugagaaggucugugaggacagcccugaucacagccuccuuucugcaggucaaaggaacugggaaggggguuccaggaguacuauugcaagaguggcugugcacagagcucucuagcaccagaagaucugcauccugggcuuauugacauaccaaauaacugugaaucucucuucccugcaggugcccuugcucgugugaaugaacagaggccagagaauugcagaaacccaccuguaauaugcccacaggcgucacucaaggagucugcauagccaggaacaucaaguuuugguguuacuuucuugucuacaggccaaaugcgcacaguugauuuucgguguguuccuguauaacggcuugaaaggaaaggagaagaugcugugucgcugcgcagcucgugugccaaggaaauguguuuugccucugaauaucuuaaguugcuaauaaacgauucuuguuggcagguuaaugggacuauaaaugcuggagcccagcacucacacuuaauuauauuuaugggcaaaguaaaaagaaucaugccuuagacugauuuuggaccuuugagacuuuuaccacauacagauggaugaaacuacuuacugauuuaagaucuuuugaauuuuagaaaaaacauaugaaucagauggaacaaucugaaugugauaugcuccaugaugcuguguguuuugguaguaagaaaaaaaaauugggaggcuuuucaaagguggcuuuguuagguaguaaaacugcuggauucuucuuccucaaauauuuggggcuaacacuucacagagggucacaguccaugaucugaccaacuaagcuuuuaaaaaucaacuauuaccacccagaaaacaguccuacgugaucauguggccagggcaugcccgaguccugcaaggguggcggguggcugaggucacaccaccacuggaguggaugggcagugccccacauggacagccauuccccaggcuaugaagugacauaggccucccccacggugccuguguacggagccugaugacuucacugggagccuucuggaauccugcagagggucaaggagcagggauguuggaugcccaccugucaagaguucagaucaaaguugcgcugagagcaucacaauuuugguucagccuugacgcguuuguccaacagcucauuggcucccuuuguaugauaucguggucuucucacauggugcccagucaccaauauuuauaaugaggucuaacuacagcaguaguuuuucauauauaucucuaaaacauuuuguuauauugaaaaaaguaauagaaaucaagauguguugaugaaauaaaauguguaucugagugagaaaacaaguauggugaggucacuuuaauguuucacagcgaucucagaucuaggccucagguagaauggaagcuguucugcauucacugauuaacguugcuaaacucuuggugaggcacgagcuaccagccaauugcucuucaucacagcuaucugucuuuuagugccacaaauaaaagaaaaucaaaucuuagcuguugugugaauuucauacuacaguugguuuggauaccccucuuccaaaaugggaaggacggauucaguuauucaacca

SEQ ID NO: 16506 - RNA, 10361 nt, Homo sapiens
ccuggucugaaaugagugucuuuauugcuuguaccguacaaauaugaagacgaggagaaaggccaguagggacggagaacugucagauaacaacaucgcacacagaggaaaaagacccucacccacccgaaccaaccccaccccuccccacccugccaugaacuguguaguacaggagaugggauagggagagcaaacccacaaaagcuaaacuccaaacacccagagguguugcuacagggaggggaggcgugggcagggcagcucauggaucacaguggggcuccucccacuaggucagcaccccucccccacaggaugaaaugcucgggccagggauggggcccaagcccacacaccaugcacacuggaggacacgcugcccucacacaaacacacaugcacacacacccacgugugccugcgucccgccgacacacgcaguccgaggcacgcacaggagucccacagcacugacauggacgugcacucauguucaaccuuaaggcugcagaacguggggcccuggggagagggaggggugaggggggccuaggagccucccuuuucagaggccccccaccccaauagguaccagagaugcccacccccaccccucccugaccaaguccauggggcccaauacuguccgguguaagauuguaacagccaaggcugguggcccuccacccccgcagaggagagggugagcccagcccauagcccccaguggggccaggccaggcccaggguccagcgggagguaaggccagcuggaaggaagcccuaguaaggcacggggcugggaggcaggcagguuuggccccaaauguuccuccugccucauccauagggugaggacaguuugguggggaggaggccggaccaggaggcggcacccagcccggccacuccugguuccccaugguacagauccuaggaucugacuccauucaccagggagcagcccuaacccccagcccugcagcucccaagggccccugccugccccuggacauuauugcuuuucugcccccauagggggacagcgggugggggauuggaccgccccgugccuggccacuccgagccuaggccacggggccuggaaggcagcaccacugucugccgggugucgcgucccaccagaaggcagccuucguccagaugcagcagcgcggaggcagacaccagcacgacacccaggccagaaacucaggcaggccccaggcgccaugcuucaccccucacuggggcuuguguggauuaaaaccugaaucuccaaccgcccaacagcccaggccugggcgggagguggagucuuccaaaugcgagucugggcacaaaggugaggcuggaggcuggaggcaggggcugcaggggccgcuggggugcgucugggaggggccugaagaagaacuggaaagggggugaggagguggggguggggacacaaaccaaaaaggcuaaguaaaaaguuagggggaaaaaaccacccagcggugauggcagcgagcgugcguccucugcgugggcagacugcucacucgcggaugcuggccgaguaggagaacugggggaaguggguccgcugguccagcuccaguaagcccaggcugucaucugugggcggcagagguggauggggaggaccagucaggagagggccugggacaccugcccagacucccuggggaaacggccccagcuggcgggggcugcccacaggacaggacaggaaaggcccaucccuccgcaauggaggcccucagccacggacccacuccccaaaccugagccccgggcggccuccucugggaguuuccugugcccuugcccaugcgccccacagcuggcagggccuucugagccucccaccuucucucugccccacacaccaccaugccagaguccagcccagagcccuguccuggccugccucucgcacccucccauccauucuccacgggcagccaggggggcuuucuaaaggccugcuuuaacccugucccucucuguaugaaacccuuccauggcuggcucccgccaugcaagcaguccccaccccucccaguggcccccagacccuugcacuccagccccaugcccucucuucucaccaccaucucccuggcugcugccgguccuuagcuaugccaugcuucucccauugcuggcaucccacacgucauuccuccggccagcugacacguuugcuuccuccucuagaaagcccucccuaacugcaggccaggucggauauuuccucugggauuccccagucccuggccucccacgcccuagcccugaccacuccaggccgcccacccuaccugggcugggagcuuuccagggcagggcccagggcuggcucaaucagugcuguguccccagcauagcccagcccugggcugaguucagaguaagaacccaaacagcuguaaagcagugaacccagccaggcucagggaccgggcugccuccugcccugagccccccgacugagcuccagaacgugcugcagucaauggcuccugguggccucaccagguccaaagaggaccaacagcaaaagggccugagagcagacuuggggaaaucucccagacaugaagcgggggccuucgagggcccuccuugagaagugaguuaagagcagaucccaucccuccaccccuggggcaggcacaccagcgcgggggccccaggcacucacagcggucagggggugugauugugauggacugggcgguaaauucaucaucgaaguaccuugugucgaccucggacgugaccugagguuugaaggguggcaggagcuacggaggagaggagcucaggcucagggacccugaggccaggaggccucaaccaaggucaccacgagugggccaggucccugaggguccugcuggggcaagcaguggggcucaccuucuucuggaccacguccugccaguugaugcugaggaagaaccugugcuccaugaccuccuuggcaucgcugggccccccaccaagccugugcagagacggccgucagcaccugccucccggagcagcuggguucgggcagacgggcuuucggagcaggcaggcccuguauggcccuuaaugauucugucuugaccacaaaccacuucacagaggaggaaaccgaggcucagggagggagcucacgugcccagggucagagccagggagucagcaacccggacccacguguccucacugccuggccuuacccugaguccagaaagggaguuaguagggcaggcuccguuccuauccuggcucugccacauaugguuugguggccccagccaggcccaggggaugcccuguuccucaguguccccauaaaauaaggcagugucaaggaugggccugcccugggggaagcacucccuaagugccacuguggacguuuucaggggcuguguggggacgacacacugcgacccuacaagcgagcacccuuguggacgcugcccccuccaggccgcagggacaguggcagcagcuggcgcugggcuggguggggccgacgccagcccucaccucugcuugggguccuucuuaagcagcccagcaagcagggacuuggccucggggcugagcgugcgcgggaagcggaucucuuccaugaggaugagcucgaagaggcgcucgugguccugguuguagaagggcaggcggccgcacaucaucucguacaugaccacacccagcccccaccaguccacggcccggccauagucauuguccuccagcaccugaggauggaggagaaaugagggcugggcccguggcccugaggcuggcaucacaguccugcccucagggcaucugggcuggaaacacacaggucugggggaucccccuacccuuggccucacacguuccuacccccaccaaccccagacaccucaggcgccagguacuccggggucccacagaagguuuucaugguggccccgucacugaugcccucuuugcagaggccaaagucagugaucuugauguggccaucuuuguccagcaugagguuuuccagcuguuggaaaagucaacggaucucaggugcaugcucccaaggcuuccugccaccccagccuuuccuuccagggaaagaugcccggggcuccuggacaucaacccucccaugccaggcugggcccagcacacacagccucacccucugaggcucagagagaggccagauccaacccuccucacccucuggcccacccccaugguaccugggaacagcugggcagggagagccgagagccaggcccuguccacccaccguccccauugugaacugugguucuuauuucgaacgugggggcacuagcuuucuucuauucuuuuuuucuagacuuucuguccuuuaauuaugaaauaugcagccaggcaaaguggcucacaccuguaaucccagcaauuugggggacuuagguggcaggauugcuugaacccaugaguuugagaccagccugggcaacacagcgagaccccaucuccauauuucuuaauaugaaaaaaaaaauuagccaggcaugguggcacacaccuauagucccagcuacuugcgaggcugagguggcaucucccccuggaaggcccugugugccccucccgguuacugaccaucccccacaagaauuaaccucuacuucccaucuguaccacugcacacagacacaccugugaacuguggacucaccuccucugugcggcuuucccucgacauuagccuaugagacgcguccacacugucguguguagcuguagcucauuccuaacugcuguguggcgucccacugugagaacacuccacaguggaucugacuguuccucucacaguggauacuuggguuguuccaguuggggcuagaguaaguccugcugcugagugagggggacacuuucuaaggugaguguguguccccacuucuccugugcacacagcuagggcagaugacuggugcucagcuuugguggacacugccaaacuaucuucuaaaauuggccgggcgcgggggcucaugccuguaauccaagcacuuugggaggcugagguggguggaucacaaggucaggaguuugagaccagccuggccaauaugaugaaaccccgucucuacuaaaaauacaaaaauuagcugggcaugguggcgggcaccuguaaucccaccuauucgggaggcugaggcaggacaaucgcuugaacccgggaggcagagguugcagcgagccgagaucacaccacugcacucaacagaguaagacuccucaaaaauaaauaaauaaauaaauacaaauaaaguagguauuguggcaguugacacuccgcuaguggccuaggagcgcucaugggaggcuugggaaggucccuacuuggggcaacuugccacagagccaccacccuggaccuugguggggagccuggugaaugagggcagccaccacccuggaccuugguggggagccuggcgaaugagggcagccaccacccuggaccuugguggggagccuggcgaaugagggcagaagcucagcccaacuuccccagugugagucccauguggugugcaugccacaggucagccuggcgcacacccugccacuaaccuugaugucgcgguauaccacgucccgcgagugcaaguacucaagagccgagacaaucucugcaccauaaaaccgggcccgcuccucugugaagacacgcucccgggacagguggaagaacagcugcaggaggaagggguggggagaggaggucaggccccagcccacccaccugcccucaccuucccagcccccugccccagcgcagugauguggugacaccuguaucaugaaccagcaagugacagcuagagggaccaaucaaggcagagcgcagaagcucauaagugacacagagcuggggggaagggcgagggucugccaggaggcacccaugagaggguaugggagagacauccgagacaggagggaggauggcauggaggcaaaaagaagcacacgucaugaccaaguaacaauaggccaugggcaagcccagaucagacagaugagcaaaccacgcaucccaaagcaggugugccaaccacugcacagagaaggcgcgaggcaaggagugggugacaaaagugaggcgacucuguaaggggaagcugagcggcugcgggaauucacuucgagaggacacgggaacggagggcugcuagguuuuaacccuugggggcuuucucuggggccuuuaagaccauccuucccagugcuaucgccccacagcccucuccacaccucucuggacugguuuggaccugacccacccacucacuagcuguguaaacuugggcaagccacuuaaccucucugagccucagugacugcccccccaaaauggagacgaagccgccugccucaagggagaggggcacuagaugacacugaaauuucccuccacccuuccaucucacccacagcuccucuccaucccgccccacccuaaagaaggaggccccagagggcaaagucaaggcagccgcggcucaccucacccccguuggcauacuccaucacaaagcacaggcggucgugggucuggaaggcauacuucagcgccugggggaugaaggcagcagggugggaggugggagggaggagggcucugcugagccaugccagggcagggcccuggcccugcuuauucugcacacacacacccugcccuggcuggggcccccaggagucagccauaugggguucacauaccggcugcaccuuuuggggcauuaagugaaggcauggcucugcgguaggaaaggguuacaugcugaaccaucuuguccucugccuccaucaggcacagccaagggagaacuagagcuguucugagcaaccauggcucuuguuuuuacaguaaaauguguucaacuuacacacacaagugaugucugcuguggcugggaguggcaaaggcuugggagccaacuucaaugacaggauggacaggcugucagucaacaaacaguaguucuccacugcacuaaggagaucuacagagaguuccucagagacucccaccaggggguccuucagcucaugacaacucaacuauucuguuuucugcacugagguaccucauaagauuuuauuugaaaaaguacuguggcuuaauaggauaccuggacagcaacugagauaaagaaaugauacauaagccauccucaaucuaguccauuuaacugguggccacuggccuugauggagacugcagcccaaacaggcaucuacucaguccaggcugacagacaacacaaugcuaacacaucugcuucuaugagcauaucugaaaacaaaaacaaaaaaaauaauguuuccacuucaaccagcugggcuaagugcuccuaacucauagagacagcagccagcaaauaaugugauaucuucaguuaguucaaaugcuuacaugaagccaccaucuaugaagaagcugucacccucccacuccccgagccugcucacccccaccacaugucuugguucggaugacuuggcagggcgcagcaacaccuugcccugcccgccuggccuaccccaagacugugcuuuguaccagaagauuagggcucucucucugagcucuguccaaaggcuggccucacacugucugggaaggggagggcaacucacagugaggaacgggugccugguguucuggaggacccggcucucggugacugugugagcgacuucauccugcagacagacugcgggugaggggcuggugggcaacaccacaccugcccacuccgccccgacgaaggggagcaaggccuugugaaaugcaauuccauucccagccauaaaugcagaaaaucacaggagugaaaagugaaagccugcaaacccucagcaaauagcagacccagacgaggaucaucaguggcucucaaagccacaggugaaaagucagcaggaaugucacaauguaaggaccaggcugcuagggacaagacaccugugacgucccugcaagggagacaaacagacaucacgagagccccgaggugccaccacaggcugugggaagucccaccuagaaagcauucuugcccaaagaaggaaaaacagugcuucuuggugugguccccacacagcaccucagcaccgccugggaacuggcagcaaugcaaauuccugggaccuacccccaggcccacugagucagaaacucggggugggcccagcacugucucacaagcccuuugggugacucuaauucagguucuaauuugguaccugacuguacagcagaaccaccaggagugguuccaaaaaucuggagccaccugcagcaacgugaacacaggcucucucuggggcaaguuuauccccaggggacaccugagaaugucugaagucuuuuuuuuuuuuuucccuuuuuuuuuuuagcugggggucuggcucugucgcccaggcuggagugcaguggugugaacaugggucacuacagccucaaccucugaggcuccacugauccucccacuucagccuccugagcagcugggacuacaggugcacgccacuaugcccagcuaauuuauuuuuauuuuuacagagacagggucuugcuuuguugcccaggcuggucucgaacuccugggcucaagcgauccucccaccucagccuucuaaagugcuggaauuacaggcgugagcuguggcgcccaacccaaaagucauuuuugauugucacaacuuggggagcuaguauuggcuucaguggguagaagccaggggugcugcugaaacccuagaaugcacagggcugccccgacagcgcagaaucaucugucccaaaacguuaacagugcugaggcugaggaaggcugccuuaggcccaaucgucacaucaggaaugaacagcuaauuugguuggcucugauggcagcaccacaugauuauauucuuuacagucuucaucugucaggacacauguucaaguauggaugagugaagugacguguugucuaggacaggccuuaaaguauuccagaacaagagggacaggcagagcuaaggaaacaaggcuggcuaaacgcugauaacugguuaaacuggacaauggcuacauggggguccguaauauuuauuuucuuuuuaaauuuuugaaugucuuuggaaucuuccacuacaaaaaauucaaauaagggaaaaaguagaauuccacuccuggcccggccuccaccugggauacccugagcaaagcccgggacuccccaacagcgacguccuccccaacaggccccagccucccuugacaguaccugcuggguggggccccgaggcucucucucuccacaggcacccccagccccuaacauaggguggagguggggacucagcagcaaggccugcugcuccucucugggccucaggcucccccuuuucugacuagggggaauuugugggggaaauaagcccacagcagcagaaagcgcggguaagcguccaggccucagggucaggcuccagaccgcagcccccacagaggcucgcgagcgcaauucccggggcacgcaccuuggcaaugaugacuuccuuccgcaggaucuucauggcguaguagcggccaguggccuucucccgcaccaggaugacuuugccaaagguucccuugccaaggaguuugagauagucgaagucauucauggucugccagggacagggagagugggggcagucagcgccuggcucauggcccgugggaggaaauuuuaacaaaagaaagaggaaaaccaaaagacacuguugccaaacggcuuaggcuggagcaggaagggaggcucugggcagcaacuguguguucugaagcggccuucagaccaggcucugcaggcacagggccuugggagggcugggcucugacguggggguagccaggucuucaccaacucccaggacgaaccugcaguggguccacccaagguugcucccuccccuacgggcauggagcacacccuagggcaccugccaccugaaaucaccccacccugcagggcagccuugucucucagcugagcccccugaacuguguuauggaaaccaaggagagcaggccagcacugggggugggggcaccgcaggcuggcagccccaccccugcucccagcacuuaccacuuuagcccgugccuugcugaccgccacuuccaucuccucagucguggaggagucacugggggagccacacuuguaguccaugggguccucgccuggggcccgcugcuugaggcuguuggcgaccaucuggauggcccgcauccacuccucccu

SEQ ID NO: 16507 - RNA, 3627 nt, Homo sapiens
uauuuuaauuuuccaccauaaaguuuaguugcuaaauucuauuaauuuuaagauugugcuucccaaaauaguucucacuucaucuguccagggaggcacaguucugucugguagaagccgcaaagcccuuagccucuucacggaucuggcgacugugaugggcaggucaggagaggagcugcccaaagucccaugauuuucaccuaacagcccugaucagucaguacucaaagcuuggacuccaucccugaaggucuuccugauugauagccuggccuuaauacccuacagaaagccuguccauuggcuguuucuuccucagucaguuccuggaagaccuuaccccaugaccccagcuucagauguggucuuuggaaacagaggucgaaggaaaguaaggagcugagagcucacauucauaggugccgccagccuucgugcaucuucuugcaucaucucuaaggagcuccucuaauuacaccaugcccgucaccccaugagggaucagagaagggaugagucuucuaaacucuauauucgcugugaguccagguuguaagggggagcacuguggaugcauccuauugcacuccagcugaugacaccaaagcuuagguguuugcugaaaguucuugauguugugacuuaccaccccugccucacaacugcagacauaaggggacuauggauugcuuagcaggaaaggcacugguucucaagggcggcugcccuugggaaucuucuggucccaaccagaaagacuguggcuugauuuucucaggugcagcccagccguagggccuuuucagagcacccccugguuauugcaacauucaucaaaguuucuagaaccucuggccuaaaggaagggccuggugggaucuacuuggcacucgcuggggggccaccccccagugccacucucacuaggccucugauugcacuuguguaggaugaagcuggugggugaugggaacucagcaccuccccucaggcagaaaagaaucaucuguggagcuucaaaagaaggggccuggagucucugcagaccaauucaacccaaaucucgggggcucuuucaugauucuaaugggcaaccaggguugaaacccuuauuucuagggucuucaguuguacaagacugugggucuguaccagagcccccgucagaguagaauaaaaggcuggguaggguagagauucccaugugcaguggagagaacaaucugcagucacugauaagccugagacuuggcucauuucaaaagcguucaauucauccucaccagcaguucagcuggaaaggggcaaauacccccaccugagcuuugaaaacgcccugggacccucugcauucucuaaguaaguuauagaaaccagucucuucccuccuuugugagugagcugcuauuccacguaggcaacaccuguugaaauugcccucaaugucuacucugcauuucuuucuugugauaagcacacacuuuuauugcaacauaaugaucugcucacauuuccuugccugggggcuguaaaaccuuacagaacagaaauccuugccucuuucaccagccacaccugccauaccagggguacagcuuuguacuauugaagacacagacaggauuuuuaaauguaaaucuauuuuuguaacuuuguugcgggauauaguucucuuuauguagcacugaacuuuguacaauauauuuuuagaaacucauuuuucuacuaaaacaaacacaguuuacuuuagagagacugcaauagaaucaaaauuugaaacugaaaucuuuguuuaaaaggguuaaguugaggcaagaggaaagcccuuucucucucuuauaaaaaggcacaaccucauuggggagcuaagcuaggucauugucauggugaagaagagaagcaucguuuuuauauuuaggaaauuuuaaaagaugauggaaagcacauuuagcuuggucugaggcagguucuguuggggcaguguuaauggaaagggcucacuguuguuacuacuagaaaaauccaguugcaugccauacucucaucaucugccaguguaacccuguacauguaagaaaagcaauaacauagcacuuuguugguuuauauauauaaugugacuucaaugcaaauuuuauuuuuauauuuacaauugauaugcauuuaccaguauaaacuagacaugucuggagagccuaauaauguucagcacacuuugguuaguucaccaacagucuuaccaagccugggcccagccacccuagagaaguuauucagcccuggcugcagugacaucaccugaggagcuuuuaaaagcuugaagcccagcuacaccucagaccgauuaaacgcaaaucucuggggcugaaacccaagcauucguaguuuuuaaagcuccugaggucauuccaaugugcggccaaaguugagaacuacuggccuagggauuagccacaaggacauggacuuggaggcaaauucugcagguguaugugauucucaggccuagagagcuaagacacaaagaccuccacaucugucgcugagagucaagaaccugaacagaguuuccaugaagguucuccaagcacuagaagggagagugucuaaacaaugguugaaaagcaaaggaaauauaaaacagacaccucuuuccauuuccuaagguuucucucuuuauuaaggguggacuaguaauaaaauauaauauucuugcugcuuaugcagcugacauuguugcccucccuaaagcaaccaaguagccuuuauuucccacagugaaagaaaacgcuggccuaucaguuacauuacaaaaggcagauuucaagaggauugaguaaguaguuggauggcuuucauaaaaacaagaauucaagaagaggauucaugcuuuaagaaacauuuguuauacauuccucacaaauuauaccugggauaaaaacuauguagcaggcaguguguuuuccuuccaugucucucugcacuaccugcaguguguccucugaggcugcaagucuguccuaucugaauucccagcagaagcacuaagaagcuccacccuaucaccuagcagauaaaacuauggggaaaacuuaaaucugugcauacauuucuggaugcauuuacuuaucuuuaaaaaaaaaggaauccuaugaccugauuuggccacaaaaauaaucuugcuguacaauacaaucucuuggaaauuaagagauccuauggauuugaugacugguauuagaggugacaauguaaccgauuaacaacagacagcaauaacuucguuuuagaaacauucaagcaauagcuuuauagcuucaacauaugguacguuuuaaccuugaaaguuuugcaaugaugaaagcaguauuuguacaaaugaaaagcagaauucucuuuuauaugguuuauacuguugaucagaaauguugauugugcauugaguauuaaaaaauuagauguauauuauucauuguucuuuacuccugaguaccuuauaauaauaauaauguauucuuuguuaacaaugccauguugguacuaguuauuaaucauaucuaaccaacuguagguguucuuuccugauaacuuuuuuaaaaaaucaauaaauuauuuuuagagcag

SEQ ID NO: 16508 - RNA, 431 nt, Homo sapiens
ucuuccuuucuccgccaucgugguguguucuugacuccgcugcucgccaugucuucucacaagacuuucaggauuaagcgauuccuggccaagaaacaaaagcaaaaucgucccauuccccaguggauucggaugaaaacuggaaauaaaaucagguacaacuccaaaaggagacauuggagaagaaccaagcugggucuauaaggaauugcacaugagauggcacacauauuuaugcugucugaaggucacgaucauguuaccauaucaagcugaaaaugucaccacuaucuggagauuucgacguguuuuccucucugaaucuguuaugaacacguugguuggcuggauucaguaauaaauaugugaggccuuucguuuuuaaaaaaaaaaaaaaaaaaaaggaaagaaaaagagaaggugagaaagaa

SEQ ID NO: 16509 - RNA, 1371 nt, Homo sapiens
gucccgcgcagaaacauuucagugugaauuaaauaagcugaaaacaagcccagagcucaaucuuacuucuacuagcaacuacggcucucggggaggcugcucagaccgccgaguccacagcagcuacaaccgugguguucuugauuuuauucugcagagugagcucuccacguuugcuuucuggagggugaguggggaugcagaugggugauuuuaaguuaucugcaaacagacacucagacagagagaaaaucugagguuggagguaacaugcauggcuuaaggccgacuacgugcuggcuacuuuugaaagugugccguguguguguguguguguguguguucgcgcgcgcgcgcgcgcguguguguuggcgaagggggggcucucuuuuuguuucuuuuacuuuuuaacaucuauuuugcugaccuguuuggcgaacacggcuauaucuucauugaaugacucugacgagcagacguccccgcccgccacccccggcucgcgggggguacaaguagcuaauucacauuucucaaaaaucagugcuaagagagggaagagggggugucugcaagaaaauacaacagucacaaacaacauaaugguuaguccccagucaauggaaaaaggugcccaagaaaaacagcuggaggagcaagaggaacagacccccucuccgauugugucaucuacuuuuuuccuuuuccucccccucccccagacccaggugaccgcucaccuccccuuccuccuggagcccugaagucggaggcccugagccauggacgguaucugaggaucgguuuagcguaucuggccggagaaauuggcaacauuugcuacgaauaaaacccaagcguuuccagcagccauuuugaauuaaguuucccacccgacaagcccucguccccuccacugcacauccaggauccgguggaggagaaaggcgccgggcggagaguuggggagggcugguuccugcggguuccuccuaggcggccgcgcgaagcccaggcucgggggaucucgguggcaggcgcucagcuaacuuggggaaaggacguccauggccguggggccgacugucaacgggcugcaccuagggaucccaaccccaaggcccucggagagccgggaggcuccuccucagcuccacgcacauuccccucccuucgcugauagcccccaccgccccccaaagaaaguuccuucaaauguuccugcaguagagccuuucauuuugucucugcgaaguggcaaagcagcuaguauugcgaggggccuagaugucgcuugucucagcccauaaaaaagaaaaaaaaaaaaaaaagaagaagaagaagaaagaaagaaaagcuucuucuaaugcc

SEQ ID NO: 16510 - RNA, 1371 nt, Homo sapiens
ggcauuagaagaagcuuuucuuucuuucuucuucuucuucuuuuuuuuuuuuuuuucuuuuuuaugggcugagacaagcgacaucuaggccccucgcaauacuagcugcuuugccacuucgcagagacaaaaugaaaggcucuacugcaggaacauuugaaggaacuuucuuuggggggcggugggggcuaucagcgaagggaggggaaugugcguggagcugaggaggagccucccggcucuccgagggccuugggguugggaucccuaggugcagcccguugacagucggccccacggccauggacguccuuuccccaaguuagcugagcgccugccaccgagaucccccgagccugggcuucgcgcggccgccuaggaggaacccgcaggaaccagcccuccccaacucuccgcccggcgccuuucuccuccaccggauccuggaugugcaguggaggggacgagggcuugucgggugggaaacuuaauucaaaauggcugcuggaaacgcuuggguuuuauucguagcaaauguugccaauuucuccggccagauacgcuaaaccgauccucagauaccguccauggcucagggccuccgacuucagggcuccaggaggaaggggaggugagcggucaccugggucugggggagggggaggaaaaggaaaaaaguagaugacacaaucggagagggggucuguuccucuugcuccuccagcuguuuuucuugggcaccuuuuuccauugacuggggacuaaccauuauguuguuugugacuguuguauuuucuugcagacacccccucuucccucucuuagcacugauuuuugagaaaugugaauuagcuacuuguaccccccgcgagccggggguggcgggcggggacgucugcucgucagagucauucaaugaagauauagccguguucgccaaacaggucagcaaaauagauguuaaaaaguaaaagaaacaaaaagagagcccccccuucgccaacacacacgcgcgcgcgcgcgcgcgaacacacacacacacacacacacacggcacacuuucaaaaguagccagcacguagucggccuuaagccaugcauguuaccuccaaccucagauuuucucucugucugagugucuguuugcagauaacuuaaaaucacccaucugcauccccacucacccuccagaaagcaaacguggagagcucacucugcagaauaaaaucaagaacaccacgguuguagcugcuguggacucggcggucugagcagccuccccgagagccguaguugcuaguagaaguaagauugagcucugggcuuguuuucagcuuauuuaauucacacugaaauguuucugcgcgggac

SEQ ID NO: 16511 - RNA, 1679 nt, Homo sapiens
auauauucuaaacuaauaguugaaguacugagugcuggaagaggucuggcgaacgugcucuagucacuaauagcaaacauuuaccuuugaagcaacaggaugagucacacuggccaugcuuagcauccauguucgacuggauaaaggggcauauuuugugaaaaccuucaggcaaaaaucuuacugauuauucaaaaauaaauauuuuaacauuucauugagcuaucuaaugaauaaggaaaacaucgaaggcuuccugcggcgcagaaagaauucuagcagcgucaaaaacauaaaggagcaaagaacaagaggaagcugaaggacgccugcugaguaguuauucacuugugaauaucugaaaacgugcuuuucugugcccuuauuuaaaaaugaaaaacaaauaucaucuuucuuuguccuuuuaaaaaaauuaacgucagaauauggcuaugcuagcuaaacaucauuuuuuuuuuuccaggcgauuuaugcgagaaagggccaauuugaacacugguaacuagugggagaaauaaacuuauaagccacaaacacaucgguucgcaaccgagcccacagccccgcgaggcgccccuucuucccagcucccggaggauaacuucauugacuggcaggucggcggccacuucugggagggccacuguuuaccgaaugagaaccucucauggcacaguccuuacagcagggcugcccugucgcccuugcgcguccgggugccgggucccggcgguguucugcagcgcgauccgguccccgugcccugagccacccagagcccugggccugccugcacccuggggcgcgcugacucccugggucgggugggggucccggcaggaugcacuuccagcugcgggguccgcggaguuugcucgcaccugguuuggcgcagggacguagguuugggggacuguguccccugggaagagcaaaaggugaaaagguccccucucccaccagugugccccauccccgccaguuuugacugcgauccuauuuuucucuuugggggucgccucagccugugccggagggaguugggaguuggucaggcuugggcagcgguggguggcagcccgggagccggagcaggagcgcgaggacccgcggacuggggcgcagcgacgauggcgcaccggcuucugucuucugcugcuuuggggcugagcauccgagggcgccuuucuccccagcuggacucggggacgccggaucaccccgccaccugccucuuggccuaauucuggaagcuucucgccuccguuccuggacggcucuuccucaggggcagcaaugagccccggggugcgcucaucuccuccgagaucaauugcucuacgauuccuuuuaggacuugcaggggggagagguuggggaccccggccccagaguggcuccugcggcacggcggcccacucggaggggucgcaacaagcgcgcauuuguggccaagguugugauuucaggugcgcuaaugggaucagacguccugggagaagcgugaggggauuggugccguuccuucucccggcuuccagcggccgccggguggaaguggggacacaggagggccgcgcuacgggcgcccagcgcgggcgcucacaccucuugaggaggcguggaacccagcgccccagguggggguagggcgcggg

SEQ ID NO: 16512 - RNA, 32660 nt, Homo sapiens
uggcugcaggaaauagaucguuaugccagugaaaaugucaacaaauuguugguagggaacaaaugugaucugaccacaaagaaaguaguagacuacacaacagcgaagguauguuuaaaguuuaauuuucauacugaauuugaagguguugaauuauguauggguucugcaguaacaguaaggccacagccuuuuaaaaauaugugcacuagaauacugugacagugacaauuuguguagcaucuguuuggauccaaugaacuuaguuccucacgcuccauuauggaugguagaaaugcacuaagaauuagugaaaaagauuuuucaguguuaauugugccucauuauucucuuaggaauuugcugauucccuuggaauuccguuuuuggaaaccagugcuaagaaugcaacgaauguagaacagucuuucaugacgauggcagcugagauuaaaaagcgaaugggucccggagcaacagcugguggugcugagaaguccaauguuaaaauucagagcacuccagucaagcagucagguggagguugcugcuaaaauuugccuccauccuuuucucacagcaaugaauuugcaaucugaacccaagugaaaaaacaaaauugccugaauuguacuguauguagcugcacuacaacagauucuuaccgucuccacaaaggucagagauuguaaauggucaauacugacuuuuuuuuuauucccuugacucaagacagcuaacuucauuuucagaacuguuuuaaaccuuugugugcugguuuauaaaauaauguguguaauccuuguugcuuuccugauaccagacuguuucccgugguugguuagaauauauuuuguuuugauguuuauauuggcauguuuagaugucagguuuagucuucugaagaugaaguucagccauuuuguaucaaacagcacaagcagugucugucacuuuccaugcauaaaguuuagugagauguuauauguaagaucugauuugcuaguucuuccuuguagaguuauaaauggaaagauuacacuaucugauuaauaguuucuucauacucugcauauaauuuguggcugcagaauauuguaauuuguugcacacuauguaacaaaacaacugaagauauguuuaauaaauauuguacuuauuggaaguaauaucaaacuguauggugauaaguauuguuuugauucuuaugguuaaagggaaauagagccuugcauuauauucaacacagccauuugugugugcacaaugcaaacuaagguauucuagaccuaucuuagagcagcauccaguauuugcuuucuagauaauaugcccaauaacaugaccuagaggggcuucugugcuguguagggauuuaaccaacuucagugguucagggagcucaaacuauauguaaaacaaguuuagaauguaugcuaucuagcccguuaucucugauccuucucuaaaaccauuugaaauagcuucauugaucaacauuucauaaaugcaucugugguagagguagaaagcagcaccuuuccuaauuggcaaaugaucagacuaaugugugcuaauguuuuucuuccaugcuuucagucagauucaacuauuuuauccuccacaguugcuuaacuugguguuggaggaggguuuaagcauuaagauaggaagcaggaaauuugauugcucuaaauuuagaaauuauaucccuaaaaauuaaaacaugaauacugggugguaaugauaauugaggcaaauguauuuauuuuggugacauuuugcauauaugaagauuuucugaaauaggaccuucaagauccuaggggguuuuguuugguuuuuaauugugaggaauaaaaaaucuucugcccacacuggcauuuuaaggugacugaggucaaacguuguuuccuuagguugaaauagcagccaaaacauucuucacgcaggggcuugggauauggcugcuggcaacacauuuuguugugggcuccuuaauuuaaugauaaaauuuaagcuaaacacaagccaaaaaugaauagguuuuuuuaauuuuuauuuuucacuaaacaggcaauugaaauacaugguacaaaaauaagugguaagauaauuguaaaaugaaauggacagaauauucaauuuuccaucuaugaaaauuucacaauaaaaaucauaguuuacuuuguauuauaggcgugcuugguggaucuauucauccucacauaaggcaacugacaaauuccugaaguuaccaauaguuauuuuggugaagaucuuuaaugcuucagaaguuuuguuuuugccuuaauacaguauaaagggggaaagaguucagaaacuauuuucuaaaguagcuaaaugacacaaaacaaaugucaagauacugugaugccaugccgugcacuucauuuuuacacaguaaaaguuguuuaaauugucagcuuauucuuggugaguuagcggaaacauuacaugaacuuaagaugagcauauuuacagacuuaaguuuggaaaauuccagcguucuuuuccccauggcaguaaagauugggauuuacaacaaauuucagcaugccuuaagauuugcuucuauguauacgccaauaaaugugguucuggaaaaaauauauaccccuuuauacccccauuuucaaguacaaacgguucaaagcuacuacagguuuuaauaaucuguucacuuaguaaagggaauuaccacuuguucuaaauauaaggugcugccauaaauuaguuuacauagugaagaagaguguucuuaaaucuaagcagcugcacacucugugaaauccuuucagaaugauagucauuguggucugagcaguaauuuccuauucuucgaccuuggauugaauuucccuuagccuacaucuugccuuuccagcauaucuuaccucaaaccuucuuuguguuccauucccaccuaagcuucaaaauagccguguugacgucgucuuccauuugcugagcuuaccuauggaucuccaagaacccagaucuugaaacugcugauccagcuuugaguaucaucacuucccuguggauuuaacuuccauuaauuuuaagggacuacuaaguuauuccaguguggcaucacagugcaguuagcaagcucagcuacuugacucuaauuuggccauguuugcucauagaaaugcugcuggcagcaucuuacuaggcugaaacaauuucagcuugauuuuuuuuuuuugagacaagagucucacucuguugcccaggcuggagugcaguggugccaucucagcucacugcaagcuccgccucccggguucaugccauucucaugccucagccucccaaguagcugggacuacaggcgcccaucaccacgccuggcuaauuucuuuuuguauuuuuaguagagaugggguuucaccguguuagccaggauggucucgaucuccugaccuugugauccacccgccucggccucccaaagugcugggauuacaggcaugagccaccgugcccagccuucagcuugaguuuuaagguaagucuuaaacuuaaagcacggcgguauaauuaacaguuguguugauacucuucaguagcauucacagccagguccagggaguuagcacccuuuagucucaccuuauucagaggaugaacaaaaauaucuuagaucaucucuagguaagguaguacuuucuugggaaacaggguauuguguaacauucugugcaaauuccugucaguugaagcugauuauuaguugaaugggaauagaaugccacauucugcauucaauuaguauaauauuggccaauuuguuucuauaggguuuucaucuccaacuuuuaugcuaauuaauacacuucuaugccugucaaauauuaguaaauaaauggguuuaauuuccuaagggcuauucaguaacauacucaguggaaggacauguuccuacuuauaaauguacaucuaagagaagguaaaauauaucaauuuaagaagaggccgucagacaucucuaccuuuuuaaccaacucuagguuuucaagaauguuuuacauacagguuuauaauugacaauuauuugcuagagugguuuuucccuuuuaaagucucaguguguauggaacuaagaugauuaauauggcaaacucauaagccauuuuaauuuugaucaugcccuuaagcauuaugauaaagcauaccacagcagcaucaggcacuugaaauacugcauuuuauguguagcuacuguugaagagcuaaucuuuaaagaauuuaauggcuauuuuccagugacuauaaagucucagaaauucugaagcagaaaagucacauuaauaauaggacuuuaguuuccauuguuacugugcuuuccuccuuccagguucauucauggcccaacagaacuuuaaaagugcuuuucuguagaaucugcaguuaccagcaauaacugaucaucuugcugcaaaaagcuauagaauugaugcuuugaaugguugauccauaguuuuuuuuuuuuuuaaucaaaguacuuaugugucaaugccaaagcaacgaagaauuccccuuuuuccuucacuauugacagcuucaguuucuguacuuacugugucauccuauccguucccuucccugagccuggacugcucuuccaagggagacuaggagugaagggaggaguccucccaaaguuacccuuuaagcuugauaauuagcuccauagccaugcuaaagcaugacuguagauccccaagucccugacacauuuucuucuaagaaacugguuagccaagaaaguaaagacguaagcccugaagauggcaaaaggugucauaaucucccaaagucaucuguauagaugcuucauuuaacccuuuuucuuuugcagacaaaggguuaaaaaucucuucuuucuaccuauaucuuuaaagagggauugacaagcccaaauuuccuuuuaugaaaagacccaagguuucuggccaacaauucacuuuuuucagucucuuagguccucuugcaugccugagaauauugaguauucggaaucuccuaccagcccuugguaaaugacccuaccagguggaauaguuugagcuuuaucugcucuuuuuuaaugggauagaggggaaggcaacacgucuuauuuuaucaaaaauugcaaagcuacacgcucuuuguggagaagcaccaaaaggaaaaccuuaguuuggaaggauucauuguaaauaaaaauaguaacucagcccuccauucagggaggagaaaggcauuuuaaagcuaguauauugaagguuucccccuugacuucaguguugaauggcucuugcaaggacuucuugaagguuuuuuuucucacuagccaguguuuggccgacagguugcaccucugccugagaagaugccugaaagagaaaaggcagcauuuguuacaggcauaauguuguagaggaagaaacgacaacagcaguccccugcauucauuuuagaaccaagaugacgucucacaguugcucugauaaaaacacagggacucccugcucuuagcauaccuauagugcucaccuagaaaaucuaugaguuaagcacuacaaacauuuuguuguaggagcgacguacgacaguccaauugcagaauuaugaaaagcauuggcaguagcaacucugugguggacacacccaccuuugcucuccuagcuccuuuucugucauucuguuugacuuucucaagggagcaaaagaaaguuguacuaccaguuaagucuccaaggugucuuuaaccccuccaucccccuagccuuuuuggaagggaguggugugggagauauguggagacccuuugugcagggcaggggugguggugcaaaguuaucaguaacucuggguuucucuaagcacuuggugcugucagagaugcuuggagauggaguaccaaaugagcuggggagaagauccugcagaacagggguggccaggucauggccccauacuggaaaaguguaccugugcagaaauaaaguagguguacagauaaguugugcugcucuugucuugggauggcaggguugguggugaagaaagugccauagaaauggcagcacagaggcacccucauccucagcaggcagcaggggugaacaguaauggaaagcaccgcagugagccuucaucaucauaggaagaccagcaacuccuuuuuuaguaccauuggcugucuucuuccaguaucucauuuguuuaaauaauaguucuuggcucaacaagcuucuaaguaguggccaacuguuacagcaggguuggugggcaaauuuucuuuuugaguuccuccacuuaccagguuaaaccccuucacaugggugcuccauugccgccaugggcuuuuugucagggauaagggugcagccagccagcauguccagagaggccaagauagagucauacaggcgaucugcguggcucuccagcucaccagacugcuuugcgauccucccaaggacauccucuaaaacuaacaaugagguucaaagaaauuaaaccagaaauaaaacccaugcaaguguuguccaguaagcauuuucaaaagaacauacaaggguauaguauuuuacacaaaguaggaccuggcaguaguuucugaaugucugcccuuuuuuaacagugauucuccagggacuucuguugcacuggagaaccuauguuguuaacuucugauuaaagcuaagaaaagaacucacugacuccacuuugaaauuacguaauucacagaagggcacagagauauuaugguuuucugauggcugguauuaccugacuuuagagguaagacagguaucucuguaagggcacauccagauccucuugggcauaaggcuuaaauaaaacgacaugccaagguucagaugcuuaccccugcuaccaggucuaucaguuucuauuggcugggaagaauguuauuucacauggguggucuguaauagauuugggagugcuugagacccuuuguuuugugggccucagugaacagacugaaaaagaaaaugaccuggccaggcgcaguggcucacgccuguaaucccaacaacacuuugggaggccaaggcggauggauugccugaggucaggaguuggagaccagccugaccaacauggagaaaccccgucucuacuaaaaauauaaaaaaauuagccgggugugguggcgcaugccuguaaucccagcuacacgggaggcugaggcagaauggcuugaacccgggaggcagagguuguggugagccaagacugugccaucgcacuccagccugggcaacaagagugcaacucugucucaaaaacaaaacaaaacaaaaaaaugacccgaaagcagucuaagggaagauucacucccgcagugucagaauuguuguucaugugaggaagggaugggcuagggucagagugcaucucacacagcaggcuuuuuucuuucuuuuuucaaaaauuuauuuuuguuaagcacaaaggcugucuuaguuuccugcaccuuuaucagcugugcuuauacucucccuaguuuccugccacagcuguaacaucugucaguagaggaagggaaagaggaagcuuaucugcagacaaugcugacuggaugaguagaaggagaaggaacacaggcuggcuguauugagaucuccuagggaagccacaucagugcggugucaucagggcaaagugcuguccacaaagagaguuggcagaguguggcagaggauugcagucaggcgcacgguaaagcuuggcuguaaggguggcugggcuggguucuacccuccaguuucuuuuuuuuuuuuuuugagauggagucucacucugucacccaggcuggagugcagcggcacaaaucucggcucacuaaaaccuccgccucccagguucaagcgauucuccugccucauccuccccaguaguuggaauuacuggcgcccaccaccacgcccggcuaauauuuguauuuuuaguagagacaggguuucgucaugcuggccaggcuggucucgaacuccugaccucaggugauccacccgccuuggccucccaaagugcugggauuacaggcaugagccaccgcagcuggcuaaccccucugguuucauuagaccuuugcccagucuucuugugcgaugucacagaaacauugguucagggacaacuuuauguuuuugaacuuuuauuuaucuauuuauuuugagacggagucuuacucuuguugcccaggcuggaguacaguggcgugaucucggcucacugcaaccucugccucccggguucaagcgacucuccugccccagccuccugaguagcugggauuacaggcgcccgccaccaugcccagcuaauuuuuuuacuuuuaguagagaugggguuucgccauguuggccaggcuggucuugaacuccugcccucaggugaucugcccgcuuggccucccaaaguguugagauuacaggcgugagccacugcgcacggacgcuuuugaacuuuuauuuagacugucagaauguuugguuggggccaaauaaaagaaguugggaaggacuggaacaaaacauguuuguaggcuggcucuauggacuuuugacagcaugcuccuggcggaagaaaaguuaaguuuugcacccgcuggagacagacacugacgucucaagggggaaacagccacauuccugauuauuucaagcagauggauggggaagggcugugugucaaucugaaagagccuggauacauaucugaaaaccaaagaaaaccccaaagccaguaaaaaaccucuugagagagcaaagugggacuaagcacagaaaaguauuauuaaauugauuuuaaaaugaaggucaaaaaaccugaagcuuuuaagaggccuuuuuuuuuuuugagaaggaauuucgcucuuguugcccaggcuggagugcaauggcgcaaucucagcucgcugcaacuuccaccuccuggguucaagcgauucaccugccucagccuccagaguggcugggauuacaggugcuccccaccacgcccagcuaauuuuguauuuuuaguagagacgggguuucuccauguuggucaggcuggucucaaacucccgaucucaggugaucugcccaccuuggccucccaaagugcugggauuacaggcgugaaccaccguguccggacuagaggccuacuuuuacacauggccucugugaagagaggagccgcucaggccucugcaccuccagacacugggaagcugcggaaagccagugcccaggggcucugccaggcugccacuucuccuguggccuguggcaaauccacaacuauccaucucacagggcugugauuaaauggagaacacugaugugccaacugcuucaguaaaaugcugguguaaauuacaugcagcaaaggagcuuggcacauggaauuucugccccaauaaaaaaucuaagaacccuagugaaaaugccagaagagccaaaacaaaggccuuaaaagggcaggggauugcaaagagcucauauaauucacacuagagaaucacuuaccugcugaaaacuauucaguggucccuguccacugaugccucucaacccuagagauuuuucuucccaggguacacuuagcaauguguagaaacauuuuggguugucacaacugugggggaagcagggauuuacuggggccaggggugcugcuaaacauccugcaaugcauaggacaauuccccacaaaaucaugcggccaauauggcaaaagcgccaaggcugagaaauccugcuguacacccuucacgguaugcaccugcccaccaugcuggucaggaaagugccuccucauugccucucaagcccgugggaccugcccagcuuugcuucggcgguuguauuccaguauaaaucccaucucacucaaaaauguaaaaugaggcauaauauaggcaggcugucagcacuugauuuacagucuugcaggaaauuaggggcugccaucaguucaaggcuuuacccuaccauucucuuagcucauccucccuaucauauccucaucccccaugcccucguccuguaaagacaaugaaaacuguaaauccuuggcacccagcaugcuuagauacaugccugaggucugugauuuucacuuuccuaaauggggaacccauccuacaaaaugggcucaaguggcugggugcaguggcucacgccuguaaucccagcacucugggaggcugaggcaggcgaaucaccugagauagggaguucaagacaggccugaccaacauggagaaaccucaucuguacuaaaaacacaaaaaaaauagccgggcaugguggcgcaugccuguaaucccagcuacucaggaggcugaggcagaagaaucacuugaaccugggaggcaggugaacuugcggugagccaagauggcaccacugcacuccagccuuggcaacaagagcgaaacuccaucucaaaagcaaaacaaaacaaaaaggggcuugagcuugguuugcacacuacugccacccuguccccucucaucaguucuucauucaaucuguucccugaggacagacugacuguccucagauacuuuugagcaauacaauccuuuucugaaacaacuauuuccccaaagcaggacacaaggcagauaaucagagaggaauucaaccugggcuagguaagguggggaaccaaagggauacccacuaaauacccuagccacaaacuaaggaugguggauuaauacuaggauuccuacccagacuaccaccagaaaaauacaaaagcagaagcaaaagacagcgucauucuugcaggcucaaugccuaauuuguaaugggcuugguuuuauaaccaugacugccucuaagcagguguguaggggcagugaugggcagcgacgcguggagcuggcagauggggcauggggcaucucgggcagugggugugggcaggggcucuugugguaccagcuccuuaccagggauagugcggucccugggccugcugcugacagggauuaagcucuggcuaaauccaaaaccuuaagcaucucaccugggguguucuccaacaggcacugaagaagaaucucccccuucuguaagacacucuccgucagagacugauguucaucuauaucuuucuuaaauugcuuaaggcguaucagaaaaagaaaaggcagaagcuucguuacuauuguuuuguaaacguuauuugaaaagcacagcauguagggaagccuuauuccccucuaauguguaagauucaccccaucaggucugcagaauuccccaaguaaacagugcaacaguuuaacuucagcuucuuugaacccaagguaaauagagucaguaguuuuuccuguuuaguuugacaucagaagcaucuucccugacagaggcuggcucacaaacagcuuggaguuagggucuccuucuagcgcccucaccucaugggguucucuuuuaauucagggcuaugggagucucagaauuuauuccauucuaauggaccacaggagaucugccauuaaacugaccgcagggagccacugucucuaccucugcuccucccuccaugucuuugcucugugcagaccacagggguaacuaccucaacaucugggaagcugugaguuucccaagcaacucauuugcuuuccccucuuggcuaccgagcugguguucuugauguuuguuuagcaguuaagaaguguaaagucagccaggcgcgguggcucacaccuguaaucccagcacucugggaggccaaggugggcggaucaccugaggucaggaguuugagaccagccugaccaacauggagaaaccccgucucuacuaaaaauacaaaaaaauuagccgggugugguggugcaugccuguaaucccagcuacucgggagggugaggcaggagaaucgcuugaaccugggaggcagggguugcagugagccgagaucacaccauugcacuccagccugggcaguaagagaggcuccgucucaaaaaaaaaaaaaaaaaaagguaaagucaaauccaugaccacccuuagugcaagguguagaacuuggugacugauuuuuauaaauuuuuaaauuuuuaacagaaauagagacagggucucacuauuuugcccaggcuggucucaaaccccugaacucaagugauccaccugccucaggcucccaaaguacugggauuacagguaugagccaccgugcccagccagaacuugguguuuuaccauuuugaagugauaguuuuacccuuggauuuacuauuuuccugucuucaguuuuccuuuacccugauaccuauacuuauuauuuuauucucuaguacuguagugugguuuaugugcugcugcaaccccguguuaagacaaaauacaaguauauaagaaaaugagucacaguuaaaauaugugaacacagacacgcucgcuuauacuaggucuuaauccaagcaggagucaagauagcacacacauacgcaugagccaugcacaauucugugcgggcaaggggcuagcaguacagucccacuuugugacagcuguaugggugacacaagaggccuaugccucacugaccugcacgagugacucccagcucaaaucucagcucuaccuacaaagcaagcugguuguuuccgucuagccuagaagcugagguacagaaggcuggcaggagggauaagacggagggauggaauuauucuguuugcaccugcucugacaagccaggaaaggccacuaagcuaggucuaccagggcagcuuccucucucuguagugguacugguccugggcccugcacagcugcgugcaugcacguggagucugcauacaggacccuuggagucagccuuucucuccuuccucaagcucacuccacccuagugggaaugcuguuuccugcaguguggagaggaacucauuguggaguuccucaaagugaggaacucaaagcaaccucucuccacacugcaggaaacagcauucccaguaggguggagcagcuggcccagccugcccaggucaagcaaggcuccucccuacacuuuaguuggccccaaguuggaaaacaaagccccucccuuccucuagcuggaguacggucccaggaaggcccucagucagcucagcccuggcccaagcacauguaaauuguguccucugcugcugaagauauggucagguuauaagguuguaggaauucaaagaauuguuuuagaaaacuccuuccagacuagccucaggcucagaccauggauaucccucugcuucuucaugaagagauuagaaaggugcagccaaccagauaugcuagaaggcaggaguucagccaagguuaacguuagacuuagggaugacaacuauauaauuuauccuccaauucaggacacuucugagacugaaaggggaccuauuauuaugccagaacaacaggcacaaacugggacgcagucauccuaaaucuaggaccaaguuaacaaaaauccacauuaguauuuucaaaauaacaaaaucuuaaugaaaaagaaacaagaaaacuaaaaccaaacccaaauacauacacacgcacacaaacugacgucagaguuuuuguuuguuuuuugagacggucucggucuguggcccaggcuggagugcaguggugugauuuuggcucacuguagccucugccugccggguuccagugauccuccugcuagugcaugccaccacacucagcuaauuuuuuauguuuuuuuuuuuuuuuucuguagagacgaggucucacuauauugcccaggcuggucuggaacucccgggcucaagcgauccuccagccucagcaucccaaagugcugggauuaauagugugagccaaggugccuggccuagauuucuauuuaaauaccaucaaaaugcccuauuguagauucuggagucaguacaauuucagcucagaucuuuaaauaguggugcaguccaauaggacuuuauguggugauggaaguguucuacaucugcacuguucuacgugguagccacuagacaaaugugaugguugaacaugcagaauguggcuagugcaaauaaaaaaaucugagucuuuaauuuuacuucaauagccauacauaacuagaggcgucauaauagugcaagucuguauuuauaaucccugagacauuuggaaaauuauauugcaaaucacccuaaaguauuuuuguuuuuaauuaagaaaaaacuuuuuuuugaggggggggggucuugcuauguugcucaggcuguacucgaacuccugggcucaagcaaucuuccugucucagcuuccagaguagcugggauaaaagacuugucccacugcaccugccagcccaaaaccuaaaguauuuuugauuugagauaaauauauuguaucuucaagcuccauuuggccugggaaauaauucaugcauuuuacaaagcguuccgcuuuaagaaugugaagcucuaauuagauuucagguauaauagucaacugagcuauaacauaccagacauugguuauuugagauuuuacuuuguaaucgaguaauuuagccacacucuugugagggaacaagccagagccaggaccgcauauuacccgguaaagcugcagagaagacuugagacuuguaagauuggaccuggcugcagucccguggucaguaacaucugcaacauuauacagccagcagaucagcucuuccagcugacagcaaaaugucugcagagacaaauaaaaggacacaugguguuacugaucgaacagcuauuuauguuaucaaaaggcuaaaaauaucaggaggacuuggagacagacugugcaccuucaguuuccucucuccuccuugcucaccugucccgacuccacgacucuguaccucccucugccaaagcaaugaaaaccacagccuggugugacaucaaaaaugacaggcugagaaaacccagccuugcagguaggaauggagcagcccagaagaggcgugccugccauggaaaccaauucuuggaucagcaccauuacuaacuagaaucagcaucuuggagccagauacguccauguuucucuggaaaagugaacguaaaauaaaugacuaaaaucaugacuaaccugaagcuauagcgaagaacaacuuuaccucauggcaucucaaucuuuuaucaguaaagagggguccaugauaacguguccuaccuaccucacaagacaaaauaaccacgucaccuccugggaaggugaaagccccccgcaagcgcuaggacacguuccuggacaggcacauuccugaaccuucaacaugucugggaaugcaccgaagcccucaacaugaauuauuuaaugcacacaacauccuaagaaggcagggcuccacauuuuacaaaugagcaaacucaagaggcugagccaacauuccaaagacagcagugccauguuucaaauucagaugccugacaccgauaacccuauuccacgcaguguucuuuauaccuccagauauuaagucauuugguucacaagaugguccgguggccacaaagucuaggcaacaguacauccaaugccccuaacuuugcacuuaaaccacuguggcaaaugaagcucuagaaguccugcagucaagaaagccacuuaccuuuguuuagcccaguguuuccuaaaggcaucugugcacaaaaccuuuuuuguucagaauaccucugaguuaggaagcagccaaggguaguggcuaagagcucagccucugcaaauagucuaccugggucucauucuuggcucaagcccuugcuaauuauaagugggcacguuaccuaaccucucucugcucuuuccuccaaaaaguaaaaugagaacagugcuuaccugguaaaaguugugaggacugaauaagauaagguacagcacaaugccuggcacauaaaaagugccuggucaacaugaacauguuuuauuaugauguuaguggauugggggaagagacaagacaccuguacacaaagcuuccuaacguugagugucauuaccuucacacauugcaccagugauucuuuucccuguucuccuccuuuccugggaagcugcccuucaacaucugggucugagaauggccaccgguccaaccuagcuggcaaggaggggcguguuuucagcaguccagaggagaccccgagggccuggcugcuccccagacugccuuccccugcggagucgugggcacggacgaaggagcgcaggaaacagggauucuggcccucaggauccccagauccuuggagggcagcuccagggggaagcuggcuuuggcuggagcuugaagggaaggaagcuggcccaucacugucugacacuuccaaggggcucugcccuuugauauccccagugggcaggguaaccaagguagaaauggauccuagauacgaaaccaggcuagaaaccugugucagccgagcggggagggcaagauacucgucaucacuuuccacuuccucuucugauuuccaccuagacucugugcagguagggcgccgggcacucuggcugguccucuucucccucucuggccugggcgagggccacccucugucccguguccuuagcuggggagagcccauaucaaggugcuugccuauagucagccgguccuucgcaccccucagggcuggcucucugcgcucccaacgagcaucccuacugccuggggcucuggggguagaugcaaguuggcuccaagaugccaagcccaugccacccuguuucugggguacucuggagggccacugcuuaaggcuuggcucucugggcccagaaaauggcagggcaguggccucugcuggugggcaguugggggagacauuaguaggugauuugagggugcuugcuggagagacagagaagcuauccaggucuaccccggaguccugcaggacagggucagcuggcacacggcuaucaaggugcuuugggagcugaggcccgggccucaguggguaaguauagucaagcagaucuucauacucuuuauuuggguuccagagaggggaguggcggucgggugauggaggcagggaaucuggcagcacacaggcccaguacucagccuggaaggagaggcgucuccugccuagcccagaagcaucacccccagagaacacaggcuguggugaccacuggggccgagguccuagccccaccacagaggaagguuccugggggacgaccggcuccagggaggaggagaccuuggccagagaaccaccacgaggcuccgcccucuccuggugacccuggagacugcugccuguggaggaagcagagaugcugcagcuggaaggcugagcugcggaaccugggcucagcacggacuuccacugugacaggcaagagagaccugagcugugaggcugcuggcugagguccagugccuggggcaaaucugcuagggauggaucaucuucgguaucagcaucauguccugagcaaauaguuguuguucugggaaggcucagagucugagggaacuccucggaggaagaaagcuuggucuucuccaccugcaaugaucaaagggacaaaaagcacuuggguaaaaaucaaacccaauuucuuucuuagaugacaacccaggaguuuccuugugggucuagacaguauuuaggaaagaccuuaaaaugcaaagucugcugccugaggcaagaaccaggcaauaugcacugccagcagcagcacugagacccugccugucugggaagcaagaugacucccaucuccaguccucuccaagguucuuccuuccuccacagguauccagggugugagcaagcagaacucagacagcucugucaugcugaagcuggaaaacagucccuuaccucugagaagcgucuccuggcagaugaaacccucaaucacucugucgcuaacaggacacguccaaacccaggaggucgccccagaccccauccugcucaguucacacgccagugguaacugaacacuagcagaaugacugguucaucucagcuucuucacugaauuuuuuaucugcuugaugaagaacucacccccgagggaagcaggacagcacaguguugaaggacauggguuuuggagccagacaaaccugaggccagccccuaacuuugccaccuuccagauguaugacuucgagccucacuuuccuccccucauagcaccagcuccucagaagguaaggauuaaauacacccaugugugcaaagcacaugguaagagcuuaacgaacaacaggaauucuaauaauaagcaccggacucauccccgugaaaggccauuucugugucuguuuaugauucgcuuccugccucaccgaaucucugacucacaggugccagagccucccacugccccuugcucccaggcagguggggcccagccucuguucucucccagucccgcucagagccuccucacagggugcagccccacaaggggacccugcagcagccaaggcuacaaugacaccgagaagaucaaagccauucccaggaaaggccuuggcaagcagaacagaaaagaauguaagagcugggcagaacagaucauuccggucaccucccaaugauacugagggccugaaagaucuggugauuugccugcagucacagaaccugguaggauucccugccccaugugacucccacuaggagaagcugccuggcagucagagaagcccaaggaauucuccuuaaccagggacagugcugccuacuacagggcuccaagguucugacaugucccuugggucugaagaggauuuagguucagagcccccaggagcccaaagcccuggacacuccuuucccaagucucuucaggguaccccuaaagccuuuaaucaccaagucagaaacacggcagggcucuccuugccagaauuccccuggccuggaccucugggcagcagccucuuggccuauaaucccugguccuuaaaaagucaccagucacucuugaggaacaggagauaaccguggacaguccccccggccgguccugaggcccagcucucuagcugaacccgcaaaacagaaaucaucauacucaggccccuccaauuccucacccugcacaguagcaaggaaaggaugcaagauggugaggaaauccugaacaaacucccaaaggacagcaauggguccaucuacagucuugccuuaguaccuaccuggcuuuccccggagagcagaaggucuccagaccccaugguggcaggaggcaggccacugagugcaggcucagaccucucagcuacgggcucucuguuggcaucacuggccuguggcuggugggcucuagaggggccgccagggucagucccaauccagcaaguaggggcagguaucccuucugccccccauacaggggagaugagcccucccucagcuuccaggcgugggggcugcuccccacucaugggcccugggauguccagcucccgcucccugcagcucccucucccauaggacugggccuuugugucuucagaugcuuccgcuucugccuuuucuucacccagggccauugagacucccuaccuaggucaggguucugcugaagacuucagcuuccuacaaaacaggggaagggagagaaaaauauaaaucuucuacaucuguguucaggaagucuugcucuuuaacaauuaaggcaaacauauuuuuggucaaagaaaaaaggaaacaaauggugacuacuuccucagaggagcaccgaguuccggcuuuucccuggccccagaccuuuccaaaggggacacagaagcacaccauuuccccucugcuuucaugguggauggugccauccccaccagcagaaacccaagagggucaacacagguccaaaguccaaucaaggcugggguccugccuaagucaccuuuuugcccuuuuagcccaaccccacuggguaagaggccuggugggacccuuccugugcacaggcccauagugguucuguugucguaacgguccccucagcaagcaacucaggccuggcucugacuguucuauccuagagaacagcaagucagggcaugcccaggccucagcugggcacuggaagaaugcccuccaagaugcuuggcucugccuggcagaggaggcaggacccucucuuuucuuuucuuuuuuucuuuuuucugagacagggucuuacucugucacccaggcuggagugcaguggcaugaucucagcucacugcagccucgaccucccugggcucaggugauccucccaccucagccuccugaguagcugggacuacaggcacaugccaccacgccuggcuaauuuuucuauuuuuaguagagacaggguuucaccauguugcccaggcugggacccucucaaagcacagaaaccacauccagccuguggaacaggugagagcuacuuguuccaaggauggccagugaccaaagagaaagagaucagcaacucuccucaggcuggccuggguuaugcugcacguggugauggagggaagcuguggaaagcugguggguaacagugguaggguaaguguaacacagcaugugugcacaugagagcaagagccaaucagcaggcaggcaggcgagggagcacaggccgagcacucagggaaggaugaugauuugggagcugaaucugcaaacaggaccauuccaacacaaagagguucaggaacaacagagggacaucacccucagccuaagcaugccagcaaaaguugaugcugagagcccuggugggaugggguagggggccaaaaagccaacaggaggaagaccaaugcugggaggauguggaaggggagguaacggaaccgugaaugcccaggaugucggcagccacccggagugcacugggccaaccucaaagcuuaaaugugggcagaaauggccuuguuuccuuagucaggaggcaaacagaugguaagaggagaugcugguggagagccugcaaagggggaauggcugcgggcucaucuuacucagcucacacgcugggaaauaccaccuagaugggcacugcacacacugaggacgccuugcacuggaauccaagagggcccuucccuacucugccugauggggcaugccaggcuccagccugauucagaagugacccuggagaagagcaugcccuucgcacggacgcucgucuaguucccacaaccaccagguggggcaggaacuaaucagaaaauuauuuuugaaagguaauauacagcucaaauguaaaaugcacagcagauguaagucucucuccgcccuugucccccauuccuuugccaaaaugagccagggcaggcagaacaucuaugacagugccuggcaugguauggacacuaaguguuggcuguugucauuagugucauggggaggcauggacagaaucaguguaacaggucaccuuacaaggaaggacaaaggagccaaaugggagaaaaagcagcccauuuuuaaauacaaaucaaacaaaauauuuacuacuagauacucccacaaaaucagggaaccagccuuacuaguuuuguguaugacccuuguuuccugaugcaaauaucuauguucauccuucccccacuuuuguucccccagaaacugagucuugcuccaucacccaggcuagauagaguucagcggugugaucucagcucacugcaaccuccaccucccggguucaagcgauucuccuaccucagccucccggcuagcugggacuacaggcgugcgccaccaugccuggcuaauuuuuuuauauuuuuaguagagaugggguuucaccauguuagccaggcuggucuugaacuccugaccucaggcaauccacccaccucccaaagugcugggauuauaggcauaagccacuguaccaggcuuauccuucccucccuuuuuuuuuuuacauaaaaguagcaaacuguauaggucauacuauucagaaccuugguuuucuuuucucuacaaaaaauaucuaggggcucauuccuaagcaauacagcagguccuucaguaacaucacuugguacgauaucuuuuuuuuuuuugagacagagucucacucuguugcccaggcuggagugcacuggugcgaucucaguucacugcaaccuccgccucccugguucaagcaauucuccugccucagccucccaagcagcugggauuacaggcaugugccaccaugcccagcuaauuuuuuuuuguguguguauauauauauauauauauauauuuuuuuuuuuuuuuuuuuugagacagagucucacucugucuuccaggcuggugugcaguggugugaucucggcucacugcaaccucugccuccuggguucaagcaauucucugccucagccucccgaguagcugggauuacaggcacccaccaccacaccuggcuaauuuuuauauuuuuaguagagaugggguuucaccauccuggccaggcuggucuugaaauucugaccuuaugauccacccgccucagccucccaaagugcugggauuacaggcgugagccaccgugccuggccaauuuuuguauuuuuaauagagacgggguuucgccaucuuggccaggcuggucuugaacuucugaccucgugauccacccgccucagccucccaaagugcuaggauuacagguguaagccacaccgcccagccgguccaaugucuuuucauuauaucauugauaagaaacccugauuccugacugaggucacugucuguauggagugugcacauucuccccaugucugccuggaugauauccaguucaucuggauacucggguuuccucccacauccugaaaacauauacuuaggugaauggggcugacuacaugguccuggucugaguguggguagaugagugagcgugcccugccaugggaugaaguccugcccaugauugguucccuccuuacacccucagcugcugggacaggcuccagcuaccugcgaacuugaacccauuugaguaagcagguaaaucauaaucuuguguuuuuuuuuuuuuuuuuaagaugaagucucgguuugucaccuaggcuggagugcaguggcgugaucuuggcucacugcaaccuccggccccuggcuucaagcaauucuccugcuucagccuucugaguagcugggacuacagacacucaccaccaugccugacuaauuuuuguaugggguuucaccauguuggccaggcugaucuggaacuccugaccucaaaugauccgcccuaguuggccucccaaagugcugggauuacaggcaugagccaccacgccuggcucaucuuacuuguuuuuauucaucuuucauaaauguauguacagcucacauuuauuucacuauuuaauuuaaaaguguuuuagucuuuacuuagaaguuuggugaugcuuucaugaccagaaauaugccauaggagcuuaacucuuauuuauaucaauuagacuaugguaaaauugguuucguuauauguccuuucaaguggcagagucacgguuuccaagaacuuacugacgacaucaagugaggacuuaccguacaaagacagcuuccucuuuuucauuacugaccaguacuguauucugguguaaggacgcacuaguuuauuucaccagucccuuauuaguggacauuuggguuauuucuagucuuuuuugcuaguccaaacaaugcuaugaugagucacuaugcacacacauuugugcuggcacauccucagcaugaauugcagaaguagagcugcugaggcgaagggugcuuuugcacacacugccaaguggcccucugcugagugguaucacucuacacuccaccagcacaugugagggccaguucccacgggagccagggucuuuaauccucacgucacagauggggaaacgaagccucugagugagacaaguccaggacugcccaacuccagagcccaagcuguuuaugagccaacuggggaauaagugaucaaacaguuaagccacaaagcagaagagagagaagacugguggagggacaaagagaagagugacaaaucuugcugagacagagaucuuacggagccacauccucaccuuguggcucauuaagaaacugcacaugaagacguuuacaggcaaguuuuguuuucauaaguaggggaacagcugcgcccgugagcuagaaaaaccagggugaaggcuggguauagcccauaauucccaauugcuacuucuugcuccauuucuuuuuuuuuuuuuuuuugagacggagucucgcuuuuucgccaaggcuggacugcaguggcgcuaucucagcucacugcaagcuccaccucccggguucacgccauucuccugccucagccucccgaguagcugggacuacaggcgcccaccaccgcacccagcuaauuuuuuguauuuuuaguagagaugggguuucaccacauuagccaggauggucucgaucuccugacaucgugaucugccugccucggccucccaaagugcugggauuacaggugugagccaccacgcccggccucuugcucgauuucuaaaaacucucucaauggcuagagauuccccacaccucucacuaaagggugcgaucuugagacaaggugcuggaauaagaugaugauggggcaagggaggggugcaaacaaauuaucccuuuguuuugaucauguacuuuuuauucaucuugucuggaccucauuauucaaaaaagaagguaucuauuuagccuggagagauagggaguggugagcuauuacaaacuauucaguugacaucccuaaguaacuuacaaggauacacacaaaccuaaacuagguuaguaguguggccaaagucccuucagcaaccagguaagaagaucugaaauucaaugauuuucaaggaaauuguacgucuguaaagacggaaugaagguaguuacuuucuuagacuggauaaacagucccuucauaaucuuauuaaucugccugacaaaucaugcuuuuccccccuauuauacaaguuuauuaugagaaccaagacagacacaugugaaagaaaauaaaaaccaaucuauaaugcauucaaaacugucuaugaaauguuaccaaaaugcaacgaaagggagaaaucaguugggauaaaaauaauaggggaaaacuuccugaaguaaugacugaagacaaaccucuuuuaaaacagcaaucaugccgaagaaaacacuggcccaggcuaugauaaacgcacaaguuuuggauuccuaggacucaacccugucugcaucuggccgguggccaucuguaacacugcaugaaggucuggucuucauuuccauagauccgagauuuuacacaucauuccuccuaacccucugggguaggggugggggcgauagauucagguugcacuucuaauaagaggcagcuuauccuucucagacuggugaauagcgcuuguugucuuggacccacacagucucccaggucaucagcuuuaaacaauuuccuaauguggggccucccguucucggaucacacauuuuacagugcuccuggaggcuagcagcuccaugauggggcacaggcccccgucgccucccaaaugaaggaagugccaggagguuggacugaaugacaggagacaucagagcacagacagugaacucaaccuuacccucugagaaaggucuguacacaacagaacugccuuguccuuugucaaaccaagagacaagccacauaagcuucaggauauucuagggaccaucuggacuuugcuauuaaaauucuguuaguuuccagaaccugaagaggcuguaugauccaccagauauaauuaggagugauguaggcuuggcuuacucuugcccuacaguaaaaauacgcccacaaaucaugcaugugguaacacaaacucuaagccuggacaucugacccuucuucguauaugcugcaucacccuaggacacuccugucacagcugccgggcuuccucccacucacuucuguccaagauggagagaggaggacugggaacugugggaggggugaggcucugcucuugcucuugacuaaaccccucaaacagaugaaugaucaacuagagagcaauccuccuuucaacaaaaaaggaccuccccuaggacuauuuuuuuuuuugagauagagucucgcucugucgcccaggcuggagugcaguggcacgaucuuggcucacuacaaccucugccucccggguucaagggauucuugugccucagccucccaaauggcugggauuacaggcgugcaccaccaugcgugguucauuuuuuguauuuuuaguagggacaggguuucgauauguugccaaggcuggucucgaacuccugagcuuaggcaauccacccgccuaggccucccagagugcuggguuuacagauauaagccaucacgccccgccucuuuuuuuuuuuuuuuuuuugagauggagucucacucugucgcccagguuggaguacagcagcgagaucuuggcucauugcaaccucugccucccggguucaagcaauucuccuggcuuagccuccaaagcagcugggacuccaggugcgugccaccauccccgcuaauuuuucuauuuuuaguagauacgggguuuaaccauguuggccaggcugcucucgaacucccggccucaagugaccugccugccucggccucccaaaguguugggcuuacaggcgggagucaccgcaccuggccaggacucuuuaagucgugagcucccuuugaaacaaucucauuuauaccaacuuugcccagggagcucuguucuggcaagggcucgucucuuaccugagcgcacagucaccugugccagccacagaggccagguguugcuagacugagcaagcccuaugaguucagggccaaaaccuccaaaccuguuuucacaggaggccacaggaauaagugauaauugccaugaacacacaguggcagaaccugcccagagaaccaaagaggcuuuccaugcugcucuuucuccaauaacaugaaacuguccacaaggaaacagaaggcaggacccagcagagcuugcuggaagaacucugggggaacuagauuuauggaauaaaggagcuuaaaggcagaggccaagcaggcaugggaggucacaugaaaggagguaaagacacguaggggaagccaacaaaggggccagucacaaaaggugacugaggccugcuucaggguggcgugggugccaggaaaacuguggcuggaggccugagacugggaggccagcagcaaagagcaacugcugcuccaccugcuccugcccugcugggaagucccccuggagccccacagucccccacaccagcccugucuuucacugugggauaggucacucugagcacuuugucccccuucucugcagguaaaaucaaaguaaagugaaaaugaagaaaagacucaaagcuacggaggguagacugugucugcuguggcuuggccaugggccgaggccauccccaggauccuugggcaccgggagccccuucuuuucuccccagggcugcuucuggaaguuuugcuuagagucaaaagaacagaaggaaucucccagggcccuaggaggagccagugggucccuguagaucaaugcgguagggagggcugugggcuaggcugcuuggcugucuguucccucgccuucucacucacuuaucuguuggcugacugaccagggcuaccagacagccucccagcaaggccaauguucucauuuacaaggcaaggucuuuagguagcccuuuuuuuucuuuuuuuuaauuugagauggagucuugcuguguugcccaggcuggagugcaguggugcuaucucacugcaaccuccaccucccagguucaagcaauucuccugccucagucuccugaguaguugggauuacaggcacccaccaccacgccuggcuaauuuuaguauuuuuaguagagacaggguuucaccauguuggccaggcuggucucgaacuccugaccuuaugugauccuccugccucggccucccaaagugcugggauuacaggcgugagccacugcgcccaaccuagauagccuuuaaagagauguaagucacaucuacaaggagcuugacugagucccagcuacuccuccccucaaccccaagcucucuggccuccucagcagucagcagaguguccauguguaacaaagcucaauguacaaggaugcugagggcugaauaugucaaucaacagcaccuuuuuucucacuaaagagcaaagcagaaaaacaccuuccuuauaacaaaagucacugucagaagaggcuguaccuggaccacaugggugcauuuccacagaccacugcuuuuacuauacugacaguuuuuauuuuuauucauuuauuuuuuuuuaagagacgaggccucgcuauguugcccggacuggucucaaacuccugaacucaagcaauccucccuccuuggccucccaaaaugcugggauuacagguaugggccacugugcccggcccugacacuuuuuugugaggucaucaggcugcacguaugaagacugagaagaaucuuaccgcucucaagagauacuauuaagauugccacucacuguaccauagcauucucuuuggagaagccaugggagaauucucuggccucaauaacagaaacagcugucuccauucagcagacauuuucacuuuauaaguacuggcaaaacugauaaaaaaaaauuucccucuuugcuuuggcugcuacaaagcucagggccaaauacacaaucucaccugaguaaaaggcauaggacagagagguacuugccuuuuugugcuaauuucuuccuugacuuucuccuauuuuuuuuucacuccaugugccucaauugcuguuauuaaaaaucuuauuacaucaaaguauguuggaacaauuccucaaauaguuuuuuuuuaacaagauagagaaauuguuaaaacaaaaaauagaaaaaagcuccuaaacccaagauuuuauuccaauaccauaagaaaauaaaacccauuuacccaauacuucuaaaaagcaaauguagauacuaggguuagcacuucacuaucaaagugugauccagcaccagcagcaucugcaucaccucagagcucguugggaaugcagauucucagguccugccccagaaccuuggaaugagaaccugcauuuuagcaauaucuccagaugacuugguaagaaaaauguuucagaagcacuggguugguaaguaaggcuguuucagcacccugagaaggaacaacuaaaauagcuuuacaaccauuccuugggugccuauaugccagccacacacaagaagaaaauuuauggcccuugucuucaaggccuuugcaacaggacauuagaaaaggcuuacaccuuguggcagguuuuuaauggcuaauuauagaauaccacagcugaaagggaguccccagaaauaauaguauucccuagaaagaauuugagauucaugauggcuauguuaaaaacagaaucacagaccugaauuucuccugugccaguuacaagugaggaggggaaagguauuuguuuuggaaacuggaaauaauuuaagagaaaccaauaugccaagggagcuuacagcuacaaggaaaugugcaacuuaaccuguuuccuguaaccagaaaguggugcaggaaaaccuggaagugacgcagugucccccaggaguuguaucugacacuucuagcuggcagacaggucuaaagccaacaggaacauuucuugggcuuuucaugauguuggugaacaacauuaaagauaggagacaguuucuucaugagaacagauuuaaguuauaaggagaguccaccuccauaagcucugcuucuuucuggauggaucaaccagguaaagauuuuuugucagccacaugaggcccccaucuauuuagcuccucugauuuuacaugaccauuucagauaacagaccccguuaagaauguaucaaguacuacuguaacucuuggccaaauugcuauuuggcaccaaaucaaucuuuaguugguggugagacuccagacacauaaacagauaaucuucuacggaauacuuucacuguggaaagagaaucaggaaaggcuaaagggauguuuaaaaaucagacaucaggcugggcaugguggcucacgccuguaaucccagcacuuugggaggcugaaguggguggaucaccugaggucaggaguucaagaccaggcuggacaacauggcgaaacccugucucuaccaaaaauacaaaaauuagcggaacacgguggugggugccuguaauccuagcuacucggaaggcugagguaggagaauugcuugaacccgggaggaagagguugcagugagcugagacugugccauugcacuccagccuggccaagaagagugaaacucccucucaaaaaaaaaaaaaaaaaaaaaaaaaaggaaaaaaaucagccaucggauaaggugucaggcaccguggcucaugccaguaaucgcuugagcccaggaguucaagacaagccugggcaauauagagagacgucaucucuacaacaaaauagaaaauuagcugggccuggugaugugcaccugugaucccagcuacuugggaggcugaggugagagggacucgaccccaggagguugaggccacagugaguugagaucaugccacuguacuccagccugggugauggagugagacccugucucaaaaaaagggaucggauaaggaccaaaaaacagagagauccugaagggucaaguacuauacagauauuucauauuggugaguguauucaaguauccauuuauuuuucuccuaacgacugcuaacagcuaacagcuacugaucauuuucuuugugccaggaacuauauuaggcacuauacaucaauaucuuauuuaauccuaauaacucaccacacagguacuacuauuauucccauuuuuaaggaugaggaaaccaaggcacggagaaguuaaauaacuuaaugacacgccuguaaucccagcacucugggaggcagaggcaggaggauugcuugagcccaggaguucaagaccagccuggacaacauggcaagacccccaucaccauuaaaaaaaaaauuaaucagaguuaguaacauggcagagcuaaagccuguuugacuuagagagccugagcuuagcugccuuccuaaccuguaagaauaacucgcucaagaaguuaaauaaauguuucuguugugucaccuuuagacuaccacgcugauuuuguuuccuuuuggcuuccuuccaucauugagugccuuuuauguuccaagcauugugcuaggggcuggggaaaccacaauacagugugaugaguaaaaacagaggcugcagaagguagcccaaaaaagggaggaguuaucagucgcaggguggggaagugcuuuaaaaagcuuugcgcaaaagagguuaaacugaauuccuuggguuuuuuguuguuguuguuuucuaagugggccagaauugacucaacagagggugggaaaggggaauggagggaacaaaguaaaaaguggugacuucuagaucuuucaacuaaacccaaggcaaacugacccaacaaccuuuguuacacacuuuaacacaacacucuucauacccuagaucugagaacuguuagauuauuuacaaacgcuaccucccuucgugguccugaugaauucccagugagguccaaucugcccuggcaggcuuccgcucauuuuuguuacaaacaauacacuaaacccaaccuacuaaucaucaagggccuggaacagguuuuggacauucguccccaggcugcugagaacuguucuagugaugacaguuagaaaggguagcccuccgaggcaaaaaaaaugagacaucuugauuuuuucucuccgcaucugggcgcggcgauaagaagacaucacuggucuccaucuuuccagggggaaaggcccgagcugcauuagccccgacuggggagcuggguaaacagcccacgcccgggagaggccugagggaaagugaccucccccggggcccaggccgaccagcggcgcagcugcucggccgccagaugcgcggacucgcgcacucccucgccgcgcccgggcauucccaagcccagccgcccgccucggccccgaccccucggccgccacagcacacgccguuccgcucgcaagauggaggcgaaggcacgaggcgcccccgccccccagggagccuuugugcccuugccggcggggacgcgaggccagacggcccgcaccgcaagggccccgcaggcaccgaagagacgcgggggagggggccgggcgcgcgcgcggaucuagcccgggccaccgcccccagcgccgcggcacccccgacaccagcacccgcacgcgggacacugccuaccuaccgcaccgcgaacgcuucgcacguccggagcggucucagcagccccaugcgcuggccccgagcuggcggacccugacugcaacugcggcccuccaaccgcagcccaaaacgcgcagggcaggaccgagcgccaaccacg

SEQ ID NO: 16513 - RNA, 598 nt, Homo sapiens
gaugggugcauacaaguacauccaggagcuauggagaaagaagcagucugaugucaugcgcuuucuucugaggguccgcugcuggcaguaccgccagcucucugcucuccacagggcuccccgccccacccggccugauaaagcgcgccgacugggcuacaaggccaagcaagguuacguuauauauaggauucguguucgccgugguggccgaaaacgcccaguuccuaagggugcaacuuacggcaagccuguccaucaugguguuaaccagcuaaaguuugcucgaagccuucaguccguugcagaggagcgaguuggacgccacuguggggcucugaggguccugaauucuuacuggguuggugaagauuccacauacaaauuuuuugagguuauccucauugauccauuccauaaagcuaucagaagaaauccugacacccaguggaucaccaaaccaguccacaagcacagggagaugcgugggcugacaucugcaggccgaaagagccguggccuuggaaagggccauaaguuccaccacacuauugguggcucucgccgggcagcuuggagaaggcgcaauacucuccag

SEQ ID NO: 16514 - RNA, 7512 nt, Homo sapiens
uauauuuuaaaagaacccacugcauuuaccauucacaauguaaguuauuaggucucugagggccccaagagacuuuucuucuguuuaucaguguggggaaugcaggaaaaaguuaucuugaggcauaagugugaaagugaggaaucacugcuaugccacguggucuaugcuaaguacucuauaccuggcgccaaauguagcauguuauaaacuggaaacuguuuuguagaaaauuccuuuauuauagugcaaauuacuuucagcagugacauaauguaacaacacauuuagcaacauuuuacaccacacaguaaauaagaaaguguuucuuugaaaauaugucaucauaggaacauuauuucuacauuaaugccagaaaaugccaaggccguuuaucucaaggcaaacagggcucccuccuuccuuuuggguauuuucuuuuuaacacaaaugaaaugacuugccauuuuaacaaauccucaauucuaaaagugaucucucagggggcuuugaacuaaggucggcaagauuugaaauggggcuucaaaauuuuaaauaauaauuuuaaaauacuucuggaauagcccaaaaaguagaagucacuucuauuaaguuuuaaguagauauacacacucacuccaauuuuacuguagaaauggacagauugucuaaagccugcuuucuauucccccagagccugauuguuauuuauacuccuugguuuugguuauugcagaacuagggcucuggucagaaauaacaccuuacauacccgaauacuuuccuguggaagcuuuacauugcauuuuccauccugaaauucucaccuuagaccuuacaggcccaggagagggugugaauauuguuuucaguuuacagcuaaagccccuuacuaauuugggcuauaccugaaucaaaucaucacaucauuuagauuaaucccaauaggcuuauccaagcgguucccacuaaccucacagagaaacaaacaguuaacauuguauuuucacacuaagcugccuaagggcuuggcugcuaaugaguuagcugauagguagacagaauaagcgugucaauuccaaucaguacacgcccugcuccucuaguuucugcugaauuaugcagugggugggaaugguuggccacucaaaacagucuuccuauggggcucuuccaccauaaguuggaucaaaacuccacaaauguauuucaaggugcccuuuaagucucucaaauuuagggacuuuuaagugacaagccaugagaaguuaaucacaggcuugaaaauaccuggaaccacagaacagcccccacggaacaggcugaauaugguuaaauaaguuggcugguacauaaagcuuuucaauguacagccagucuuguuggauacagugucuucuuauauaauacaauggaacugugcuaaacaguuucaaaguugagaagaauccaaauguaucaccuauaaaaaauucauaauuuuaguuuauuuuagacuuugguacugaaacacugucuacauucuugacacuugaaaaugacauggucacuucagugccucugcauguuguguaaaaaaaaaaaaaaaacucaaaaaaggaaagcaggacaaggaugugucauuacaagacacaguaugcuguacaaacaaaaccuaaauuauauauaaauacacccccaccccagaacccugucuucccucacuaccugaucaaagcaaugccaagggucccucccuccagggccaauguagcuuuuaaaguccagaacccaggacuuuaagcaucccuugccuugcggugacguuuacaguacugcaaccuccuguuggagucaccuguuugaucaguuccguaagugcaggguaacaccuacagcuuaauuggaagcauucacucuacuggcuggauucaaagaccuggaguccugggaguuaaccuuucagauaaacuaacuggaucauuuccuaaucuggauccuaucuaauccuacuaucuccucagagccaacacaguaggaagcaucuucuacucugaagcuuccaaaggcauuacuuagggauauuggugagggucacauaagaaaaguuauacaaugagcuaacagcuuaaguugauauaaauuacuuccaaguaaguuauucagggccguuugcuucugcuuuacacugcauuccacagucauuuucauauuauucuuuuaaaaguuuauacuauagucacuuuaaaaauugucuaagcaaucaccucuuuguguuuuugauuaauaacaacuuaaugagcuauuauauaaaucaagagagaaauaauuagucuuaaggaagccaauaaugugcuaauucccaguaaggagaaaaagcaauguaaauagaauuuuacauaaccaacaauaacuuggaaagcaguuuuaucaaaaugguuuugcaaagguuucccaaaagcacuuacagcaguuuauaucaagagauccuaaguuuagggguauggagaaucucaauucuuuaaagcagaaauucaccuguuucauaauuguaauauguaauuuucuccccuuggaccuaagauauuuauacauucaaaaguuuacaacuugcuguucuugagacauuguucauucuuuaauacauacauugaguauaaauaaauaacuacaagaaagcuucaacaaucugaauuaacauuaugcugugcaaaacaaaaacaaaaacaaaaacaaaaaacaaaaaaaaagucaaaccuugaacaaccuacauucuauguaaauacccugacuaaaauauugguugugcuacacaauuccacuuuagugcagaaaugcauugauuucacuguaccguuguuguuggcuuuuuaagugucuuuagcacuucuguuucuaagcauugccuugcuuugaaaagaugaauaauuugcuaccaaaucacaaaucaucacaaauccauuuuaguuuggucugaauaaaauccagcauaaauguauuauuuuauucuggguauaauggcucggugucuuugucccaacagcuuucuucuuaagggcaaaccacccuuaagugaaacuugccauuuguuuuuguuuucuuuuuaagucuccagaucuugcuaggacacuucuuccagaccaacagucagauaguuguggcacgugauccuauuugaaauagaggugguuuaaaucagccaagcuuggugaucuggaggucuccauuuaucuuuauggugucaauugcagauaacguuugaaugcgaugguaaaaaucaaaaaguugguguccauccacaaacacucggaaacgugggugcucacaaagaauuuccaccuggaagaaacaaaauaauaauccacaauuucaaugaacgcuacuggggaaaacaaacaauacuucauuuuagagaaagaaaggcaguaucuucagugguucacaaacaucagaaugcauugagaccugcagagggcuuguuagaacacagauuguugggcucuaccuccaaaauuucugauuccuguguagaauguaaguguaaaagcuuuuuccucaaguaauuuaccauaaaguucaauuacugguagugugcuaugauggguuuauuaaaagcauuggcauucaccauguaaggaggcuccauaugugauacuagucacauuuauuuuauauuacuaaauuuuaucaccaagaagggccuauuucacuucaguuuugcuguugggagcauuauauuccuccuggcagucagaagcugugguuacucacauucaugagcuaugcauuaagguucaucacuaagaaacuauccuagccaagaggagcccaaggggacaucaccauucuagagaaggggaugaggagagauaaugggucaagggugccuuccagagacuauaacuagaagugcaacuaucucaauucuaccaccaaugcaaaaaucauggauucuuauuuuccccagaauguaagaagagaagugaaagaauuacuucuucaugaggcacuugaaaauuucuagaugaaggguaaccaguuaaguguaguuguguuuuauugggcucacauguaacauggagcuuuuaacugaguugucauuauugugauguaauguuaagguguaaugacaauucaucacuaggucugaccccuuuuuaacaccauuacuacuugcauuucccuuuauuuuuuuuuuuuuugacagagccuugcucugucacccaggcuggagugcagugaugcacacauagcucacugcagccuugaauuccugggcucaagcaauccucccgucucagccucccaaguagcuaggacuacaggugugugacaccauggcaggcuaauuuuuuuuuuuuuaaaggcaggguuuuugcuguguuuccuaggcuggucuugaacuccuuugcucaagcaauccucuugccucagccucccaaaguggugggauuauaggcacaagccacugugccacuaccugcaucucuuauuuggcauugccuuucauagaggaaggggcugcuaaugcugcuugauuggaugaaaaguuuggauugugcuuccugcccagaagauaguggggagcaaaucuuuauucauccagccccaagggaaggaauuugucagccacacagccuguaaccaugaaauagacugaggcuaauuaauccagagggggaaacaaggacacgaacauggccucauuagcaaagggaacaagagaaaaugaaaugaucaucaucauauucuuuaaaaugucauacaaauaaaagagcuacuuauuagcucucaaccuuauuaauauuaauauuuaauaaguggguacuuaguauugauuaaucaaucagauauuuggggguagguaucuacuauauguuggguacuacauagaaaaguuacuuauucuuaacaauuuggacauguaaauaugggucuauuuaaauguaugaccugaauagaacuaagaagauacuauggcaaguguuaauuuauaucagcaaacagagcucuuuugaucuuuuuuuuucaccauugggugacaaauuuccuggacaugcagaaauucuggcugcuucaaguguucuuggcacacacuagguaagucgaacauuaucagccugccaguggcuggagccgaggcacucgagguacucacccugaauggcuggucuggaaugaauggaaaguaagggauugcugacuguucuucaccccucuccccagauauacaagaauuucugaguagcugccgaucugugaacacagcuuugaguucgauugccacaucggcaggagggucuucugaguccccacaggucaagcugauugcaaagcugaaaagaaaaucaucccacugauuaaggguuggauauaaaaacauuucaaaaugacccaagugcuuauauuucuucuuccuccucuggguuuguccauuuuuaagaggccacuacucuucaagagagguuagauuauggagaaguaagucaaaccagcuuauuuuguuaccuaaagcaagcucuggugaaaacuuugguguugaaaaugacuaaaauuagagaauuccacuucggaauucucaaaaacagccacagaaauugaccaggggaaauaauguuaaguuggguucuuauucaucuugauaguucuugcuccuggcaccauguuucaaaaccauuaaaaaaaaaaaaaaaaauccucuggccucccuaagggucaaagagaaaaugugggccuauauuuauaaucucugauauaaauagcugucuggagaaaugauggcugggauucauacauauucguuucaugggaacaugguacuuucuuggcacuggcaacuagcaacacuguccacaaggagaggaagaggagugcuaaaccacaacagaagugggcagggcucagccacagccugauaguucuguccugacaaagacucugccuuaccucucuggguugaggucuacgaugcccaucacuaacaccuucuugccuggucucaugccaccuuuaaugugcccacaaaauggaacuaucugaaaagggugggagaagaaaaaugaauuuuacagccuguuagggaaaagccaagaccucagacccugaaggccugacccacuggaaaaugcaauaaacaaaugaauaaaauuuuaaaaagcaaugagaaaggaggaagguacaggcagagacacagagcaaaaucauuuaccagucgugggaaguacacguccgcuugaacuggagagcucaaagaguuguuuaaauggccaucaucuaguuucuaaaaauagaaguacacagauuggcuuuccaugggcucuuuuuuggggggcuggaggaagaacccacacagaugugguggaauccagcagccuuccacaugcacacagugucugcagaugaugccucuucaccgucucuuagauaaucucaucacccccgaacaaaacccauccuuuccacccgguaguuaagccucugaagauccgcagacccuucagauccagaucaaaaucaaggucgagguccaccgaagagccagagccccacgccggaggagggcaggccccucuccaaccguaaacgcuucuggaagcgcggugggccaggccuguccuucgggacgugacugaagugcagcggccgugcucaacuucucucgggagccccgggcgccgacccauuuccaagggggaauccccgguacgucgggggcgguggcggggcgcgcgccccggacacacucacccacgcgcacaccuggcuggcgguugcacggcacagagggggcugucgggcgucccuacccgccauccuccccaaacucccuccccagcccagagccccgcagcccgggagccucuccagccccuaacaccggccgcgcgcagccagcggcugcuaacagguaccgggcgccuucccacgcgccgggcgccggccgggccugcggcugcucagcaccccagcacugcuggagcaggcggcggcggagugcgggacggcggggaggggcgccucgcgcgcgcccugccacacucaccaccacggcaucgcugucggccacugaucccgccaucuucuugcccggcgcggcgggguacgugggacgcggcgcgcgggcggggaucccggggcuguccugcgcggggcgggggcgggggcgcggguccgagcuggcggcgggcgcgcgcacacacgagggggcgcgcgcgcgcgcgcccggggcccggcgccgaccuggcaggcagagccugggaggaggggaggggagggaggcagcgcgagcugggagggcgaaggugcuugccgcggcccagaacggccccggacccgggccgacggggcugcuugcugccgcugccgcugccgcugcccgaccaagaaaaguggcgagggccgugccgcgucggcccugggcagcauuuaaaggccuccggggcccggcucgggaaccgggaacagggcggggacccggcggggcugccgcggcuugcucagcgggcccugccccucggccauuggacgguggcg

SEQ ID NO: 16515 - RNA, 8293 nt, Homo sapiens
cugacaagccguucauuaauuugcauuuauuuucgggaaguaauguagauaaagaggaggagggggacugccuuacauuucaacaaguaauuugugaucuucacaucagacaaaucaaauuuacaaauuacuuucccaccuacuggacgaagcggccaaagccaaaauugauacacaggcgcgcgggcucuccgcagauuucggagaacgaaggugcacuaaaaacucacuagacaaaacaaggguguugaaagagagaagccgacagaggaguuggaacuggguuuggggccuggguuuguuuguuuuucccuaaugcuguacuuuuacggauuuuguuuuguuuuguuguuuuguucccugguuuugguuuucuuguuuuagguuuguaaacuggaacugcgacccugugcuuagaccgggugagggggucagcccugcgccccugcccaacccccaccucuguacccugacuugucuguuuccuccacacuucggauaucccgcgcccagcuuccugaaaccaagcgguucucuucaauaaauacacagagggagaagaugugaagagggcagggcagcuuugcaacaacugaaaaagaaaaagcgccauugauugaggaagagcagaagggggacggacagagggaaaauauuuuuugcuuuuguuuuuuauauauguguauauauauauguauauauauauauaugugcuguauauaucuuaaaguucuguuuccugggugcuaagacaagauauguucaguucaaccaaccaacagcaacuaaaaaguuuaaguggucccuggaacggaccugacuauguacagcguucccgccgaggcggaagcuugaaccaguccagcgcagggcggggcgggaugcggcucugugcgcggaaggcuggggacgcgcuccuccggcgggccuagcccuggcgcgccccagcgcacuccgcuggggcggaagaaacgccgggaggcucuggccggcaggcguggagcaaaaucgagggcagcugaaggggcagcagucugcgcgggaggaacucuuagugguuuugauuuggaguagugugcgggugcuccaaugggcagaaacacgccaguuagugacuccaguguccagaaagaauaaauuaaaguguugggcucaaacagcggaucagagcgcagagccuccgaaggcugcaagugcuuaauagcuguccagaaagacuggaaggggaggcuuaagaguuuaguaggggcugaaggggggaaauaauacaucucuccuguauagaauguguaggccaagccgaagcaccgguccccccauccaaggggcaggguggguuugcacauccccccaagcaaguggcacaaaaaugggggcggcagugcaggcaauggacaucuuuuuggggggugaaaauucaguuuuggagaagacgaggcaaaggcgggcggugcagcagcagcaacaggaucgggaccacggagggcgcagguaguugcguuucuucuccucuuucauuccugggcucacaagaccuggaaccgccaugaggcuugguccuuauaguccagacagucgggggaguugaaguugaguuuccaggcggaggaagcagcagcggcgccaggcuccuuguaauccaagcagucggcagaguugaaggcaagcccagagccaccguagccuuggugguggugguggugauggugguggugguggccugaggacuggcucaacggguggugcgcauguggguggugaugaugguggcccgccauggaggagggugccauggggcugagcuggugcggguggugaugugagugcaugggcgcuagguaugagcugcaguccacgccgccaaaguaggaagaggagggcguaggguagccuuggccguagcugccgcccuggccguaggacaugggauaagaggcugcugcgguggcggcgccugcagcuacggagcgcugcauacacgagguguugcuaggcgcggccaauggcuccggcaccgacacggacgcgggcgcugagccuggcgagauggaggccgggcuccagauagaugaggcagcugguguacucagcgacgacgcggccgccaccggguucccaccuagucccgcagccgcugcagccgcuggguuggcggaagagcuggacgccgagcuagaggacgaggcagagcuggacacagcuggcggcgugaauuggccacugcuuucggagcccgagcucucccgcacuggagaggacuucuucuuggcugggcggcucuugguuccgcucccgcucugcugcugcuggcggcauuuggcgcggcgguucuugaaccagaccugcagugggccggaugggggagagugggucaaagggagcuaggggagcuuguugcuccaccgccccgcggacccaacucccgguccagaauaucgcaauccuuucucaccgaggccuccgccccuuccugucucuggccuggccagacccugcccccuaccucgguucccagcuccuccacccucccccauccuucugcucaaagccccuccucagcuggcuccagagcagggaugcgcaccuccccaccccuaccgcaacucugcccuagggcggaauauuucagucugcccagucagaaguucugccaucucuaaauugcugcuguuggcugcuuccguguauguuuggaggccccguguguguuuggaggcccaguuuucuacuaacagagcucaggcaacaguggagagguacagagccgaagaguguggaacagucaccaagucuagggccugagccguuucacugagcagcuccuggaggccagaacugggcagggcgaguauuuggguggggguaggagcaaggccagaggcuaaacagagguaguacuugagggacucgggaaggaagccugggugggauuucguuggcccuuuggcuccagguggggaaccaaauggaaugguuacucuucuaggagagccccagcacauggcacugcauuccuggucccccuucucaagcuuucgaguaaaggaggcgagacucuugaggagaguucugaguuagaauccgaacguuaucaucggaacccuuucaucucaaaaacagaaauaagaaagccggcagcaggauuuugcacuuagcauccucuguaagcagaggaagcgucuaaugagacccaggcagagcaccaggcuccagccaaucuccgcucuuccauuucuaggauucccgggguggaagacaagggcagaggcagaauucaggccucuaagggaaacugccaaguccuggggcaggcgaagaagcaggggcaagugucaggcccgcagggcgcuuuacauucgggagcuucccuaguccuccggcaauucuaaaaaguacuuucgauaccgacaccgaaggcgcccuagggcuaaaggcggaauccagggcucuaagccauuuccuuuaacuuuugcccccuuuccuggcuggggcccagcgcuagggggaguccgagagcggcugcccagucuguaagcccacccccacaggauggucuccucaagaacuacucaagagccuuccuagaccuuccccgagcagccucagcuccccuacccagacccuggagcccggggagugcgcaccuggacucuagacuccggcagguugaucuugagcgccaccuccucccgcaugaagaugucaggguagcgagucuuggcgaagagcgccucgagcacguccagcugugaacgcgugaagguggugcgcucccgccgcugcuuccgcggaguggcugcggggacacgcgggggcgccgcgggucauugguggccacguggacccgcgauagaggacucgggcaggccccuggcaggcccagaucucggccuucgcaaaagaaagccgaacugggaauaaaagaaacucccucgggcggccgagccugagaggccacaggugggagaaagugcagaugugcgacuagaagccagugucuccaagauucgagggcugccccucucuaugccucucagagguuaaaaaaguuaagagaagucuacaaucucccuucuucuacauccccucuccccugcacacacacacgcacacgcacacacacgcacacacacacucuggaugggggacagggaguggggaagagguaggcagaaacacgaccugaaaaacacuuucggagaaaauaaaugagguaaaggagcgggagcuaaaaaagaaaccccggcuuuggcucaagucguccucuacagcagcgcaaaaaugggugcaggacaucgauuuagaggacaauuuaauuagggaggaagaauacuccuucagugcagccugccgcuucgcauaaggaaaguuuggcucuuucugucagggccuaacgaguguccagauuacacauuccauguuggggaaaaaggaaaaauacuagccgccccuggguagcgaauccgcaaguaaaugagcucugcgcuggcggugggaccacaaccggagaaagguugccggugauccggccgggaaggcgcauauugcgcguuuucucagcccuggccaccucacacgcccacgacucugccccaugcgccggcagugggcccuguauuguaaacagacagugggcccuguguugcagccggcucccugggccugcucagcaacaaagcuugcacucaaauccaacagucuggggguccccaacauuugagaggcugaggcagggucgggagggcuggugcucacccggauagcccacggaugggugcaggagguccauggcgggcccggccaggcccagcccguucaugccguauggggguuguuugagguaagacaucaugcuaacagcuggguggaggcgccccgacggauccagggggcccggggccaggagcggugcagggcucccaccacgcaguccuucagggucugaugcgucugggggccuggccuaugaagacacgagacacacggaaaccgucaaucggagccacuuggcugccaagucuugccccgggauagacagggaaggcagguuacagaacugcgcaggguggucaacugggauccacaaggccuuagcccagaaaccacaguuacuuugaaaaguaaaguuuucugggucgucuggcucuaggguuggaaugagccaaagacacugguagggaguccauaggaguaaggagaaguuaaaagcagggccaggcuggggaggucagagccagaaccgcggaguguacaagcucccaaguccaggcaaaauucugaauccggcagaagccagcuucauguugcacaagcaaagguucacuuggugcccggacggcaggccgcccagagcaugaggcguuguuucauuuuguuucacguguuuuugaaaagguagagacuacaaagggccaauguggagggcuaauugcacuucuuguccacuuagacacuugguuccuuuaaaggucuccagggcugcgccccugccccagaucccgcaaucaccacuccagcugaccucucugugcccagccacugaaagaucgcugacgcgaaaucccaccgcaccucaaccgcaguaacgggcccaggcuucgcagagggccagaggacgccgaaggggccacuguagaggggggcgaccccaagaugcggccugaggucgggagcgccucagcugcggccagcguccuucguugccagcgcgcacccggccuucucucugcccagucugggcugcggaccgcagggucccagcagggggugaagggugacuggccuagcaccucaaagggucucggggauuugugaagccggagggcagcaagucgcgugcugccauccuuguagcugaacccgcggccccaggacacggucgagaacagagaacuaggccucagcggcguagcccacgcagacccgagcugggaggucgaagccucgcccccgccgcugccgggaacccggggugccacucucaggggucagggaggggcgcuggaaacugggccuggggcccuggggggccaucgcuacaccccgcuuagcgggaucgcugugaagcaagccagggacucgggcuaggacguucaaggagagaaguuagagcuaaagaagcuccccccagccccguucccgcccccgucuucugggacccaagaccugggcugagggaguccagcuuguaggaaggggaccggaagggaagcagccagggcucuagggccgaaggaaaaugggacucaaagcugcgacggcuuugcgaagcugcagcgugaguuuucaaagacuuucuccaaacuuagcacuucagcuugguuacuucggaggaggcgggggagggggcugcgggccgcgacagcgccccgggguccucggcucaccaagaggggagccaggccgcucccacagccccgaccaccugcuggggaccggggaagccgggauccauuugaggagggggagauaaggguaaccaacgcgcucccggaguccgggguggccccgcggcuuucuccuuaccugcccucagcugccggggccguucaccaucuaccuggaucucucacagagacccgccgggcagccaaccugcaaaacagagcagcacuggaauuacccuggcggcuggucuaggacccccagguuucuuucuuuucccaacuuccuucuucccaccucuaucuuuuuuuucaauggcuuugugcguguccuucuggguuucacuuuauugcacagacacuuuguuugcuaagccccacacguucucaggacauugccucgccugggaucgcgccgaggggccgcaagggggggaauucgaggggcagaguugggagguggcucggcguugccgcggcacucccggugcaacguggaggcaguggggacugggaaguccugcagagucacuuugcaaacuaaauaaaucaagcgauuuaccuugucggaguggcuugucuugcucgguuguuuaggugauuggaaauguagccugaugaagauugaucaccuuucuacugcccuccccggguaugugaacgcgaggcgagugcguaacggggcuaggccgccaaucgggggccccgcgcgggcugagugacagggagccgggcaauggcugcgcgagccggggguuaccuccgcgcgcccccgcccucccccgccccccacaccccgcccuccccgcccucccgccccgccccggucgcgcgcuaacuccgggacucggcuggcaaaagcggcgcagagcuaggcgaggaaggcgagcggagagcccgaguccuggccgcggagggggccgugggucuccaggccugcccugggcgcccccgcccuucucgcgcucucggcgcuccggagggaguggcagggaggaggcgaggugcuggagaaccgguuccuucgcucucccgcgcgcuacagggcucagccgcucgggugugggcgccaggacccgggggcggcgggcuggaggagcccgggccucggccccucucccggcgccgcgggccccagcguuuucuuccccggcgccgccaccugagaccgacgccgcgggcugcucgugccggcgcaggcuacuuugcagagcgcgggagcagcuccgggcgugcagaucucuccucggccccuccggacucucgcgccugggaagagcacccacugggagggcgccgccacuuaccugcuugcucgucggcaucucccgggguuccagguccccaccaaggguguuugcaagucuuaagcgcuucuacugaaacguuggagcccagcguccucuuccccucacacguacacccuacuucuuaauugaaacauuuugauaggaaaguuucuuuuucgcucuuucucucucuuucuuagacugccucuaacagggacuuuuugauggaaaauguggccacagaccccugcccucaacuuuuuuccacaugcugcguaaggauccuccuugaggcgauuuccccggauuguucguacgggcgaagcccauuucccacccgaaaaaacuucccaaacacgucuaccuggguggacuuuuaaaagugcaaaaaagaguuuucguuccaacucuaagcuaggcgaaucuuuuaaauggcaccuccuccugaaaauuaggcacuuuauucccuuucgaggaauuucuaccccuuguuucuaaucucccccacucccccaccccgacaggcgggguaaaaaguuugcacaggauuaagugugagggcaagucaaggagccuccaggcgcaucgcaguggggagcacucgcgcugcccgggcugcgg

SEQ ID NO: 16516 - RNA, 1440 nt, Homo sapiens
ugaaagcaacacacauuuauucucuuucaguucugcagaucagaaaucugaaaucaguuucacugggccaaaauuaagggguaagcagagccugcaggggcucuacauuuccuugcccuuucuagcauccagagcugcaguguuugcauucuuuggcucuuggccucuuacccaucuucaaagccagcagcauagcauuuccaaaucucucucucugucugcuuccuuugucauauggcuuuguuugucuucuguaguaaaaucuuccucugccucucuuuuagaaggacccuugugauuacauuuaagauccaucugaauaauccgggauaaucuccccacucaagggcuuucagucacaccagcaaaguccguuuugccauguaggguaauauucacagguuccagggguuaggaccuggcugucuuugggggccaucauucagcccacccagucaguaaccugugaaaugcacguggccccaucagcucaugguucgggguuggcuggucuugaggaagacaucaggcugaaggaagucuucuggagguaggcccuggagggagaccagagccagucaugcuagagaccucucaccucuuucuucugacucaucuccuuucuagaaacuaugauaugaggcguuugauagcacgugugagccuggaggugcugaggcagcuagcacuguuaccaggguggcggcggggacaggaccagaacuuggggccucgcgcccagguccucccguccuugccuucucccagcuccccuccaggcuaaccaccuccacgcgggggccgggugcugcugcugcccugagagcucagccccuuucccggggcgggcaccgcuucccggucccgggccucucugcucucccgaggcgauagccacccugcgaucucucgcgcggccagcaggggccagcaucccccgcggaaagggucgcugggcugggcuggccgagagccggggaucggcgaccccgggcgccgcugccaagcccccugccgugcgggcugcugcuucgccgucccagccccgcagccuuuugugucuuuccacuucuccccuggcccgcugcgcucucgcucuagagaaggcagagacugccuuggguguggcagccaggaguggacgguugcgggcugggaggcuggccggguuuccuccccgucgcggaccuggaggaagggcugggugcggcgggaaggccccggagggagagcugagccuggguugguagcauggugaggaauagcggccucaggggcagagauguccguuucuuugugcaccgaaagcucugagaaggacaucccgauaccagugaacuucuagauuuggaaugagcuucuuaccgagcaucucacauuccaaagugcaucugauucggaaguccucgugguucuaccuucggaagguggggguggggu

SEQ ID NO: 16517 - RNA, 2905 nt, Homo sapiens
uuugggggagccggagacagaaguggcagagguugggggugggggguggggagcggcugccggcggcucuuuggcucacaaaacaccugaucuccccaugcggcacgggaggccggcgcagugcgaggguggggugcgggggugcgagcgaggaaucacgcgcgccccccuccccgaaaugcccgcgcgccccggaugaggaggcccggccccagaugccccuugccaaagcccgcaucgccccggcgccggaucccccggaaguuggggugcagcgaggagggggaagguccccgggcuccagggcgaggugggcacggaauggguugggagguuccaaagccccgcagcgggcggugucccucuccucucccucugggcugagguuggguggcugggacggcgggaagguaagggaggcuuaaaugcggcaggagccaccuagggacggcuuccuccaccggggcgcggguacgaagccggaaccggcgaggaaccgggcggggguagcaggguguccggaagguggggccgggaagcagggaggcggaaggggacugguagaggggccuggcggugagagggcagcggggagggagccggcgggggugcucggcgcccgggcccuaccuuguccgggagcagcuccagcucggcggggcgggggcaagggcgggagaucgcggccacauccacgucccggccgcuccgcgcggcucagcccggcgaccgccgcagcucacgcuccaugcgcggcgccccggacgggcggcccggcggugucggcggcagggacugcuccggcuuggcucugcuagccuccggcacuuguugccgcugcugccgcugccgcugcgccucacuccaggcuccgguuccaggcgcagcagccgccgcgggcgcccggccccgccccuccccugcccgcccgccaauggggcccggccccgccccucacgucaccgcccgacggccccgccccgcgccccaaguuuugggaggguuccgcucuccccacccgguaccaggacccacccgggcccgcgcucccugcggcuuccagggacccuccagcccccacgcacccuccugcaaagccgaggguuaagcuggggaaagggggccucuaggaaggcgaccccccuggaaaugccuggcagcuccaaaaacacuaaugaaacucagcuccagccuccgccccuccaguuguggguggccccucuugcgguucgucugaggcuaggggacuaggcgcaucgccuagcgagacuccaguggccuuuucuguccaguuuguaaccggaacuagaccgaccccggccgcccccuccagugcuggggcgggugaggaauggccccgccggggaggcgggggagggaggccugggccacccuggggucugaccuuugcuccaccucuuaggugcucacgacccagaguggugcccugcuugguacugccacuggauccucuggcuuaugaagccguccaggacaggaaggguggggggugguccuuaguucucuucguggggucaugcagagugguuuccucgaggucccacgcccgucucaggaagccagaaacgcaagaugccgggcgcucggcccgaacccgugccgcggcccaaggggcaaggcggauaccgaggcaaggccuaaagggccggacucugaccgcacccuccggacacugcagggcuccgccggccagaggcggccuuggcgccaaccacaccuagcagcgggguccccgggcccaccgaugcgcccuccuagccccgcgcuccuucgagggguuccaaggugacucagagacgcagcugacacaauucugaggcccccagguaagccuggcgauaccggauggagaaguuaccuggucuugaaaggcccaguccagccagcgagacccgcgugcgcuccgcggggaggcaagccuaaccaggggcucaccuggaagcguccccgcccccugguccuuaucucugaaucgaaaccgaaccuggacccaucuagauaauuggacugagcaauuaaggacgcuucgcuccuaacuguuagcauuuuuuccuaaggcucucggaggcggaaucagcuggaaaggaacauugcuaaguaggaauuucaggcaccugugaacugagcccacucaauaaucggcccuuucccuuaaccaaacucagcaaaggaagaaagaccaaguugcugcggaugcacagagccacgugggugcggguccucuagaaacaggaauucagagucaguagauauggaaauguuaugguuugcagucuucggaccaugcugcuuucaugcuguucacaugauucuccucggacugcgagguaaaguccaagaaacaagucgaauguuuguauuuucauagaaaaaacaucuguaagggugcacaccgacuguuaaccacgguuacgcggggaggggaaacaagggaguuacauuuuuuuacucccuugacuuuggauuuuguauuuuuccaguuguauuuacuuucauaauuuagaaagcuaauaaaacauguuuaaagaaacagaagcuagaaauucucuaagaacucuaggaaguagaggccgggcgcgguggcucacgccuguaaucccagcacuuugggaggccgaggcggguggaucacaaggucaggaguucgagaccugucuggccaacauggugaaacccuguuucuacuaaaaauacaaaaauuaauggugacauguaccuguaaucccagccacuugggaggcugaggcaggacaaucgccgaacucagggaggcggagguugcaguaagccgaaaucgugccacuguacuccagccugggugacagagugagacucugucucaaaaaaaaaaaaagaacucuagggaguauaaauuaauaaauga

SEQ ID NO: 16518 - RNA, 1329 nt, Homo sapiens
gcgacagcggcgcuucucaaaccuuuagucucccaagagccguuacgcgccgccccucucaauccccacaagucugggccccuaaccuccuagcccgucacagacuucuccgcgcagcuacgcugcaagaggcucucuuagcuagaaagcaaccacugggcggguaccugagccgagaugaaucccucauacacgguuuucgaccgguucuggggcagaagcagggggcacuggcgcaacaggcucgcuuccgucaccgccauggcucgaaguccggagaaacacagaaaagcucuagaccugcuggguccugcacaugcgcaguccgcuggcgcucggacgccgcggagcggaaaccccagccuuggcgggaagauccuggaggauuccgcgggcggaaaugaaggugaagcgcaggccaggccaaguggcgcucugcgggaggcgacaucagggcuccccaaccgguagugggagggaagauugcccucaaguccacaggacugacugaccaagaucauucuagccucaauugucccaggagcccuuucgaugauucuguuuuacuuuauugaaagacuguuacaacuuugguguugcauuuccuccagaauaaaaugacuuuuacagccuggacguuguagcacucugucuucuuugcuguuguccucucucccuuaacauacagaauaauguauuauuuuguguauaauuauuguaauauaauguauaacacauugauuauaucauauauauuacaguucuguggcuuacuaaguucaaucagauauauuugaggcacacacauguauacguauauguguauugauuagacucaagucaacacuggacucaguucuguguacggcacucacaaauauauaaagcaaaacaugaguaaagauugcugauggacuugaacuuaauuuuccucugacagcgcuugcaauauguuuuucuaacucaggaauguuauccaucccaucuuauuaagaguugauuaaauaagaaaccuacuaaaauauuuaccauaugauuauuugauuuuccaauuuuccaauuuuccaaugcaucacguuugagcccuacuauuugaaaaacaucauuguaaugugccaaagguugagcaaagauuauuucguccccuacccaucuuuauugaccucaagacagaauuugacauccugaagauucuuaaaguuugacaagaauuugucacagcauucuggaugcuuacagaaaagaaugcuggagcagugguuagauauaaauuacauuaaagcagugguucucaaaacgugauccuagaaccuagcaacagcaucaccu

SEQ ID NO: 16519 - RNA, 3223 nt, Homo sapiens
uaucuacauauaauuaccuguauaugcauagaauaucucuggaauaggacuagauacauacuuugugggcccagugcaaaauaaaaccgcagggcccuuguccagaaacuuuccugaauuucaaguuagugacagcaaaacauuaaaccaagugccuaucuguacaggucaccaccaugaagccagcccugcucuggcaacauacacaggaaaauggaauagaggugauuccaagaggaaaauucuaugaguggcaggagacaaagacuaaaagaagacuuaguuuucacuauauaucuuugccuuuuuuuuuuuuuuuuuuuuugagacagucugucacacugucccccaggcuggagugcaguggugcaaucuuggcucacugcaaccucugccucccagguugaagcgauucuccuaccucggccucccaaguagcugggauuacaggcccccaccaccacgcccagcugauuuuuguauuuuuagcagagacaggguuucaccacguuggccuggcuggucuggaucuccugaccucgggcaaucugcccaccucgcccucccaaagugcugggauuacaggcgugagccaccaugcccggccucucuuuuuaauuucauauguguaaaggcauuacuuauucaaaacaacaaaaaaggaagauugugggcuuauuugguuagcaacucuuugaaguggaacuuugaugacugccugaagcaaagaacaucugcuggggaagaugugguuauggggggcccucagacuuggauaagcacugagcccugugcuuuggaggggucugaaauccauggaaucaugggacuguagccaccugcagcccacuuucccuuuuccagaccaugcugugggcacucuaguauucccuaucccaaacgccaagccugacuccagggucugcacaauccucuucccaaguucagucuuccuggggaguaaccaaagggugaggcuuggacagaaggcuggagagucuaacaucaggcucaaaaauugugugaagcauucucugacucuuccaagacagaaauguuauuuucucugaggucaaaauacauuuuguccacuuucaucacaucaauuaauuggcucuauuguuauguauuauauuaugaugauuuucuucaaguacauuuucugaggucucuagauuaaaaaaaaaaacuaugaauccagauuuugaaauuauuucuaucagcauguguucuguacacugacccacguuguaguguacugcugaaggguguccacacuuaagcgaucuggucaaaacauaagcacguuuuaacaagaccauugauuaguuaugacuacaacucccaagaugcacugcagggucagugugcgcgucucgccuaguuuucaccgaucaggcuaaugagcugcacagaaguggcagcugaacaagcugagagacuguauuaaagaacgaauauagcggggauggggagcaggcgucuacggucccagcuacucgggaggcugaggugagaggaucgcuugagcccucaaggcggaggcuacagugagucgagauagcgccauugcacucuagccugggaagcagagagagacuaucaaaaacaacaaaacgaauaaagggauucuaccaagagugagcuggacugaaauaaacgacacgcuacuacgacccagcgcgugacuauauccaccgcacaaugugcgauaauagccucaaugcagagagaauuccuccuuuccuuauucagugcaagagagcccuauagagaacgcaggaaaugcccgcgagaaacugagaaguaucaaaacaaucacagauauguuaggaaaguagcuccccgccacuucccuaaacuuaucauagcagacuuacuuuccaagguuacaaacacaagaagagcacuguauuuucaugaagcggaaaaugugcuuuacaaucgccagcuacuaagagccuuaacggugaagcgcucugcaagaaacaggaaaucgucaacacacuuucugcaugaauugccuggagaguuguguccauagacaauuccugguuagaugcuuaauuguagcagacuccauaacgggguuuagcggguuuccauucggcagaaagggcuccacguucuuuuucacagaaagguuuaaacuuauuuuuccuccucaggcggacgaagugagcgucguuccgugaagguaugaaacccuuuuccuuccuuucugucccugguuacuccgguucaaggcuacguacuuccccgguuugcuuuguuuuuuccucagagcuaaguuccuaggaacgucacauacuggugccauccaacaacaugacgacgugcggaaccgaaguccccuuccaccuagcggccucucgcggcgcaggcguggacggggagaucgcgagaaccucccgcccaauugcgaccccgcgccaagaggcggggccgaaagaggaggaagucgggccgaaagaggaggaagucucgccgaaguacucccgccccagucgguaccccuccucgcgagagcgccgagcauuccggccugggaagcgcgugcagaagcggaggugcugcucaugggacuugucggccgccguagccccugcuaggacagcccgugcgagccugcuggaggaggaagagaaaggcagagagagucggguuacaagauggcggaucuguaguaguuaccgcggcggcgggagagcaagcgagcccuggggggcaaagagacgggagaguggguguaugcgcgggugaagugagagguaacggggcuccgggcggagaggccucaguggcucuugucaccccuucucgcggcugaaccuuuggagccauggugaauucgggccucuccgaagccgccgccgccgccaccgccacuacugccuuuaccgucuccuaagagugaggagcgcggacgagguaagcgaggaggcggcggcuagagcgguggagacagcagccaccaugucggauacgcggcggcgagugaaggucuauacccugaacgaagaccggcaaugggacgaccgaggcaccgggcacgucuccuccacuuacguggaggagcucaaggggaugucgcugcugguucgggcagaguccgacgguaagguuaucggaacuguagaauaggggauagugccucugguuggggcacagcuuggguuuagggcccugggcccguuaccguugcuacuccuucgggacagcg
